United States Patent 9,328,353 (ISOLATED POLYNUCLEOTIDES AND POLYPEPTIDES FOR INCREASING PLANT YIELD AND/OR AGRICULTURAL CHARACTERISTICS) - sequence listing, part 2

SEQ ID NO: 1489 - DNA, 2222 bp, Pennisetum glaucum
gggacgcaagtcgatacaagattcaggaagtcattggtaaggggagctacggggtagtatgctccgcaatagatgtccacacaggagagaaagtagctatcaagaagatacatgacatctttgagcacatatctgatgctgctcggattctccgcgagatcaagcttttgagactcctaagacatccagacattgttgagatcaaacatatcatgttgcctccatcaagaagggtcttcaaagatatttatgttgttttcgaacttatggagtcagatcttcaccaagttattaaggctaatgatgacttgacgaaggaacattatcaattctttctctaccaattgctccgtgctctgaaatacattcacacagctaatgtttatcatcgggacttgaagccaaagaatatcttagcaaattctaactgcaaactgaaaatttgtgattttggactggccagagttgcgtttaatgataccccaacaacaatcttctggacggattatgttgcaacaagatggtacagagcaccagagctctgtggatccttcttttcaaagtatacgccagccattgacatttggagcattggttgcatctttgctgaggtgttaacaggaaaacctttgtttcctggtaaaaatgttgtccatcagttagatctgatgactgatcttctaggcacgccatccatggatactatttctcgggtccggaatgagaaagcaagaaggtatctaagcagcatgaggaagaaagagccaatcccattctcgcagaagtttcccagtgcggatcctttagcattggatcttttgcaaaggcttttagcattcgatccaaaagaccgtccaactgcagaacaggcactagctcatccatactttaaaggtctagccaaggttgagcgagagccatcctgtcagccaatcacaaagatggagtttgagtttgagcgtagaagagtgacgaaagaggacataagggagctgatattccgtgagatattggaatatcatccgcaattactcaaagactacatcaatggcacagagaggacaacctttctgtatccaagtgctgttgatcaatttaggaagcaatttgctcatcttgaagaaaatagcggaaacggccctgtgattccaatggaaagaaaacatacttctcttcctaggtctactattgttcactctgctccaattcctgtcaaagaacaacctcgtgtcggtccatctagggaaaagtcttcatctgatgagtcttacaaaaattcaagggagacggaaaaatattattctggcaatgttttgagaacctcacaggctccacaaagagtgccaacagcgagaccaggaagggttgttggcccagtaatgccttacgaaaacggaaacaccaaggatcactatgatgcacgaaggctggcaatgaactcaggatatcctccccaacaacaaatcccacaaacatatggttattatcagccacctggcaagctggcttgctccgagccgttgcaggctgaaaggtacacgctgcatcagcaggcctatgcctgcgcagacagcacaactgtgtctgatgttgctctggacatgagagcacccccttttcaccatctatcggcaggcccgaaaagcgactcttctgataggctaacagcagatacaagcttatacacgagatcactcaatggcatcgctgctaccactgctggagtggctgctagtgctcatagaaaggtgggcgtagttccgttcggcatgtcaaggatgtattagtggccgaatcatggtgaatcctacatcacttgatggaactctgctggccaatggtggcagatcattgggaaagaagcggcaatcgagccctggctggatgcagggtgccatatgctgctaagtttagagtacagagcaatccaaggttgactgacctgtctggtcggaaaacaccatcggtggtattgaagcttatcagcatttctgtttaggccatcaacttgtatcagcctgtgctttgagtagtgtgccctttggttgcacactgaagggggtagtgcagcggcttgtactctgggcatttttaggcgccaatttcttttctagagcgaggagaaagaagggaaaggaaggaacactaacgcttttaaatgttgtatagagatgttttctcgtatatcatatcatatatcaatgtccaacatccgaatgact

SEQ ID NO: 1490 - DNA, 2317 bp, Brachypodium distachyon
atccggtgaccggcgagatgcagcaggatcagcgcaagaagagttcggcggaggcagagtttttcacggagtatggcgacgcaagtcggtacaagattcaggaaatcgttggcaagggcagctacggtgtggtgtgctcagcaatagatgtccacactggtgagaaagtggcaataaaaaagatacatgatatctttgagcacatatctgatgctgcacggattctccgtgagattaagcttctgaggctcctaaggcatcctgacattgttgaaataaagcatatcatgttacctccatcaagaagagacttcaaggatatttatgttgtctttgagcttatggagtctgatctccaccaagttattaaggctaatgatgacttaacgaaggaacattaccagttctttctttaccaattactccgggctctgaagtacattcacactgctaatgtttatcaccgggacttgaagccgaagaatatattggcgaattccaactgcaaactgaaaatttgtgactttgggttggcacgagttgcattcaacgataccccaacaacaatcttttggacggattatgttgcaacaagatggtatagagctccagagctctgtggatccttcttttcaaagtatacaccagcaattgacgtctggagtatcggatgcatttttgcggaggttttgacaggaaagcctttgtttcctggtaaaaatgttgtacatcagttagatttgatgaccgatcttctgggcacaccatccatggatacaatatctcgggtccggaatgagaaagcaaggaggtacctgagcagcatgagaaagaaagagccaatcccattttcgcagaagttccctaatgcggatcctttggccttggaccttttgcaaaggcttttagcattcgacccaaaggatcgcccaaccgctggagaggcattgtctcatccatacttcaaagggcttgccaaggttgagagagaaccatcctgccaaccaatcacaaaaatggagtttgagtttgagcgtagaagagcgacaaaggaagatataagggaacttatatttcgcgagatcctggaataccatcctcaattgctcaaagattacatcaatggcactgagaggacaacctttctatacccaagtgccgtcgatcaatttaggaagcagtttgctcatctcgaagaaaatagtgaaagcggccctgtagttccaatggatagaaagcacacctctcttcctcggtctactattgttcactcagctccaattcatgccaaggaacaaccccgtattggcccatcaagggatagacctttgactgatgagtcatataaaaaccctcgagactcggaaaaatattctggcaatgtcccgaggagctcacaccattcacaggctccacaaagagtgccaacagcaagaccaggaagggtagttggtccggtactgccttatgaaaatgttggcaccagtcatccgtatgacccacgaagagtggcaatgaactcaggatatcctccccaacagcaaatcccacaaacatacggttattatcagacaaccggaaagtcagcttgctctgagccatcccaggctgaaaggtatacgctgcaccagcaggcctatgcttgcgcaaacagttcaactgcgcctgatgttgccctggacatgagagcaccccctttccatcaatcagcagggccaaaaagtggttcttctgataggttaacagcagaaacgaacctatacacaagatcccttaatggcattgttgcaactacatccggagtggcagcaagtgctcacagaaaggtcagcgttgttccctacggcatgtcacagatgtactagtggccaatcacaaattttacaacacatctggcatgtcacagatgtactagagaaacaggagcgctgctgctggctggtgagaaacattgagaaacgaaggggcggatcaagctatggtggatgccgccgaagttgacagccctcaggcagcctgaggttcatgatatttgcagtggctcatctttcctgtttgatccagaaacacggcaaaacacatcagccccttcgtgctctttgggccaccagtttgtatctgcctgtgtgccctttagcactggaagggggtagtccagtggcttgtaatctgagctatttaggcgccaattacttttctacagtgagaaggcagaagggaaggaaggaacactaaccctttttcttgttgtatagagatgtttgtcatcaatgtgcaacctcagaaagatataaacctcagaaacatgtgattaaac

SEQ ID NO: 1491 - DNA, 2461 bp, Triticum aestivum
cgtcgcctcgtctcgtctcgtctcacgatccgtccgccggcgccctgcggcgtgtgcgcttttcgtcctcgccggcccggcccggcgccggcaaatgccgtgtgtctgaccgtgtccattcggaggcgggcttggtgttgtcgttgccgcccttaccttacggtacgggggagctgaggagattctgggcgagatccggtgagcggcgagatgcagcaggatcagcgcaagaagagttccgcagaggcagagttttttacggagtacggcgacgcaagtcgatacaagattcaggaaatcgttggaaagggcagctacggtgtcgtgtgctccgcaatagatgtccacaccggagagaaagtggcgataaaaaagatacatgatatctttgagcacatatctgatgctgcacggattctccgtgagatcaagcttctgaggctcttaagacatcctgacattgttgagatcaagcatattatgttacctccatcgagacgagacttcaaagatatttatgtcgtttttgagctcatggagtctgatctccaccaggttataaaggctaatgatgacttgacaaaggagcattaccaattctttctttaccaattactccgggctctgaagtacattcacactgctaatgtttatcaccgggacctaaagccaaagaatatattggcaaattccaactgcaaactgaagatttgtgattttggattggcacgagttgcattcaacgatacccctacaacaatcttttggacggattatgttgcgacaagatggtatagagctccagagctctgtggttccttcttttcaaagtatacacccgccattgatgtctggagcatcggatgcatctttgctgaggtcttgacaggaaaacctttgtttcctggtaaaaatgttgtacatcagttagatctgatgactgatcttctgggcacaccatctatggatacaatctctcgggtccggaatgagaaagcaaggaggtatctgagcagcatgagaaagaaagagctgatttcattttcgcataaatttcccaatgcagatcctttggccttagacctgttgcaaaggcttttagcgtttgatccaaaggaccgcccaactgctgaagaggcattgtctcatccgtactttaaagggcttgccaaggttgagagagaaccatcctgccaaccaatcacaaaaatggagtttgagtttgagcgtagaagagtgacaaaagaagacataagggagcttatatttcgtgagatattggaataccatccacaattgctcaaagactacaccaatggcactgaaaggacaacctttctatacccaagtgctgttgatcaatttaggaagcagtttgctcatcttgaagaaaatagtgagaacggccctgtagttccaatggatagaaagcacacctctcttcctaggtctactattgttcactcagctccaattcatggcaaggaacaaccccgtattggcccatcaagggataagccttcgcctgacgagtcttataaaaatcatcgagattcagaaaaatattctggcaatgtccagagaacctcacaggctccacaaagagtgccaacagcaagaccaggaagggttgttggtccagttctgccttacgaaaatggtggcatgaaggatacatatgacccacgaagagtggcagcaatgagctccggttatcctccccaacaacaaatcccgcaaatatacggttattatcagacaccggcaaagtcagcttgctccgagccatcgcaggccgaaatgtatacgctgcaccagcaggcctatgcttgcgcaaacagttcaactgtgcctgatgttgctctggacatgagagcacctcccttccatcagtcagcagggccgaaaaggggttcttctgataggctatcagcggaatcaaacctatactcgagatcccttaatggcatggctccaactacaacaggagtggcggcaagtgctcacaggaaggtcggcgttgttccctacggtatgtcgcagatgtattagtggccagtcaggcgcatccgacatgccatcctggagtgcggctggtggctaacgaaacagcgaggaacgaagtggcggattaagcttgggtggggatgccgcaaggtttacagcgcagggcagcccatggtttgatgcttatgtgtgctgtctgatctggaagcgtgtgaagctcttcgttctgttccgggccatcagcttgttgtatctgcctgtgtgcacactggatgggggtgggtagtcagtccagtggcttgtaatctgagctatttaggcgccggttactttttctagggcgaggagacagaaggggaaggaaggaatgctaacccgttttctgttgtagagatgtttgtcatcaatgtgcaacttcagaaagatatatataaacttataaagcacacttttg

SEQ ID NO: 1492 - DNA, 2679 bp, Triticum aestivum
  misc_feature (55)..(55): n is a, c, g, or t
  misc_feature (60)..(60): n is a, c, g, or t
ccacgcgtccgacactgccggcctcctctcctctccacccgtcgtcctctctctntctcnctttcttattcccctcgcggagcgcgagcgcagaccagcagaggaggaggaggaacaggggggagagagagagagagagagggagccctagccctggcccggcgccccgtcgctagggttagggtctcccccccagtttcccgccctcccttcgtcgcctcgtctcgtctcgtctcacgatccgtccgccggcgccctgcggcgtgtgcgcttttcgtcctcgccggcccggcccggcgccggcaaatgccgtgtgtctgaccgtgtccattcggaggcgggcttggtgttgtcgttgccgcccttaccttacggtacgggggagctgaggagattctgggcgagatccggtgagcggcgagatgcagcaggatcagcgcaagaatagttccgcagaggcagagttttttacggagtacggcgacgcaagtcgatacaagattcaggaaatcgttggaaagggcagctacggtgtcgtgtgctccgcaatagatgtccacaccggagagaaagtggcgataaaaaagatacatgatatctttgagcacatatctgatgctgcacggattctccgtgagatcaagcttctgaggctcttaagacatcctgacattgttgagatcaagcatattatgttacctccatcgagacgagacttcaaagatatttatgtcgtttttgagctcatggagtctgatctccaccaggttataaaggctaatgatgacttgacaaaggagcattaccaattctttctttaccaattactccgggctctgaagtacattcacactgctaatgtttatcaccgggacctaaagccaaagaatatattggcaaattccaactgcaaactgaagatttgtgattttggattggcacgagttgcattcaacgatacccctacaacaatcttttggacggattatgttgcgacaagatggtatagagctccagagctctgtggttccttcttttcaaagtatacacccgccattgatgtctggagcatcggatgcatctttgctgaggtcttgacaggaaaacctttgtttcctggtaaaaatgttgtacatcagttagatctgatgactgatcttctgggcacaccatctatggatacaatctctcgggtccggaatgagaaagcaaggaggtatctgagcagcatgagaaagaaagagctgatttcattttcgcataaatttcccaatgcagatcctttggccttagacctgttgcaaaggcttttagcgtttgatccaaaggaccgcccaactgctgaagaggcattgtctcatccgtactttaaagggcttgccaaggttgagagagaaccatcctgccaaccaatcacaaaaatggagtttgagtttgagcgtagaagagtgacaaaagaagacataagggagcttatatttcgtgagatattggaataccatccacaattgctcaaagactacaccaatggcactgaaaggacaacctttctatacccaagtgctgttgatcaatttaggaagcagtttgctcatcttgaagaaaatagtgagaacggccctgtagttccaatggatagaaagcacacctctcttcctaggtctactattgttcactcagctccaattcatggcaaggaacaaccccgtattggcccatcaagggataagccttcgcctgacgagtcttataaaaatcatcgagattcagaaaaatattctggcaatgtccagagaacctcacaggctccacaaagagtgccaacagcaagaccaggaagggttgttggtccagttctgccttacgaaaatggtggcatgaaggatacatatgacccacgaagagtggcagcaatgaactccggttatcctccccaacaacaaatcccgcaaatatacggttattatcagacaccggcaaagtcagcttgctccgagccatcgcaggccgaaatgtatacgctgcaccagcaggcctatgcttgcgcaaacagttcaactgtgcctgatgttgctctggacatgagagcacctcccttccatcagtcagcagggccgaaaaggggttcttctgataggctatcagcggaatcaaacctatactcgagatcccttaatggcatagctccaactacaacaggagtggcggcaagtgctcacaggaaggtcggcgttgttccctacggtatgtcgcagatgtattagtggccagtcaggcgcatccgacatgccttcctggagtgcggctggtggcttaacgaaacagcgagaaacgaagtggcggatcaagcttgggtggggatgccacaaggtttacagcgcagggcagcccggggtttgatgtatgtttgctgtctgatctggaagcgtgtgaagctcttcgttctgtttcgggccatcagcttgttgtatctgcctgtgtgcacactggatgggggtgggtagtcagtccagtggcttgtaatctgagctatttaggcgccggttactttttctagggcgaggagacagaagggaaaggaaggaatgctaacccgtttcctgttgtatagagatgtttgtcatcaatgtgcaacttcagaaagatatatataaacttataaagcacacttctgctgca

SEQ ID NO: 1493 - DNA, 2661 bp, Hordeum vulgare
ccctctatctctcttattcccctcccggagcccgagcgcagaccaggagaggaggaggaggaacaggagagagagggagagagcgcgcgcgggagccctagccctgcccccagcgccccgtcgctagggttagggtctcccccccagtttcccgccctcccttcgtcgcctcgtctcgtctcacgatccgcccgccggcgtcctgccgcgtctgcgcttttcggcctcgcctgcccggcgccagcaaatgccgtgtgtctgaccgtagtgactcggaggcggccctattgctgttgttcccgcccgtacggcacggcggagctgaggaggttcggggcgagatccggtgagcgccgagatgcagcaggaccagcgcaagaagagttccgcagaggcagagttttttaccgaatatggcgacgcaagtcgatacaagattcaggaaatcgttggaaagggcagctatggtgtcgtgtgctccgcaatagatgtccacaccggagagaaagtggcgattaaaaagatacatgatatctttgagcacatatctgatgctgcacggattctccgtgagatcaagcttctgaggctcttaagacatcctgacatcgttgagataaagcatatcatgttacctccatcgaggagagacttcaaagatatttatgtcgtgtttgagctcatggagtctgatctccaccaggttataaaggctaatgatgacttgacaaaggagcattaccagttctttctttaccaattactccgggctctgaagtacattcacactgctaatgtttatcaccgggacctaaagccaaagaatatattggcaaattccaactgcaaactgaagatttgtgattttggattggcacgagttgcattcaacgatacccccacaacaatcttttggacggattatgttgcgacaagatggtatagagctccagagctctgtggttccttcttttcaaagtatacacccgccattgatgtctggagcatcggatgcatatttgctgaggttttgacaggaaagcctttgtttcctggtaaaaatgttgtacatcagttagatttgatgactgatcttctgggcacaccatctatggatacaatctctcgggtccggaatgagaaagcaaggaggtatctgaccagcatgagaaagaaagagccgatctcattttcacataaatttcccaatgcagatcctttggccttagacctgttgcaaaggcttttagcgttcgatccaaaggaccgcccaactgctgaagaggcattgtctcatccatactttaaagggcttgccaaggttgagagagaaccatcctgccaaccaatcacaaaaatggagtttgagtttgagcgtagaagagtgacaaaagaagacataagggagcttatatttcgtgaaatattggaataccatccacaattgctcaaagactacaccaatggcactgaaaggacaacctttctatacccaagtgctgttgatcaatttagaaagcagtttgctcatcttgaagaaaatactgagaatggccctgtagttccaatggatagaaagcacacctctcttcctaggtctacaattgttcattcagctccaattcatgccaaggaacaaccccgtattggcccatcaagggataagccttcgcctgacgagtcttataaaaatcctcgagattcagaaaaatattctggcaatgtccagagaacctcactggctccacaaagagtgccaacagcaagaccaggaagggttgttggtccagttctgccttacgaaaatggtggcatgaaggatacatatgacccacgaagagtggcggcagcaatgaactcaggttatgctccccaacaacaaatcccgcaaatatacggttattatcagacaccaaagtcagcttgctccgagccatcgcaggccgaaatgtatacgctgcaccagcaggcctatgcttgcgcaaacagctcaactgtgcctgatgttgctctggacatgagagcaccacccttccatcaatcagcagtgccaaaaaggggttcttccgataggctatcagcagaatcaaacctatactcgagatcccttaacggcatggctccaaccacatcaggggtggcggcaagtggtcacaggaaggtcggtgttgttccctacggcgtgtcgcagatgtactagtggccaatcaggcgcatccgacatgccttcctggagcgcggctggtggcgaacgaaacagcgaggaatgaagtggcggatcaagcttgggtggggactccgcaaggtttacagcgcagggcagcccagggttgatgctcatctttgctgactgacctataagcgtgtgagccatttcattctgttttaggccatcagcttgttgtatctgcctgtgtgcacactggacgggggtgggcagtcagtccagtggcttgtaatctgagctgtttaggcgccggttacttttataggggaggagacagaagggaaaggatggaatgctaacccgttttctgttgtatagagatgtttgtcatcaatgtgcaacttcacaaagatatactataaacttataaagcacactcatatgctccaggtgatagttgcagctgcgtcctgtaacgggtcaaatcagtggcc

SEQ ID NO: 1494 - DNA, 1960 bp, Festuca arundinacea
  misc_feature (386)..(386): n is a, c, g, or t
  misc_feature (413)..(413): n is a, c, g, or t
  misc_feature (542)..(542): n is a, c, g, or t
  misc_feature (578)..(578): n is a, c, g, or t
  misc_feature (581)..(581): n is a, c, g, or t
  misc_feature (617)..(617): n is a, c, g, or t
  misc_feature (641)..(641): n is a, c, g, or t
  misc_feature (875)..(875): n is a, c, g, or t
  misc_feature (878)..(878): n is a, c, g, or t
ggcacgaggagtcttccgccctcccttcgtcgtcgtctcacacgatccgaccgccggcgccctgcggcgtgcgcgctttcggcctcggcggcgcggcgcgagcaaatgccgtctgtctgaccgttgatttggagggtgctgttgttgttctcgcctccgcctgcggaggggagtggccgacggcccggccttgttgaagagattcggtgcgagatccggcgaagatgcagcaggatcagcgcaagaagagttccgcggaggctgagtttttcacggagtatggcgacgcaagtcgatacaagattcaggaaatcgttggcaagggcagctacggtgtcgtgtgctctgcaatagatgtccacaccggagagaaagtggcgataaanaagatacatgatatctttgagcacatntctgatgctgcgcggattctccgtgagatcaagcttctgaggctcttaagacatcctgacattgttgagataaagcatatcatgttacctccatcgagaagagacttcaaagatatatatgttgttttngagctcatggagtctgatctccaccaagttataaangcnaacgatgacttgaccaaggagcattaccagttcttnctttaccagttactccgggctctnaagtacattcacactgctaacgtttatcaccgggacctaaagccaaagaacatattggcaaattctaactgcaaactgaaaatttgtgattttggattggcacgagttgcattcaacgataccccgacaacaatcttttggacggactatgttgcaacaagatggtatagagctccagagctctgcgggtctttcttttcaaagtatacaccagctattgatgtctggagcatnggntgcatctttgctgaggttttgacagggaaacctttgtttcctggtaaaaatgttgtacatcagttagatttgatgacagatcttctgggcacaccatccatggatacaatttctcgggtccggaatgagaaagcaaggaggtatctgagcagcatgagaaagaaagagccaattccattttcgcataagttccctaatgcagatcctttggccttagaccttttgcaaaggcttttagcattcgatccgaaggaccgcccaaccgctgaagagtcactgtctcatccctacttcaaagggcttgccaagattgagagagaaccatcctgccaaccaatcacaaaaaaggagttcgagtttgagcgtagaagagtaacaaaagatgatataagggagcttatctttcgtgagatactggaataccatccacaattgctcaaagactacaccaatggcactgagaggacaacctttctatacccaagtgccgttgatcaattcaggaagcaatttgctcatctcgaagaaaatactgaaaatggccctgtagttccaatggatagaaagcacacctctcttcctaggtctactatagttcactcagctccaattcatggcaaggaacaaccccatattggcccatcacgggataaacctttgtctgaggagtcttatagaaattctcgagattcagaaatatattctggcaatgtccagaggacctcacaggctccacaaagagtgccaacagcaagacctggaagggttgttggtccagttcagccttatgaaaatggtggcatcaatgatccatatgacccacgaagagtggtaatgaactcaggctatcctccccaacaacaaatcccacaaacatacggttattatcaaacgccagcaaagtcagtttgctccgagccgttgcaggctgaaaggtatacgctgcaccagcaggcctatgcttgcgcaaacagttcaacagtgcccgatgttgctctggacatgagagcaccccctttccatcaatcatcagggccgaaaaggggttcttccgataggttgtcagcagagacaaacctata

SEQ ID NO: 1495 - DNA, 1113 bp, Zea mays
tctgctgtgccatctgttgtaccacgactaaaccacagctccaccgtcaggtcttcttcccctttcgtgtcctctcctgcgcgcgcaccgacaagtgaacgagcgagcgagcgagcatcatggacatggaggcggccgcgatctccgggaccgccagcgcgtcgtcgtccacgtcgcggcgcggcaggagcatctcccgcctgccagcgcgcgtcgccggcgcggtgatccgcggcctggtcaccttcgtcttcgcggcagtgggcatggtcctcggggccgtcacgggcgcgctgatcgggctcgccacggagagcggcctggtgcgcggcgccggcatcgggtccatctccggcgccgtcgtgtccatggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacaccgcggactcgcaggacatggcgccgacactggcggacatgttcgagacgggcgccgccgacgccaagggcatgccggccgccgccgtcgcggcgctccccatcatggccttcaccgagcacaccgtcgccgacgcctccggggagcccatcggctgctccgtctgccttcaggacttcgaggcaggcgagacggcgcggagcttgccggagtgcgggcacacgttccacctgccgtgcatcgacgtctggctgctccggcacgcctcgtgcccactgtgtcgtcgcgcggtctaagccggtgcgcacacttttcgttaggatgtctttgggcaaccgtgagccgatgcgcgtgcacacgtgtcccagaccaggagcagagtattgtagggtagtaggagtgcaggacacctggttctttcttgcataccttgattatttttttcttcttttttctacgtcttgggcacgcatgtacagatacagtacgtggctcacattgtctcacacactatgtggatgtaaatatgtatagggtaaatgttgtaaacaatgtaatatacttgtacattgagatttcttt

SEQ ID NO: 1496 - DNA, 847 bp, Zea mays
gcgtcgtcgtccacgtcgcggcgcggcaggagcatctcccgcctgccagcgcgcgtcgccggcgcggtgatccgcggcctggtcaccttcgtcttcgcggcagtgggcatggtcctcggggccgtcacgggcgcgctgatcgggctcgccacggagagcggcctggtgcgcggcgccggcatcgggtccatctccggcgccgtcgtgtccatggaagttgtcgattcctccgtcgccatctggcgctccgacgagtccgggatctggagcgtcctatacgtgctcgatgtcctctggagcctgctgaccggccgcctggtgcgagagaaggtggacccggccgtgcaaagcgccgtcgacagtcagatgaacaccgcggactcgcaggacatggcgccgacactggcggacatgttcgagacgggcgccgccgacgccaagggcatgccggccgccgccgtcgcggcgctccccatcatggccttcaccgagcacaccgtcgccgacgcctccggggagcccatcggctgctccgtctgccttcaggacttcgaggcaggcgagacggcgcggagcttgccggagtgcgggcacacgttccacctgccgtgcatcgacgtctggctgctccggcacgcctcgtgcccactgtgtcgtcgcgcggtctaagccggtgcgcacacttttcgttaggatgtctttgggcaaccgtgagccgatgcgcgtgcacacgtgtcccagaccaggagcagagtattgtagggtagtaagagtgcaggacacctggttctttcttgcataccttgattaattttttcttcttttttctacgtcttgggcacgcatg

SEQ ID NO: 1497 - DNA, 1098 bp, Zea mays
accacccgggggccggtaccgggtaccgccgtcgccgtcagccgcgtgccgaacggatggctagcgaagcgagcgagcgcgcagtcaccatggacatggaggcggccgcggtctccggcaccggcaccgccagcgcgtcgtcctctcccgcgccgtcgtccgggtcgcgcggcggcaggagcgtctgccgcctgccggcgcgcgtcgccggcgcggtggtccggggcctgctcaccttcgtcttcgcggcagtgggcatggttctcggggccgtcacgggcgcgctgatcgggctcgccacggagagcggcctggtgcgcggcgccggcgtcggggccatctccggcgccgtcgtgtccatggaggtcgtcgactcctccgtcgccatctggcgctccgacgagtcagggatctggagcgtcctatacgtgcttgacgtgctatggagcctggtgaccggccgcctggtgcgcgagaaggtggaccccgccgtgcagagcgccgtcgacagccagatgaacgccgcggactcgcaggacacggcgccgacactggcggacatgttcgagacggccgccgcgggcatgccagccgccgccatcgcggcgctccccgtcacggccgtcaccgagagtaccgtcaccgacgcctccggggagcccatcggctgccccatctgccttcaggacttcgaggccggcgagacggcgcggaggttgccggagtgtgggcacacgttccacctgccttgcatcgacgtctggctgctccggcacgcgtcgtgcccgctgtgccgccgcgcggtctaggccgccgccgccgccgccgcgcgcgtttcgtttggagggtgtctttcagcgacacacacgtttccccgaccataccatgagcagagcattctaggatagtaggagtgcagggcacctggttctttcttgcataccttaatcttttttctattcgtcttgggcagtacgcatttacagatacagtacatggctcccattgtcacacacacacacgcgcggcgtggacgtaaaaatgtatagaggtgaatattgtaaataatgtaatatagttgtagcattgagattttat

SEQ ID NO: 1498 - DNA, 1200 bp, Sorghum bicolor
cgaaaaagccctcgtctgactacgctgtgttcatctgctctgctacgactaagccagagctcccaccgtcaggtcttcttcttcttcccccccttcgcgtcctctcctctgcctgcgcgcgcaccgtcaagcgagcgagaaatcgtcatggacatggaggcggccgcgatcttcggcaccgccagcgcgtcgttctctccagcgccgtcgtcgtccaggtcgcgcggcggcggcggcggcacgagcatctcccggctgccggcgcgcgtcgccggcgccgtggtccggagcctggtcaccttcgtcttcgcggcagtgggcatggttctcggggccgtcacgggcgcgctgatcgggctcgccacggagagcggcctggtgcgtggcgctggcatcggggccatctccggcgccgtcgtgtccatggaggtcgtcgactcctccgtcgccatctggcgctccgacgagtccgggatctggagcgtcctgtacgtgcttgatgttctctggagtctgctgaccggccgcctggtacgcgagaaggtggaccccgccgtgcagagcgccgtcgacagtcagatgaacgcggcggactcgggggacatggacatggcggcgacactggcggacatgttcgatacgggcgccggcgccggcgccggcgctcctcccaagggcatgccggccgccgccatcgcggcgctccccgtcacggccttcaccgaggacaccgtcaccgacgcctccggggagcccatcggctgctccgtctgccttcaggacttcgaggccggcgagacggcgcggagcctgccggagtgcgggcacacgttccacccgccgtgcatcgacgtctggctgctccggcacgcgtcgtgcccgctgtgtcgccgcgcggtctagtctaggccgctagctgcgcgcgtttctcgacgaccatatgcgcgtgcacatcatcacacgtgtcacggaccaggagcagagtatagtaggctagtagcaggacaaattggttgttctctcttgcataccttgatttttctgtttgttttttgttcgtgttgggcacgcatgtacagatacagtacgtggctcacactgtcacacacacacgatgtgtaaatatgtatagaggtgaatgttgtaaataatgtaatagactaatagttgtagaattgagattttttatatatactgtac

SEQ ID NO: 1499 - DNA, 647 bp, Saccharum officinarum
cgagctacgagctagatcgaattctccagcaccagcgagcagtccgccatggctatggtcgcgtccacctccttcgcgtaccacaagccgcgtttcgcggtggtatgcaggaagaacaaggatggccgggacagggagcgggagcgggacggcaaggagcacaagcaccccttcaaggtcgtcgagatcaccccgccgccgcggtgcctcggcgtccgctgcttccccaccaacatccactgcggcgagagcgtgacgatcgaggggcaggcgtacacggtgtcggcggtgacgcatcggtaccagctgcgcaaggggcggtacgagccgagcgagaagcgcctcgacgtcctctccactggcagatacatcctcaacctctacctccaaaacctgctcgaccagtcgtagctaggcagctagtacctagctactgtctgtatctgtagtctgtacatcagcatcgcttgcactatatatctatctagctgtaataacaatcgatcggctctgctgctgcttctatgtccatcgaacacttgtcccagtgggtggtggacgatcatgcgtcagggatagtgtttccctgcgtgctgttctgtgtaactgaaaaaggcgagatgaggcataaagttcagcaacaggtt

SEQ ID NO: 1500 - DNA, 825 bp, Saccharum officinarum
cgagctacgagctagatcgaattctccagcaccagcgagcagtccgccatggctatggtcgcgtccacctccttcgcgtaccacaagccgcgtttcgcggtggtatgcaggaagaacaaggatggccgggacagggagcgggagcgggacggcaaggagcacaagcaccccttcaaggtcgtcgagatcaccccgccgccgcggtgcctcggcgtccgctgcttccccaccaacatccactgcggcgagagcgtgacgatcgaggggcaggcgtacacggtgtcggcggtgacgcatcggtaccagctgcgcaaggggcggtacgagccgagcgagaagcgcctcgacgtcctctccactggcagatacatcctcaacctctacctccaaaacctgctcgaccagtcgtagctaggcagctagtacctagctactgtctgtatctgtagtctgtacatcagcatcgcttgcactatatatctatctagctgtaataacaatcgatcggctctgctgctgcttctatgtccatcgaacacttgtcccagtgggtggtggacgatcatgcgtcagggatagtgtttccctgcgtgctgttctgtgtaactgaattggggattgtgtgtttttattattttgaggctagtcttggtatcttattatcaatttaaaaagggggtcctctttattgtattaagttttctctacgtgtatgtaattttattttttttttagtgatctttttactttctggcttgttttaacttttacgtgagtaactgtttgtttaattattaggttggataaaccttttgtcatgtgggc

SEQ ID NO: 1501 - DNA, 841 bp, Setaria italica
gccaggcccaatcaacctctgccatccacgcccaccagcacaggatcaaaatatctgcccaccgcgttctagccatacacgatacggccatttcacggttcatcgtcctcgcaggaacagcagcaactagatcgaattcttcggcaccgggaagcaaagcgagcgagcgagcggtccgccatggccatggtcgcctccacatccttcgcctacaagccgcgcttcgcggtggtgtgcaggaagaacaaggacgggcgggacagggagcgggagaaggagaaggagcacaagcacccgttcaaggtcgtcgagatcacgccgccgccgcgctgcctcggcgtccgctgcttccccaccaacatccactgcggcgagagcgtgacgatcgagggtcaggcgtacacggtgtcggcggtgacgcaccggtaccagctgcgcaaggggcggtacgagcccagcgagaagcgcctcgacgtcctctccaccggcagatacatcctcaacctctacctccaaaacctcctcgaccaatcctagctagctagctgttcgcatctcctcatactcgtagctagcacaggaattacaatgctgtaaataacgaacacttgcccatatatggtgaactgcgaacacttgtcccagtggatggacgacggaggatcatggatgcagcagctccatgcgtgctgctctgtacaactgaagaaaaaagaggggcgagatgaggcgtaaagttcagtaaaggttgcgtatctttttcagaaaagaaaggtttcagcaaagctgctgacgacgacgaacaacgcccttctgtccgggcgcatcttggcaggatgcc

SEQ ID NO: 1502 - DNA, 762 bp, Sorghum bicolor
agccacacgacgatttccacggttcatcggcctctcatcagaaaaaacgagatcgaattctccagcaccagcaccaggaatcaaagctagcgagcgggcagcagtccgccatggccatggtcgcgtccacctcgttcacgtaccacaagccgcgtctcgcggtggtgtgcaggaagaacaaggacggccgggacagggagcgggagcgggacggcaaggagcacaagcaccccttcaaggtcgtcgagatcacgccgccgccgcggtgcctcggcgtccgttgcttccccaccaacatccactgcggcgagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctacctccaaaacctgctcgaccagtcctagctaggcagctagtagtagtgcctagctactgcctgtctgtctgtatctgtgtacatcagcatcgcttcatcactctataattctaccacgctactgtatatatagctatctagctgtaaataacaatcaattggttcggctcctcctgctatgtccatcgaacacttgtcccagtgggtggtggacgatcatggccgatcatgcgtgaaggggatagtgtttccctgcgtgcggctctgtgtaactgaaaaggcgagattgaggcataaagttcagtataaaagtctgc

SEQ ID NO: 1503 - DNA, 605 bp, Pennisetum glaucum
cccagccgagcccaaatcagcaggtgccagacaccagcggcagaacaaaaatatctctgcctacgaagccccgccgccttctagccatacaacccgaacagatcgatcgtcctcgcaggaacagctcgatcgaatccttcagcgcgcggcggcacttgcagcgggaggcgagcgagttctccagcacccgccatggccatggtggcctctacctccttcacgtaccacaagccgcgtttcgcggtggtgtgcaggaagaacagggacggcggccgggacagggagcgggagcgggagaaggagaaggagcacaagcacccgttcaaggtcgtcgagatcacgccgccgccgcgctgcctcggcgtccgctgcttccccaccaacatccactgcggcgagagcgtgacgatcgaaggtcaggcgtacacggtgtcggcggtgacgcaccggtaccagctgcgcaaggggcggtatgaacccagcgagaagcgcctcgacgtcctctccaccggcagatacatcctcaacctctacctccagaacctcctcgaccagtcctagctcgcagcacagggattgtataatgctgtaaataatgagcacca

SEQ ID NO: 1504 - DNA, 723 bp, Panicum virgatum
gacgggatcaaaatatctgcctaccgatcgccaccgcgttccagccatacacgatacggcggccatcttcccggcaggcagtaacaggcagctagtggatcggattcttcggcaccagctgggagctctctcgcggtccgccatggccatggtcgcctccacctctttcacgtaccacaagccgcgtctcgcggtggtgtgcaggaagaacaaggacgggcgggacaaggagaaggagcacaagcaccccttcaaggtcgtcgagatcacgccgccgccgcgctgcctcggcgtccgctgcttccccaccaacatccactgcggcgagagcgtgacgatcgagggccaggcgtacacggtgtctgcggtgacgcaccggtaccagctgcgcaaggggcggtacgagccgagcgagaagcgcctcgacgtcctctccaccggcagatacatcctcaacctctacctccaaaacctcctcgaccagtcctagccctacctgctgctacctctccatccacaactacccacacacacacactctacctgtaaataatgctgcccgattgatcgagtgagtccccaattctctgtcgatcatagtggatggacaatcatcctagacgatcacttgtcatggacaccagtagcttccccctgctttgtgctctgtataactgaggaaaagaagaagaaggcgaatcgaggcagaaagtattcagcaaa

SEQ ID NO: 1505 - DNA, 642 bp, Avena sativa
acgttctgcgtgctcacccagcctcttctccgcgccgcctccctcgcagaaactgtggttgatttcattcagcagcggcaccaagcaaagctgccagagctagcaattcgccatggccatggtcgcttccacctccatcgcctaccacaagccgcgtctggcggtggtgtgcaggaagaaggatcggccggacagggagctggagcgggagaagaaggagcacaagtacccgttcaaggtcgtcgagatcacgcccccgccgcgatgcctcggcgtccgctgcttccccacgaacatccactgcggggagagcgtgacgattgaaggtcaggcgtacacggtgtcggcggtgacgcaccggtaccagctgcgcaaggggcggtacgagcccagcgagaagcgcctcgacgtcctctccaccggcagatacatcctcaacctctatctcgacaacctcctcgacaagtcgtagctctctctctctctctctcagattatttactcagcttgcaaatcagttagcaaacagaaactcgatcgccactgcaaatgctactacctctgtaagtaccgtttgtgatatgatcgaaaagattaattgtaatagcggtgggaactgcgggacttgctggtttttgtctc

SEQ ID NO: 1506 - DNA, 825 bp, Avena sativa
agcaaaagaaaatctgtggacgttctgcgtgctcacccagcctcttctccgcgccgcctccctcgcagaaactgtgtttgatttcattcagcagcagcaccaagcaaagctgccagcagagcaattcgccatggccatggtcgcttccacctccatcgcctaccacaagccgcgtctggcggtggtgtgcaggaagaaggaccggccggacagggagctggagcgggagaagaaggagcacaagtacccgttcaaggtcgtcgagatcacgcccccaccgcgatgcctcggcgtccgctgcttccccacgaacatccactgcggggagagcgtgacgattgaaggtcaggcgtacacggtgtcggcggtgacgcaccggtaccagctgcgcaaggggcggtacgagcccagcgagaagcgcctggacgtcctctccaccggaagatacatcctcaacctctacctcgacaacctcctcgacaagtcctagctctcactctaattatttactcagctagcaaaccagttagctacagcaactcgccactgcaaatgccactacctctgtaagtaccgtttgtgatatgatcgaaaagcttaattgtaatagcggtgggaactgcgggacttgctagtcgttgtctcatggaccgtggacttgacttgatgctgctttgagtataccaaggcagagttctaggctatacatactacaaaggaatcggccgggtaaaagaactatatacatagcctcgtgcattattggaaaagtatattcccttcgcgtcgctctcgagaggcaatacaactcaataggatctttag

SEQ ID NO: 1507 - DNA, 811 bp, Triticum aestivum
tgacagcgacttgatcggaccgatgggcacgcgtggcacaccttctttccacacctcccggctgaagctgctgcagaatcctcaaaccaatcaaccaccatccatcaccggagagcagagcaaggaaatctgtggacgatctgcccgtccaccaaatcccttcagcgcgccgcctccctcgcccgcaactcgcgaggactctgcggatctcactcagcggcagcagcaaaaagagcggagagagcagcccgccatggccatggtcgcctccacctccatcgcctaccacaagccgcgtttgtcggtggtgtgcaggaagaaggaccgggacagggagctggagcgggagaaggagcacaagcaccccttcaaggtcgtcgagatcacgccgccgccgcgatgcctcggcgtccgctgcttccccacgaacatccactgcggagagagcgtgacgatcgaagggcaggcgtacacggtgtcggcggtgacgcaccggtaccagctgcgcaaggggcggtacgagccgagcgagaagcgcctcgacgttctctccaccggcagatacatcctcaacctctacctcgacagcctcctcgacaagtcctagactctatgctctactctatactaagtacaaatttatttattctactactccagcaaatttatttatgcatgtactgtaactgtacgtacgtacgctacttctgtgatgaggtcgaaatgatttttatacagtagcaagtacatgcgcgctgagcccttgtgtgaaggccgcgcatgcatgcacgcatttggtccaaaaaaaaaa

SEQ ID NO: 1508 - DNA, 737 bp, Triticum aestivum
  misc_feature (724)..(728): n is a, c, g, or t
  misc_feature (731)..(732): n is a, c, g, or t
aaatctgtggacgttctgcccgtccaccaaatcccttcagcgcgccgcctccctcgcccgcgaggactctgcggatctctcagcggcagcagcaagcagagcggagagagcaatccgccatggccatggtcgcctccacctccatcgcttaccacaagccgcgtttgtcggtggtgtgcaggaagaaggaccgggacagggagctggagcgggagaaggagcacaagtaccccttcaaggtcgtcgagatcacgccgccgccgcgatgcctcggcgtccgctgcttccccacgaacatccactgcggagagagcgtgacgatcgaagggcaggcgtacaccgtgtcggcggtgacgcaccggtaccagctgcgcaaggggcggtacgagccgagcgagaagcgcctcgacgtcctctccaccggcagatacatcctcaacctctacctcgacaacctcctcgacaagtcctagactctctatgctctactctatactactagtacaaatttatttattctactactccagctaatttatttatgcctctactgtacgctacttctgtgaaggccgcgcacgcatgcacgcatttggtcctatactctttgtgcccaatgatcacattatgggcaatatgaggggcaaggagaaaggccgtgtatgaggatattttttaaagtcctttgtcaacacatatctttatcaagtcatatttgaatgannnnnaanngaagt

SEQ ID NO: 1509 - DNA, 801 bp, Triticum aestivum
tgacagcgacttgatcggaccgatgggcacgcgtggcacaccttctttccacacctcccggctgaagctgctgcagaatcctcaaaccaatcaaccaccatccatcaccggagagcagagcaaggaaatctgtggacgatctgcccgtccaccaaatcccttcagcgcgccgcctccctcgcccgcaactcgcgaggactctgcggatctcactcagcggcagcagcaaaaagagcggagagagcagcccgccatggccatggtcgcctccacctccatcgcctaccacaagccgcgtttgtcggtggtgtgcaggaagaaggaccgggacagggagctggagcgggagaaggagcacaagcaccccttcaaggtcgtcgagatcacgccgccgccgcgatgcctcggcgtccgctgcttccccacgaacatccactgcggagagagcgtgacgatcgaagggcaggcgtacacggtgtcggcggtgacgcaccggtaccagctgcgcaaggggcggtacgagccgagcgagaagcgcctcgacgttctctccaccggcagatacatcctcaacctctacctcgacagcctcctcgacaagtcctagactctatgctctactctatactaagtacaaatttatttattctactactccagcaaatttatttatgcatgtactgtaactgtacgtacgtacgctacttctgtgatgaggtcgaaatgatttttatacagtagcaagtacatgcgcgctgagcccttgtgtgaaggccgcgcatgcatgcacgcatttggtcc

SEQ ID NO: 1510 - DNA, 726 bp, Hordeum vulgare
caaccaccatccatcaccggagagcagagcaagaaaattctgtggacgttctgcccgtccgccaaaccccttccgcgcgccgcctccctctcccgcaaccctgcggatctctttcagcagcagcaagcagagcagcgagaggagcccgccatggccatggtcgcctccacctccatcgcctaccacaagccgcgtttgtcggtgctgtgcaggaagaaggaccgggacagggagctggagcgggagaaggagcacaagcaccccttcaaggtcgtcgagatcacgccgccgccgcggtgcctcggcgtccgctgctttcccacgaacatccactgcggggagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctacctcgacagcctcctcgacaagtcctagataatatactaccaccaccaccaccaccaccactactactacagatttatctattccagcaaattagtactgtacgtacgctacttgtgtgatgatataaaaatgcttacacagcaaaaagtacatgcgcgatgagcccacgaacgcacgatcaaagcgatccgatacttttgccctggaccacggacgcgatgtttttctttttctttttcgatgttgctt

SEQ ID NO: 1511 - DNA, 776 bp, Hordeum vulgare
cttctttccacaccccgcggctgaagctgctgcagaatcctcaaaccaatcaaccaccatccatcaccggagagcagagcaagaaaattctgtggacgttctgcccgtccgccaaaccccttccgcgcgccgcctccctctcccgcaaccctgcggatctctttcagcagcagcaagcagagcagcgagaggagcccgccatggccatggtcgcctccacctccatcgcctaccacaagccgcgtttgtcggtgctgtgcaggaagaaggaccgggacagggagctggagcgggagaaggagcacaagcaccccttcaaggtcgtcgagatcacgccgccgccgcggtgcctcggcgtccgctgctttcccacgaacatccactgcggggagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctacctcgacagcctcctcgacaagtcctagataatatactaccaccaccaccaccaccaccactactactacagatttatctattccagcaaattagtactgtacgtacgctacttgtgtgatgatataaaaacgcttacacagcaaaaagtacatgcgcgatgagcccacgaacgcacgatcaaagcgatccgatacttttgccctggaccacggacgcgatgtttttctttttctttttcgatgttgctt

SEQ ID NO: 1512 - DNA, 748 bp, Brachypodium distachyon
agaatccccaaggccaatcaaccaccatccatcaccgcggaacaagaaaaatctgcccacgttctgcgcgtccacccagcccccttctgcttctgcctctctcgtaagaaactctcggcgcagccaagcaacccgccatggccatggtcgcttccacctccatcgcgtaccacaagccgcgtctggccgtggtgtgcaggaagaaggaccgaggggacaggggggagctggagcgggagaaggagcacaagcacccgttcaaggtcgtcgagatcacgccgccgcccagatgcctcggcgtccgctgcttccccacgaacatccactgcggcgagagcgtgacgatcgaagggcaggcgtacacggtgtcggcggtgacgcaccgctaccagctgcgcaaagggcggtacgagcccagcgagaagcgcctcgacgtcctctccaccggcagatacatcctcaatctctacctcgacagcctcctccacaagtcatagccactcctcttttagctagccagtgcgtaccaaagttagcgatgagaaaatcttatggtacacgttggttgttgcatgaatgaacaaaacacactagctgtaaataaaagggccagcgatcgctcgatcatgcgtgcgtgcgtgcatgcgctggctttatcgatctgacaccttttctcgacgatcatatcatggacgagatgctgcttttgttgaatatatatccagtacactagctagctttgcaaaca

SEQ ID NO: 1513 - DNA, 663 bp, Triticum aestivum
ctcgtgccgaattcggcacgagggagagcaaaggcggagcaacaaaaatctgtggacgttctgcccgttcacccaaccccttccgcgcgccgcctccctcgcccgcgaggactctgcggatctctctcagcggcagcagcaagcagagcggagagagcaatccgccatggccatggtcgcctccacctccatcgcctaccacaagccgcgtttgtcggtggtgtgcaggaagaaggaccgggatagggagctggagcgggagaaggagcacaagtaccccttcaaggtcgtcgagatcacgccgccgccgcgatgcctcggcgtccgctgcttccccatgaacatccactgcggggagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctatctcgacagcctcctcgacaagtcctagactctctatgctctactctatactactagtacaaatttatttattctactactacagcaaatttatttatgcctctactgtactgtacgtatgtacgctacttctgtgaaggccgcgcacgcatgcacgcatttggtccgata

SEQ ID NO: 1514 - DNA, 755 bp, Oryza sativa
gcacgcctgccaatcccgccacgttcttgcggcccagccatccatccaatcctccctcccccccccccccccccccttcctgcacgattcgcgcggatttccgcagcggcaaacattcgttcgatcgattgaccgatcggccatggcggccatggtggcgtccacggcgacctccttctcctaccacaagccgcgattcgcggtggagtgcaggaagaaggaccgggaccgggacagggacagggagcggccggagcgggagaaggagcacaagtacccgttcaaggtcgtcgagatcacgccgccgccgcggtgcctcggcgtccgctgcttccccaccaacatccactgcggggagagcgtgacgatcgaagggcaggcgtacacggtgtctgcggtgacgcaccggtaccagctgcgcaaggggcgctacgagcccagcgagaagcgcctcgacgtcctctccaccggcagatacctcctcaacctctacctcgacggcctcctcgacaagtcctgatctgattagattatgcatctaatctactactactccagtatttacatgagcataccagtacaattaattaaacatcgatcaacttcttttttttgtcatgagagatgtgtatatatgtatctgtaagtaagcactggcactgtaatcgccaacacctgtgtgatggaccaaggatggcgtgctctggatggattcagaggcggagcaacagaaagagactaaattagtttgttca

SEQ ID NO: 1515 - DNA, 574 bp, Festuca arundinacea
  misc_feature (371)..(371): n is a, c, g, or t
  misc_feature (394)..(394): n is a, c, g, or t
  misc_feature (430)..(430): n is a, c, g, or t
  misc_feature (433)..(433): n is a, c, g, or t
  misc_feature (458)..(458): n is a, c, g, or t
  misc_feature (460)..(460): n is a, c, g, or t
  misc_feature (463)..(463): n is a, c, g, or t
  misc_feature (475)..(475): n is a, c, g, or t
  misc_feature (504)..(504): n is a, c, g, or t
ggcacgaggagaaaatctgtggacgttcttctgcccgttcacccagccccttccgtgccacgcctccttcgttcgcaggaactctgcggattgcattcgatcagcagcagcgagatcaatcgccatggccatggtcgcttctacctccatcgtctaccacaagccgcgtctgacggtggtctgcaggaagaaggaccggccggacagggagctggagcgggagaagaaggaccacaagtacccgttcaaggtcgtcgagatcacgccgccgccgcgatgcctcggcgtgcgctgcttccccacgaacatccactgcggggagagcgtgacgatcgaagggcaggcgtacacggtgtcggcggtgacgcacnggtaccagctgcgcaaggggcgntacgagcccagcgagaagcgcctcgacgtcctctcnacnggaagatacatcctcaacctctacntnganagcctcctcganaagtcatagctctctctgatcatttactnagctagcaaatcagttagcaacagaaactcagcccctgcaatgcatgccactacctgtaagcaccgtttg

SEQ ID NO: 1516 - DNA, 2138 bp, Saccharum officinarum
  misc_feature (46)..(46): n is a, c, g, or t
  misc_feature (73)..(73): n is a, c, g, or t
  misc_feature (1638)..(1638): n is a, c, g, or t
  misc_feature (1734)..(1734): n is a, c, g, or t
  misc_feature (1748)..(1748): n is a, c, g, or t
  misc_feature (1803)..(1803): n is a, c, g, or t
  misc_feature (1829)..(1829): n is a, c, g, or t
  misc_feature (1882)..(1882): n is a, c, g, or t
caggcacatgactccaggcaaccaacgcttgagagttcacttcacntcgacagtcacaggacagcgcacaccncacccacaaccaccaccgcttctcctcccggaggccaaatcccaatcccccaggccaagggaaaggagggagagagaccttcccctctcctctcctctgcttccggtgagctatggagccggcagcggcggcgaagacggtggagcggctggcgcagcgcctggtgccgccggcggagccgaccccgacgggcccgcaccgcctgtcgtggctggaccggtacccgacgcagatggcgctcatcgagtcgctgcacgtcttcaagccggacccggcgcgggacggggtgagccccgcggcgaccatcgagcgcgccctcgcgcgggcgctggtcgactactacccgctcgccggccgcctcgccgtgtccgaggacgcggggggcctgcacgtcgactgcagcgccgagggcgtctggttcatcgaggccgccgtgcggtgccgcctggaggacgtggactacctcgagtacccgctccagatccccaaggacgacctgctcccgcacccgctgccgcggcccagccacgaggaggagagcaagcacatcctgctcgtccaggtgacggcgttcgcgtgcggcggcttcgtggtggggttccggttcagccacgcggtggcggacgggctgggcgcggccaagttcatgggcgcggtgggggagctggcgcgcggggcggagcaggtctccgtgtcccccgtctgggcgcgcgacgccatcccggacccgcccggcgcgctggtcggccgcctcccggaccccacgggcgcgaagcggctcgagtacctggccatcgacatctccgccgactacatcgaccacttcaagtcgcagttcgcggcggccacgggcggggggcggtgctcggcgttcgaggtgctcatcgccaaggcgtggcagagccgcacccgcgccgcggggttcgaggacccggcgaacacccccgtgcagctctgcttcgccatgaacgcgcgcccgctcctcggcgccacccgcctcccgcgtggcggcgcggggttctacggcaactgctactacatcatgcgcgtgtcctccacggccgacagggtggcgtcgtcgtccgtcaccgacgtggtgaagatcgtcagggaagggaagaagcggctgccgtcggagttcgcgcggtgggcggcgggggaggaaggggccggcggtgtggacccgtaccagatcacctccgactaccggacgctgctggtgtcggactggacgcgcctcggcttcgcggaggtggactacgggtggggcccgcccgcccacgtggtgccgctgacgaacctggactacatcgccacgtgcatcctcgtcaagccgtgggcccacaagccaggggccaggctcatcacgcagtgcgtgacgcccgaccgcgtctcgcgcttccacgacgccatggtggacatgaactagcgtcctggtgtccaccaccgccagcctcccgtttgttcatgggtttcttgttttttctcctctcatcatcagttactgtggtaattacagtgggtataattactaatcacattagccttctggcgagtggtcaagnaaaaaaatgtaaaaaatgaactaataatacgtatatactgataagaaagaaaacaaaggataataagacggtgtacaggcaggcagggatgcaacnagctaggtgaaggncagaaggagaggtatgtggggacagatagacagctaggtagtcgttggcaatagngggattggtattggattccttatttnctttggatgtcttcttttgttggtgtcgggtgcaagtacatggcctttctttnttcttgttctttgggggccttgattgaaagaaggatcaaagctggacttggtgggaagccaccaactagtctgcccctaataccatataagaagttattggatataggatccacctttttttattggcaataatactacaaggttacatagcaaaaaaaaaaaaggcgccgtctaaggatcagctactacggtgctgcacgatagtttttatgggccctaattcattcatgccgcgttacacgtggcagggaaacc

SEQ ID NO: 1517 - DNA, 2273 bp, Zea mays
tcgacgtccccgtaggcgtcccctcgcccgccaccgtgcgccagccgccaaccctcccctcgtacccggagccccgcgccgctgatccactccggaactcaccatctatataaaccaccacctccccagggcccaggcacaagaaaccaacacttgagttcacttcacctctactacacaggacagcgcacacggcacaccccacccaccagggccactaccaggtcaccactcaggcactcaccaccaccgctctctcggaggccaaatcccccaagaccaagggaaaggagggagagaaagagaccgtcccctcccctcctttcctttcggtgaggtggtgagcaatggagccggcagcggcggtggagcggctggcgcagcgcctggtgccgccggcggagcccacccccaccggccctcacggcctgtcgtggctggaccggtacccgacgcagatggcgctcatcgagtcgctgcacgtcttcaagcccgacccggcgcgtgacggggcgagcccctcggagaccatcgagcgggccctcgcgcgggcgctggtcgactactacccgctggccggccgcctcgccgtttccgagggcgccgggggcctccacgtcgactgcagcgccgagggcgtctggtttatcgaggccgctgtgcggtgccgcctggaggacgtcgactacctcgagtacccgctccagatccccaaggacgacctgctgccgcacccgctgccgaggcctacccaccaggaggagagcaagctgatcctactcgtccaggtgacagcgttcgagtgcggcggcttcgtggtgggcttccggttcagccacgcggtggcggacgggctcggcgcggccaagttcatgggcgcggtgggggagctggcgcgcggggcggaccgggtctccgtggcgcccacctgggcccgcgacgccatcccggacccggccggcgcgctggtcggcagcctccccgagcccacgggcgccaagcgcctcgagtacctggccgtggacatctccgctgactacatcgaccacttcaagtcccagttcgcggcggccacgggcgggggccgctgctccgcgttcgaggtgctcatcgccaaggcgtggcagagccgcacccgcgcggcggggttcgaggacccggacacccccgtgcagctctgcttcgccatgaacgcgcggccgcttctcggcgcccgcctcccgcgtggcggcgccggcttctacggcaactgctactacatcatgcgcgtcgcatccacggccgacaaggtgtcctcgtcgtccgtcgccgacgtggtgaaggtcatcagggagggaaagaagcggctgccgtccgagttcgcgcggtgggccgcgggggaggaggacgccgacccctaccagatcacctccgactaccggacgctgctggtgtcggactggacgcggctgggcttcgcggaggtggactacggctggggcccgcccgcccacgtggtgccgctgacgaacttggactacatcgccacgtgcatcctcgtcaagccatgggcccacaagccaggggcgaggctcatcacgcagtgcgtgacgcccgaccgcgtctcgcgcttccacgacgccatggtggacatgaactagtgtcccgtcgaccacacggccttcgtctccgtcagccccccgtttgttcatcggtttcttgattttttttctctcgtctccgttactgtggtaattagcagtcggtaattagtaatcacgttgcagccttctggcgagtggtcaacaacaacaacaaaaatgcaaacagtaaactaatacgtatagcaataacaaaaaagatactaataacaaaggtggtggcgtacatacagacaagacaagcagccagctagagccaggtgaggtgaaatgaaggacaggaggagaggtatggcgggacagctagaatagttgttgggattggtattggattccttattttctttgggtgtattctcttttgtcggtgccgggttttttctcttttgtgctcctttctggttcttgggggctttgatttgaaggaaatatcaaagctggacttggtgggaagccaccaactagtctgcccctaaatactataatcagattttatttgtaatatagtagtgttaactcttttttttgggtcaaattgtatacacatgaactacaaggtatgtgatcttgcaaagaaacatagcagtaatgggtacatactgcatattatttttcgcgtgaacatctgcatga

SEQ ID NO: 1518 - DNA, 2137 bp, Zea mays
acaagaaaccaacacttgagttcacttcacctctactacacaggacagcgcacacggcacaccccacccaccagggccactaccaggtcaccactcaggcactcaccaccaccgctctctcggaggccaaatcccccaagaccaagggaaaggagggagagaaagagaccgtcccctcccctcctttcctttcggtgaggtggtgagcaatggagccggcagcggcggtggagcggctggcgcagcgcctggtgccgccggcggagcccacccccaccggccctcacggcctgtcgtggctggaccggtacccgacgcagatggcgctcatcgagtcgctgcacgtcttcaagcccgacccggcgcgtgacggggcgagcccctcggagaccatcgagcgggccctcgcgcgggcgctggtcgactactacccgctggccggccgcctcgccgtttccgagggcgccgggggcctccacgtcgactgcagcgccgagggcgtctggtttatcgaggccgctgtgcggtgccgcctggaggacgtcgactacctcgagtacccgctccagatccccaaggacgacctgctgccgcacccgctgccgaggcctacccaccaggaggagagcaagctgatcctactcgtccaggtgacagcgttcgagtgcggcggcttcgtggtgggcttccggttcagccacgcggtggcggacgggctcggcgcggccaagttcatgggcgcggtgggggagctggcgcgcggggcggaccgggtctccgtggcgcccacctgggcccgcgacgccatcccggacccggccggcgcgctggtcggcagcctccccgagcccacgggcgccaagcgcctcgagtacctggccgtggacatctccgctgactacatcgaccacttcaagtcccagttcgcggcggccacgggcgggggccgctgctccgcgttcgaggtgctcatcgccaaggcgtggcagagccgcacccgcgcggcggggttcgaggacccggacacccccgtgcagctctgcttcgccatgaacgcgcggccgcttctcggcgcccgcctcccgcgtggcggcgccggcttctacggcaactgctactacatcatgcgcgtcgcatccacggccgacaaggtgtcctcgtcgtccgtcgccgacgtggtgaaggtcatcagggagggaaagaagcggctgccgtccgagttcgcgcggtgggccgcgggggaggaggacgccgacccctaccagatcacctccgactaccggacgctgctggtgtcggactggacgcggctgggcttcgcggaggtggactacggctggggcccgcccgcccacgtggtgccgctgacgaacttggactacatcgccacgtgcatcctcgtcaagccatgggcccacaagccaggggcgaggctcatcacgcagtgcgtgacgcccgaccgcgtctcgcgcttccacgacgccatggtggacatgaactagtgtcccgtcgaccacacggccttcgtctccgtcagccccccgtttgttcatcggtttcttgattttttttcctcgtctccgttactgtggtaattagcagtcggtaattagtaatcacgttgcagccttctggcgagtggtcaacaacaacaacaaaaatgcaaacagtaaactaatacgtatagcaataacaaaaaagatactaataacaaaggtggtggcgtacatacagacaagacaagcagccagctagagccaggtgaggtgaaatgaaggacaggaggagaggtatggcgggacagctagaatagttgttgggattggtattggattccttattttctttgggtgtattctcttttgtcggtgccgggttttttctcttttgtgctcctttctggttcttgggggctttgatttgaaggaaatatcaaagctggacttggtgggaagccaccaactagtctgcccctaaatactataatcagattttatttgtaatatagtagtgtttaactcttttttttgggtcaaattgtatacacatgaactacaaggtatgtgatcttgcaaagaaacatagcagtaatgggtacatactgcatattatttttcgcgtgaacatctgcatgatt

SEQ ID NO: 1519 - DNA, 2259 bp, Sorghum bicolor
ggcacatgactccaggcaaccaccaacgctcgagagttcgcttcacctcagcgacagtcacacaggacagcgcacaccccacccacaaccaccaccaccaccgccgcttctcctccccaaggccaaatcccaatccccccaggccaagggaaaggaggtcccctcccctctccttccggtgaggcggcggggagctatggagccggcggcgaagacggtggagcggctggcgcagcggctggtgccgccggcggagccgaccccgacgggtccgcaccggctgtcgtggctggaccggtacccgacgcagatggcgctcatcgagtcgctgcacgtcttcaagccggacccggcgcgtgacggggtgagccccgcggcgaccatcgagcgcgccctcgcgcgggcgctggtcgactactacccgctcgccggccgcctcgccgtgtccgcgggtggccagctccacgtcgactgcagcgccgagggcgtctggttcatcgaggccgccgtgcggtgccgcctcgacgacgtcgactacctcgagtacccgctccagatccccaaggacgacctgctcccgcacccgctgccccggcccagccacgacgaggagtccaagctcatcctgctcgtccaggtgacggcgttcgcgtgcggcggcttcgtggtggggttccggttcagccacgcggtggcggacggtctgggcgcggccaagttcatggccgcggtcggggagctcgcgcgcggggcggagcaggtctccgtgccccccgtctgggcgcgcgacgccatccctgacccgcccggcgcgctggtgggcagcctcccggacccgacgggcgcgaagcggctggagtacctagccatcgacatctccgccgactacatcgaccacttcaagtcgcagttcgcggcggcgacgggcgggggccggtgctcgtccttcgaggtgctcatcgccaaggcgtggcagagccgcacccgcgcggcggggttcgatgacccggcgagcacccccgtgcagctctgcttcgccatgaacgcgcgcccgctcctcctcgccggcggctccggcggcacgcgttccccgcgtggtggcggcggcggcgcggggttctacggcaactgctactacatcatgcgcgtgtcgtccacggccgaccgggtggcgtcgtcgtccgtgaccgacgtggtgaggatcatcagggaagggaagaagcggctgccgtcggagttggcgcggtgggcggcgggggaggacggcggggtggacccgtaccagatcacctccgactaccggacgctgctggtgtcggactggacccggctgggcttcgcggaggtggactacgggtggggcccgcccgcccacgtggtgccgctgacgaacctggactacatcgccacgtgcatcctcgtcaagccctgggcccacaagccaggggccaggctcatcacccagtgcgtcacgcccgaccgcgtcgagcgcttccacgacgccatggtggacatgaactagcagctggcggcaccgccagcctgccgttttgttcatgggtttcttgcttttttttttctctctctctctcctctcatcactcatcagttaccgtggtaattagcagtgggtatatatataattactaatcacattgcagccttctggcgaatggtaaaaaaaccgcaaacaataaactaaaacatatatactgataaaaaagcagaagaaaaagaaaaggataataaggtggtgtagatagaggcaggcaggcagccagctagaggcaggaggagaggtatgggggactggtagacagctaggtagcagttggcaatagtgggattggtattggattccttatttcctttggatgtcttcttcttttgttgttgggtgcatgtacatgcctatttttcttttcttcttctttcttgttctttggggggctttgattgaaagaaggaacaaaactggacttggtgggaagccaccaactagtctgcccctaaataccataccataataagatttttattgtaatatagtattcaactcttttcttgtttatttctttttgtcaaatagtgtatacgaagtataaggcatgtgagcttaagtttcaaagagagaaaacgctgtaatcgctacatactcctccatacagacagagacagccatctaattttagcatgtgaagctgtggctttcgatatgatggtggtctatgcaattaaagggtctttggtagttggtac

SEQ ID NO: 1520 - DNA, 2335 bp, Panicum virgatum
actgtgcgtgtgcgccaccttccccctcccctctacccctcccggagaagagaagcgccgcgctgcctgcttgcccatccactccccgacgaactcacccatctataaaaccctccacctccgccgctgcacataactccaagcaaccaccaccaccactccaatttcacttcacctcgacagcgcacaccccacccaccggtctccctctccctccctccaccaccaccgaattagccaaggcaacaggcggagcaggggggcctctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgactactacccgctcgcgggccgcctcgccgtgtccgacgccgccggcgggctccacgtcgactgcaacggcgagggcgtctggttcgtcgaggccgccgtgcggtgccggctcgaggacgtcgactacctcgagtacccgctgcagatccccaaggacgacctgctcccgcacccgctgccgcgccccacccgcgaggaggagaacaagctcatcctgctcgtccaggtgaccacgttcgggtgcggcggcttcgtggtggggttccggttcagccacgcggtggcggacgggctgggcgccgccaagttcatgggcgcggtgggggagctggcgcgcggggcggaccagatctcgccgcccccgacctggggccgcgacgccatcccggacccggccggcgcgcacgtcggcagcctcccagagctggacggcgccaagcgcctcgagtacctggccatcgacatctccgccgactacatcgaccacttcaagtcccagttcgcggcggcgtcgggcgggggccgctgctcggcgttcgaggtgctcatcgccaaggcgtggcagagccgcacccgcgccgcggcgttcgacgccgacacccccgtccacctctgcttcgccgtgaacgcgcgcccgctcctcgccgcccgcctcccgcgcgccggcgtcggcttctacggcaactgctactacatcatgcgcgtgtcctccacggccgggaaggtctccacctcctcggtcaccgacgtggtgaggatcatcagggaggggaagaagcggctgccgtccgagttcgcgcggtgggcggccggggaggaggccggggacccctaccagatcacctccgactaccggacgctgctggtgtcggactggacgcggctgggcttcgccgaggtggactacgggtggggcccgccagcccacgtggtgccgctgacgaacctggactgcatcgccacgtgcatcctcgtcaagccctgggcccacaagccaggggcgcggctcatcacgcagtgcgtgacgcccgaccgcgtcgccgccttccacgacgccctggtggacatgaactgctagcaatccacaccttccattccatctgttgttcttttaaactcttcgattaaattaccgcggtacgtaattagcagggggtaatggcattaaacagcccttctggtgacgaagagcgacagcaaagaataaagtcagaaagtgacaaaatatcgataaagtacatagagccagcaggtttgggggactggtagacagctagacggtagttggcaatagtgggattggtattggattccttatttcctttggatgtcgtcttcttttgttggtggtggtgggaggcaggtctaggactctagctgtgtgtatacgtgtcctcttttcttattttctgctgtcagttcttgggggggctttgattgaaggaaggatgctcaaagctggacttggtgggaagccaccaactaacctccccctaaatctcaatataaagatgtggattcgatgacctgtattatagtattcaacattttttttcttctttgtcatatactatacacaagccaataatgagtacagcctttgaattgcggattctaaatttctgacttctgaaagtggtgcttgtccgtgctccattttattcagaaattataaattctgctgagatccttggtcagaaatgtaaattatttatgatttgttatcattttgtgattctcattagtcaaatctttttgaaatattgatgttaatagaggtcgcatcttgtagggccaccgat

SEQ ID NO: 1521 - DNA, 2116 bp, Brachypodium distachyon
aaacctccccaactttcaattccctacatcgacgcgcacctaccagcaacagctcaccatcacgcccacacgtcaagccaaacccccgaaaggggcgcctccgctgtcccgctccgcgcgttccacatggcggcggcggcggcggccaagcccgtgcccgtagagcggctcgcgcagcgcctggtcgcgccggcggggccgacgccggagggcccgctccgcctgtcgtggctcgaccgctacccgacccagatggctctcatcgagtcgctgcacgtgttcaagcccgacatggccagggaaggggattcccccgccagggccgtggagcgggccctggcgagggcgcttgtcgactactacccgctggccggccgcctcgccgtgtccgatgccggcgagctgcaggtggactgccgcgacggtggggtctggttcatcgaggccgccgtcaggtgtcggctggaggacgtcgactatctggagtaccctctcgccgtcgacaaggacgagctgctcccccacccgcgccccaagcccacccacgaggaagagagcaagctcatcttgctcgtccaggtgacgacgttcgattgcggcggcttcgtggtggggttccgcttcagccacgcggtggcggacgggccaggggcggcgcagttcatgggcgcggtgggggagctggcgcgcggggcgggccgcatctcggtgcccccggcgtggggccgcgacgccatcccggacccggccggcgcgctcgtgggccgcctcccggagcccgccggcgccaagcggctcgagtacctcgccatcgacatctccgcggactacatcaaccacttcaaggcccagttcgcggcggccacgggcggggcccggtgctcggcgttcgaggtgctcatcgccaaggcgtggcagagcaggacacgcgccgcgggcttcgacgaggaatcccccgtccatctctccttcgccatgaacgcgcggccgctcctccacgcgcgcctcccttccgggggcgcgggattctacggcaactgctactacatcatgcgcgtctcctccacggccggtaaggtggcctcgtcctccatggccgacgtcgtcaagatcatcaaggaagggaagaagcggctgccttcagagttcgcgcggtgggccgcgggggagatggccggcgtggacccgtaccaaatcacctccgactaccggacgctgctcgtctccgactggacccggctgggcttcgccgaggtggactacggctggggcccgccggcccacgtcgtgccgctcacgaacctggactacatcgccacgtgcatcctcgtcaagccctgggcgcacaagccaggcgcgcgccttatcacgcagtgcgtcacgcccgaccgcgtggccgccttccacgacgccatggtggacaccaactaggtccgttccaccgcttcccagttcccacgacgctcatcctctgctttctccatccacggggttccctgcatttccttacagcggcaatgaactagtagttgttaattacagcttggtgagcaacaataatggtaaactaagcaagaatagtggtaaactggtagtgaagaaaggcatcaaagaaggacggaagaaagaagaagaagactagaacagaacataacgatatgggggacaggtagacacagctaaatggcggttggcaatagtggaattggtattggattcctttggacgttctcggtggtgtttggtgaagactgtgtacgacaagggggttctagttgaaggatcaaggcgccaccgactagtctccccttccgtcagcgtattgtactattcaattttattttttattttttaaaatataaacccgcaaggtgtatagacttttctgtagttgatatcttcaggtgttgttctgtccatgtaagataactaatccttgtacattacctgtctaaactccaactggtaagaggaccctagtttgatgccctgttgtagtttttcgtgtaaagagctggtacttactacttagtttaacttcccaacggagtagtaattttgattcagtatcattctgctgtaatttttggcaagaaagagctgccttcagatggca

SEQ ID NO: 1522 - DNA, 2033 bp, Avena sativa
cccccgcctcaattcaattcactccatcaacacgtacccaccaccagcattccagcaacagctcaccatcacaccgcacctcataccaaaccccacggtgcgtgtcctcctgccccattctacatggcggcggtcgcggccaagcccgtgcccgtgcccgtggagcggctcgcgcagcgcctggtggcgccggcgggaccgacgccggagggcccgctccgcctgtcgtggctcgaccgctaccccacccagatggcgctcatcgagtcgctgcacgtgttcaagcccgacatggccagggcggacgatagcccggcgagggccgtggagcaggccctggcgagggctctcgtggactactacccgctcgcgggccgcctcgcggtgtccgacgccggcgagctgcaggtggactgcagcgacgccggcgtgtggtttatcgaggctgcggtcaggtgccggctggaggacgtggactacctcgagtacccgctcgccgtcgataaggacgagctgatccctcacccgcgcccaaagcccagccttgaggaggagagcaagctcatcctgctggtccaggtcacaacgttcgattgcggcggcttcgtggtgggtttccggttcagccacgcggtggccgacgggcccggggcggcgcagttcatgggcgcggtcggggagctggcgcggggggcggaccgcatctccgtggcgccggcgtggggccgcgacgcgatcccggacccggccggcgcgcttgtcggcggcctcccggagcccgtcggcgccaagcggctcgagtacctcgccatcgacatctcagccgactacatcaaccacttcaagggccagttcgcggcagccacgggcggggcgcggtgctcggcgttcgaggtgctcatcgccaaggcgtggcagagccgcacccgcgccgcgggcttcgacgaggacagccccgtccacctctccttcgccatgaacgcgcggccgctcctccacgcccgcctccccaacgccggagcggggttctacggcaactgctactacatcatgcgcgtgtcctccacggccggcaaggtggcctcctccaccatcaccgacgtcgtcaagatcatcaaggaggggaagaagcgccttccctcggagttcgcgcggtgggcggccggggagatggccggcttcgacccgtaccagatcacctccgactaccggacgctgctcgtgtccgactggacgcggctgggcttcgccgaggtggactacgggtggggtcctcccgcccacgtcgtgccactgacaaacctggactacatcgccacgtgcatcctcgtcaagccctgggtccacaagccaggcgcgcgcctcatcacgcagtgcgtgacgcccgaccgcgtcgccgctttccacgacgccatggtggacaccaactagctcactactccactgtttcttcatggtttcccttatttatttatttattacagtactccctccgaccatattaggtgacgtaagtttgtcaaaatttggatgaatctagacattatttagtatataggtttatccaaatttggagaaatctaagtcaactaatatggattggagggagtagtataatcacccacccagtgcttaattacagcttggttacaaacaactaaactgtatactggtaatctaagcaagaataaatggcaaactggtagtgatgaaaggtataaaaaggaagaaggaaagagtatgtatagatatggggggacagttagacacagctagatggtagtagttggcagtggtaagatcggtattggattcctttggatggtctcggtggtgctggatggtgttggatgaagtgtatgccacactttttttccttcttcttctttttggggtttttgattgacagatggaagctggacttggtgggaagctaccaactagtctacccctactgtattattcgattttatttgtattttgtttgaatataaatccgcaaggtgtgtatatatatacttttccttggttgt

SEQ ID NO: 1523 - DNA, 1873 bp, Hordeum vulgare
ggaattcactccatcaacacacgtacccaccgccagcaacaacagctcaccgtcacacctcaaaccaacccgaaggcgtgtcctcccccgttgcaaatggcggcggccgcggcaaagcccgtgccagtggagaggctcgggcagcgcctggtggcgccggcggctcctacgccggagagccatctgcgcctgtcgtggctcgaccgctaccccacccagatggctctcatcgagtcgctgcacgtgttcaagcccgacatggccaggcagggcgatagccccgcgagggccgtggagcaggccctggcgagggcgctggtggagtactacccgctggcgggccgcctcacggtgaccgacaccggcgagctgcaggtggactgcagtgacggtggcgtgtggtttattgaggctgccgtcaggtgtcggctagaggacgtggactatctcgagtacccgctcgtcgtcgacaaggacgagctgctcccccatccgcgccccaagcccagccgtgaggaggagagcaagctcatcttgctagtccaggtcacgacgttcgattgcggcggcttcggggtggggttccggttaaaccacgcggtggccgacgggcctggggcggcgcagttcatgggcgcggagggggagctggcgcgcggggcgagccgcatctcggtggcaccggtgtgggggcgcgacgcgatccctgatccggccggcgccctcgtcggcagcctcccggatcccgcgggcgccaagcggctcgagtacctggccatagacatctccgccgactacatcaaccacttcaagggccagttcgcggcggccaccggcggcgcccggtgctcagcgttcgaggtactcatcgccaaggcctggcagagccgcacgcgcgccgcttgcttcgacgagggctcccccgtgcacctctgcttcgcgatgaacgcgcggccgctcctccaagcccgcctcccgtccgggggcgccggcttctacggcaactgctactacatcatgcgcgtctcctcgaccgccgggaaggtggcgtcctccaccatcaccgacgtcgtcaagatgatcaaggaggggaagaagcggctgccgtcggagttcgcgcggtggggcgccggcgagatgggcagcgtggacccgtaccagatcacctccgactaccggacgctgctcgtgtccgactggacgcggctgggcttcgcggaggtggactacggttggggccctcccgcccacgtcgtgccgctgacaaacctggactacatcgccacgtgcatcctcgtcaagccctgggtgcacaagccaggcgcccgcctcatcacgcagtgcgtcacgcccgaccgtgtcgccgctttccacgacgccttggtggacaccaactagctcgacactgtctccgcagtccgcacacacactcctccatttgttcacgggttccctcctattcttccactctctagttacagatttggtgaccgaaagtaatggtaaaccgagcaagaataatactccagcaaacagatggtgaagaaacgtataaagtggaagaagaatacgcgtagatatggtgggcatctagacacagctagtactgtagatggtagtgggcaatgcctttgggtggtctcgggtgtgttgcttgaagtgtataccacacccttttcttcttttctctttctctttctggggggtttggattgaaggatcgaagctggacttggtaggaagctaccaactagtctcccctcgacttgtgtactctactgttctcttttttttttaatatgtaaacccgtaaggtgtacatactattctctagtggtttttgtccatgtataatcgaaaaacagctcatctt

SEQ ID NO: 1524 - DNA, 1908 bp, Oryza sativa
ctcattcaattcactcccccctccagcttctcactccccacacgcagcttccagctcatcaccccccacaaccacctcctccccctcccatggcggcggcggcgccggacaaggcggtggagcggctgtcccagaagctggtgcacccgtcgtcccccacgccgtcggccccgctccgcctctcctggctcgaccgctaccccacccagatggcgctcatcgagtcgctccacgtcttcaagcccgacccggcgagggacgccgcggggcaggggctcgcccccgcgcgcgccatcgagacggccctcgcgagagccctcgtcgagtactacccgctcgccgggaggctcgccgtctcccgggactccggcgagctccaggtggattgctgcggcggcgccggcggccatggcggggtgtggttcatcgaggcggctgtcccgtgccggctcgaggacgtggattacctcgagtaccctctcgccatctccaaggacgagctgctcccccacccgcgcccccgccccacccgcgacgaggaagacaagctcatcctgctcgtccaggtgacgacgttcgcgtgcggcgggttcgtggtggggttcaggttcagccacgcggtggcggacggcccgggggcggcgcagttcatgggcgcggtcggcgagctcgcccgcggcggcgagcgcatcacggtggccccgtcgtgggggcgcgacgcggtgcccgacccggccggcgccatggtcggcgccctcccggagccggccggcgcgtcccgcctcgagtacctcgccatcgacatctccgccgactacatcaaccacttcaagtcccagttcgcggcggccaccggcggcgcccgctgctccgccttcgaggtgctcatcgccaaggcatggcagagccgcacccgcgccgccgcgttcgacccctcgacgccgatcaacctctccttcgccatgaacgcccggccgctcctcctcccgcgcggcggcgccgggttctacggcaactgctactacatcatgcgggtggcctccaccgccgggagggtggcgacggcgagcgtcaccgacgtggtgaggatgatccgggaggggaagaagcggctcccgtcggagttcgcgcggtgggccgccggagagatggccggagtcgacccgtaccagatcacctccgactaccggacgctgctggtctccgactggacgcggctgggcttcgccgaggtggactacgggtggggcccaccgggccacgtcgtgccgctcacgaacctggactacatcgccacgtgtatcctcgtcaagccctgggcccacaaaccaggggcacggctcatcacccagtgcgtcacacccgaccgcgtcaccgccttccacgacgccatggtggacatcaactaatttattattataattataattattattattattattattcccttttctttttattttattttttttaccacgccacctttttcactttgtttttttaccactacttccttataattaattaattaattaattagatattaataatgaagaattaagggtaaaaaaaggagaggataaagaaaggtgaaaagtacatattgatattgagggtacaggtagatggtagtagttgttggcattattagtgggattggtattggattcctttggtgttgtttggtcaagtgtatactggagaacagctactacatgctgggtattccttttatttttttttcttttttttgggatcaaaagctggaattggtgggaagccaccaactaaccagtatgtcccccttgataagtgtaccatatattgtattcaatttttatcttattttcagaatggtatatataagctggcaaggtgtacagcctctttagttgtacttggatc

SEQ ID NO: 1525 - DNA, 783 bp, Zea mays
gacaagaaaacaaggggctatgttccttggaatgatgagatggataaggtactccttgatacatttgtggactattacaataaaggtgatagatgtcagaatgggtggaagtctcatgtatacaccgctgctgtgaagaatgtttttgagaagtgtaatgtcaccattacaaaggaaaatattagctctcgcagcaagacctttgataagcactacaatatcattaatggtttgttgtccactagtggttttggatgggattgggagaagaacaagctcaaagttgatagtgacactgtatgagatgagtacgttgagaggaataaggaagcaaaaggatatagacataaggttgtgaagttttgggatctactcagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgacggtccaaagctaccctcttctgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaactta

SEQ ID NO: 1526 - DNA, 783 bp, Zea mays
gacaagaaaacaaggggctatgttccttggaatgatgagatggataaggtactccttgatacatttgtggactattacaataaaggtgatggatgtcagaatgggtggaagtctcatgtatacacagctgctgtgaagaatgtttgtgagaagtgtaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggatctactcagcctagtgtacaataatggccaagcaaatggagagagtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgacggtccaaagctaccctcttccgccgaagttctcgccgcattacaagaggttgagggacttgatgaagacacataactttagctttatgacatcctcacctctaatgcacgcaagtttgagtcgatgatggcactcccaatggaaaggaggaagaggtggcttatgatgcaactaaggaagtgaaacaactta

SEQ ID NO: 1527 - DNA, 784 bp, Zea mays
gacaagaaaacaaggggctatgttccttggaatgatgagatggttaaggtactccttgatacatttgtggactattacaataaaggtgatagatgtcagaatgggtggaagtctcatgtatacacagctgctgtgaagaatgtttgtgagaagtgcaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgagaggaataaggaagcaaaaggatatagactataaggttgtgaagttttgagatctactcagcctagtgtacaataaagaccaagcaaatggagagggtgctaaaacagcagctgaaagtttaaaggaaatggcaaaagagaatgataccggaggcaaggatgctccatattctgtatctttctcgagtagtttaaaaagacaaagatcagatgattcatttaactctatgtggtgtgataagtttgacatgcttacatctgcattgaaagatgacggtccaaagctaccctctttcgtcgaagttctcgccgcattacaagaggttgagggacttgatgaagacacaaaacttgagctttatgacatccttacctctaatgcgcgtaagtttgagtcgatgatggcactcccaatggaaaggaggaagaggtggcttatgatgcagctaaggaagtgaaacaactta

SEQ ID NO: 1528 - DNA, 780 bp, Zea mays
gacaagaaaacaaggggctatgttccttggaatgatgagatggataaggtactccttgatacatttgtggactatcacaataaatgtgatagatagaatgggtggaagtctcatgtatacacagctgctgtgaagaatgtttgtgagaagtgtaatgtcaccattacaaaggaaaatattagctctcgtagcaagacctttgataagcactacaatatcgttaatggtttgttgtccactagtggttttggatgggattgggagaagaacaagctcaaagttgatagtgacactgtatgggatgagtacgttgagaggaataaggaagaaaaaggatatagacataaggttgtgaagttttgggatctactcagcctagtgtacaataaagaccaagcaaatggagagggtgctaaagcaacagctgaaagttcaaaggaaatggcaaaagagaatgataccagaggcaaggatgctccatattctgtatcttcctcgagtagtttaaaaagacaaagatcagatgattcatttaactctatatggtgtgataagttcgacatgcttacatctgcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaactta

SEQ ID NO: 1529 - DNA, 812 bp, Zea mays
tttttatatgtgtggttctttgattgtaggacaagaaaacaaggggctacgttccttggaatgatgagatggataaggtactccttgatacatttgtggactattacaataaaggtgatagatgtcagaatgggtggaagtctcatgtatacacaactgctgtgaagaatgtttgtgggaagtgtaatgtcaccattataaaggaaaatattagctctcgcagcaagacctttgataagcactacaatatcgttaatggtttgttgtccactagtggttttggatgggattgggagaagaacaagctcaaagttgatagtgacactatatgtgatgagtacgttgagaggaataaggaagcaaaaggatatagacataagattgtgaagttttgggatctactcagcctagtgtacaataaagaccaagcaaatggagagggtgctaaaataacagctgaaagttcaaaggaaatggcaaaagagaatgatactggaggcaaggatgctccatattctgtatcttcctcgagtagtttaaaaagacagagatcagatgattcatttaactctatgtggtgtgataagtttgacatgcttacatctgcattgaaagatgacggtccaaagctaccctcttcggccaaagttctcgccgcattacaagaggttgagggacttgatgaagacacataacttgagctttatgacatcctcacctctaatgcacgcaagtttgagtcgatgatggcactcccaatggaaaggaggaagaggtggcttatgatgcagctaaggaagtgaaacaactta

SEQ ID NO: 1530 - DNA, 779 bp, Zea mays
gacaagaaaacaaggggctatgttccttggaatgatgagatggataaggtactccttgatacgtttgtggactattacaataaaggtgatagatgtcagaatgggtggaagtctcatgtatacacagctgctgtgaagaatgtttgtgagaagtgcaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtatgttgagaggaataaggaagcaaaaggatatagacataaggttgtgaagttttgggatctactgagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgatggtccaaagctaccctcttccgccgaagttctcgccgcattacaagaggttgaaggacttgatgaagacacagaacttgagctttatgacatcctcacctctaatgcacgcaagtttgagtcaatgatggcactcccaatggaaaggaggaagaggtggcttatgatgcagctaaggaagtgaaacaa

SEQ ID NO: 1531 - DNA, 782 bp, Zea mays
gacaagaaaacaaggagctacgttccttagaatgatgagatggataaggttctccttgataaatttgtggactattacaataaaagtgatagatgtcagaatgggtggaagtctcatgtatacacagctattgtgaagaatgtttgtgagaagtgtaatgtcaccattacaaaggaaaatattagctctcgtagcaagacctttgataagcactatgatatcattaatgggttgttgtccactagtggttttggatgggattgggagaagaacaagctcaaagttgatagtgacactgtatgggatgagtatgttgagaggaataaggaagcaaaaggatatagacataaggttgtgaagttttgagatctactcagcctagtgtacaataaagaccaagcaaatggagagggtgctaaaacagcagccgaaagttcaaaggaaatggcaaaagagaatgatatcggaggtaaggatgctccatattctgtatctttctcgagtagtttaaaaagacaaagatcagatgattcatttaactctatatggtgtgataagtttgacatgcttacatctgcattgaaagatgacggtccaaagctacccttttccgccgaagttcttgccgcattacaagaggttgagggacttgatgaagacacaaaacttgagctttatgacatcctcacctctaatgcagcaagtttgagtcgatgatggcactcccaatggaaaggaggaagaggtggcttataatgcagctaaagaagtgaaacaactta

SEQ ID NO: 1532 - DNA, 783 bp, Zea mays
gacaagaaaacaaggggctatgttccttggaatgatgagatggataaggtactcctcgatacgtttgtggactattacaataaaggtgatagatgtcagaatgggtggaagtttcatgtatacacagctgctgtgaagaatgtttgtgagaagtgcaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtatgttgagaggaataaggaagcaaaaggatatagacataaggttgtgaagttttgggatctactgagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgatggtccaaagctaccctcttccgccgaagttctcgccgcattacaagaggttgaaggacttgatgaagacacggaacttgagctttatgacatcctcacctctaatgcacgcaagtttgagtcaatgatggcactcccaatggaaaggaggaagaggtggcttatgatgcagctaaggaagtgaaacaactta

SEQ ID NO: 1533 - DNA, 783 bp, Zea mays
gacaagaaaacaaggggctatgttccttggaatgatgagatggataaggtactcctcgatacgtttgtggactattacaataaaggtgatagatgtcagaatgggtggaagtctcatgtatacacagctgctgtgaagaatgtttgtgagaagtgcaatgtcaccattacaaaggaaaatattagctctcgcagcaagacctttgataagcactacaatatcattaatggtttgttgtccactagtggttttggatgggattgggagaagaacaagctcaaagttgatagtgacaccgtatgggatgagtatgttgagaggaataaggaagcaaaaggatatagacataaggttgtgaagttttgggatctactgagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgatccatttaactctatatggtgtgataagtttgacatgcttacatctgcattgaaagatgatggtccaaagctaccctcttccgccgaagttctcgccgcattacaagaggttgaaggacttgatgaagacactgaacttgagctttatgacatcctcacctctaatgcacgcaagtttgagtcaatgatggcactcccaatggaaaggaggaagaggtggcttatgatgcagctaaggaagtgaaacaactta

SEQ ID NO: 1534 - DNA, 747 bp, Zea mays
ttgttggataaggtactccttgatacatttgtggactattacaataaaggtgatagatgtcagaatgggtggaagtctcatgtatacacagctgctgtgaagaatgtttgtgagaagtgtaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggatctactcagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatagtgtgataagtttgacatgcttacatctgcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaactta

SEQ ID NO: 1535 - DNA, 783 bp, Zea mays
gacaagaaaacaaggggctatgttccttggaatgatgagatggataaggtactcctcgatacgtttgtggactattacaataaaggtgatagatgtcagaatgggtggaagtctcatgtatacacagctgttgtgaagaatgtttgtgagaagtgcaatgtcaccattacaaaggaaaatattagctctcgcagcaagacctttgataagcactacaatatcattaatggtttgttgtccactagtggttttggatgggattgggagaagaacaagctcaaagttgatagtgacactgtatgggatgagtatattgagaggaataaggaagcaaaaggatatagacataaggttgtgaagttttgggatctactgagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgatggtccaaagctaccctcttctgccgaagttctcgccgcattacaagaggttgaaggacttgacgaagacacagaacttgagctttatgacatcctcacctctaatgcacgcaagtttgagtcaatgatggcactcccaatggaaaggaggaagaggtggcttatgatgcagctaaggaagtgaaacacctta

SEQ ID NO: 1536 - DNA, 783 bp, Zea mays
gacaagaaaacaaggggctatgttccttggaacgatgagatggataaggtactcctcgatacgtttgtggactattacaataaaggtgatagatgtcagaatgggtggaagtctcatgtatacacagctgctgtgaagaatgtttgtgagaagtgcaatgtcaccattacaaaggaaaataatagctctcgtagcaagacctttgataagcactacaatatcattaatggtttgttgtccactagtggttttggatgggattgggagaagaacaagctcaaagttgatagtgacactgtatgggatgagtatgttgagaggaataaggaagcaaaaggatatagacataaggttgtgaagttttggggtctactcagcctagtgtacaataaggaccaagcaaatggagagggtgctaaaacagcagctgaaagttcaaaggaaatggcaaaagagaataataccggaggcaaggatgctccatattctgtatcttcctcgagtagtttaaaaagacaaagatcagatgattcatttaactctatatggtgtgataagtttgacatgcttacgtctgcattgaaagatgatggtccaaagctaccctcttccgccgaagttctcgccgcattacaagaggttgaaggacttgatgaagacacagaacttgagctttatgacatcctcacctctaatgcacgcaagtttgagtcaatgatggcactcccaatggaaaggaggaagaggtggcttatgatgcagctaaggaagtgaaacaactta

SEQ ID NO: 1537 - DNA, 775 bp, Zea mays
aacaagaaaacaaggggctatgttccttggaatgatgagatggataaggtactccttgatacatttgtgtactattacaataaaggtgatagatgtcataatgggtggaagtctcatgtatacacaactgctatgaagaatgtttgtgagaagtgtaatgtcaccattacaaaggaaaatattagctctcgcagcaagacctttcataagcactacaatatcattaatggtttgttgtccactagtggttttggatgggattgggagaagaacaagctcaaagttgatagtgacactgtatgggatgagtacaggaataaggaagcaaaaggttatagacataaggttgtgaagttttgggatctactcagcctagtgtacaataaagaccaagcaaatggagagggtgctaaaacagcaactgaaagttcaaaggaaatggtaaaagagaatgataccggaggcaaggatgctccatattgtgtatcttcctcgagtagtttaaggacaaagatcagatgattcatttaactctatgtggtgtgataagtttgacatgcttacatctacattgaaagatgacggtcagaagctaccctcttccgccaaagttctcgccgcattacaagaggttgagggacttgatgaagacgcagaacttgagctttatgacatcctcacctctaatgcacgcaagtttgagttgatgatggcactcccaatggaaaggaggaagaggtggcttatgatgcagctaaggaagtgaaacagctta

SEQ ID NO: 1538 - DNA, 783 bp, Zea mays
gacaagaaaacaaggggctatgttccttggaatgatgagatggataaggtactccttgatacatttgtggactattacaataaaggtgatagatgtcagaatgggtggaagtcttatgtatacacaactgctgtgaagaatgtttgtgagaagtgtaatgtcaccattacaaaggaaaatattagctctcgcagcaagacctttgataagcactacaatatcattaatggtttgttgtccactagtggttttagatgggattgggagaagaacaagctcaaagttgatagtgacactgtatgggatgagtacgttgagaggaataaggaagcaaaaggatatagacataaggttgtgaagttttgggatctactcagcctagtgtacaataaagaccaagcaaatggagagggtgctaaaacagcagctgaaagttcaaaggaaatggcaaaagagaataataccggaggcaaggatgctccatattctgtatcttcctggagtagtttaaaaagacaaagatcagatgattcatttaactccatatggtgtgataagtttgacatgcttacatctgcattgaaagatgacggtccaaggctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaactta

SEQ ID NO: 1539 - DNA, 783 bp, Zea mays
gacaagaaaacaaggggctatgttccttggaatgatgagatggataaggtactccttgatacatttgtggactattaaaataaaggtgatagatgtcagaatgggtggaagtctcaagtatacatagcttctgtgaagaatgtttgtgagaagtgtaatgtcaccattacaaaggaaaatattagctctcgcagcaagacctttgataagcactacaatatcattaatggtttgttatccactagtggttttggatgggattgggagaagaacatgctcaaagttgatagtgacactatatgggatgagtatgttgagaggaataaggaactaaaaggatataaacataaggttgtgaagttttggaatctactcagcctagtgtacaataaaaaccaagcaaatggagagggtgctaaaacaacaggtgaaagttcaaaggaaatgacaaaagagaatgataccggagacaaggatgctccatattccatatcttcctggagtagtttaaaaagacaaagattagatgattcattcaactctatgtggtgtgagaagtttgacatgtttaaatctgcattgaaagatgacggtccaaagctaccctcttccgccgaagttctcgccgcattacaagaggttgagggacttgatgaagacacagaacttgagctttatgacatcctcacctctaatgcacgcaagttcgagtcgatggtggcactcccaatggaaaggaggaagagatggcttatgatgcagctaaggaagtgaaacagctta

SEQ ID NO: 1540 - DNA, 815 bp, Zea mays
gtgttttttatatgtgtggttttttgattgtaggacaagaaaacaagggctatgttccttggaatgatgagatggataaggtactccttgatacatttgtggactattacaataaaggtgatatatgtcagaatgggtggaagtctcatgtatacacaactgctgtgaagaatgtttgtgagaagtgtaatgtcaccattacaaaggaaaatattagccctcgcatcaagacctttgataagcactacaatatcattgatggtttgttgtccactagtggttttggatgggattgggagaagaacaagctcaaagttgatagtgacattgtatgtgatgagtacgttgagaagaatgaggaagcaaaaggatatagacataaagttgtgaagttttgggatctactcagcctagtgtacaataaagaccaagcaaatggagagggtgctaaaacagcagctggaagtttaaaggaaatggcaaaagagaatgataccggaggcaaggatgctccatattctgtatcttcctcgagtagtttaaaaagacaaagatcagatgattcatttaactctatgtggtgtgataagtttgacatgcttacatctgcattgaaagatgatggtccaaagctaccctcttccgccgaagttctcaccgcattacaagaggttgagggacttgatgaagacacaaaacttgagctttatgacatcctcacctctaatgcacgcaagtttgagtcgatgatggcactcccaatggaaaggaggaagaggtggcttatgatgcaactaaggaagtgaaacaactta

SEQ ID NO: 1541 - DNA, 767 bp, Zea mays
gacaagaaaacaaggggctatgttccttggaatgatgagatggataaggtactccttgatacatttgtggactattacaataaaggtgatagctgtcagaatgggtggaagtctcatgtatacatagctgctgtgaagaatgtttgtgagaagtgtaatgtcaccattacaaaggaaaatattagctctcgcagcaagacctttgataagcactacaatatcattaatggtttggtgtccactagtggttttggatgggattgggagaagaacaagctcaaagtttatagtgacactatatgggatgagtacgttgagaggaataaggaagcaaaaggatatagacataaggttgtgaagttttgggatctactcagcctagtgtacaataaagaccaagcaaatggagagggtgctaaaatagcagctaaaagttcaaaggaaatggcaaaagataatgataccgtatgcaaggatgcttcatattctgtatcttcctcgagtagtctaaaaagacaaagatcagatgattcatttaactctatgtggtgtgataagtttgacatgcttacatctgcattgaaagatgatggtccaaagctaccgtcttccgtcgaagttctcaccgcattacaagaggttgagggacttgatgaagacacagaacttgagctttatgacatcctcacctctaatgcacgcaagtttgagtcgatgatggcactcccaatggaaaggaggaagaggtggattatgatgtagctaag

SEQ ID NO: 1542 - DNA, 1177 bp, Zea mays
gcacgtttcagaccctcacccattggaaaggtttagaaagttagctaggtttcagcctctcgcactgctcgtgcctcgagcacaacggtggcggcgacggcagcgggactgttctggccgacgacggcatcgacgacgacgaggagtgttaaaacagctcgttgttttgggatttgctgcctcaagtttcatctagctacctccaacaaacccttcaatctccatggctacatcggacaagaaaacaaggggctatgttccttggaatgatgagatggataaggtactccttgatacatttgtggactattacaataaaagtgatagatgtcagaatgggtggaagtctcatgtatacacagttgctgtgaagaatgtttgtgagaagtgtaatgtcaccattacaaaggaaaatattagctctcgcagcaagaactttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggatctactcagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatatggtgtgataagtttgacatgcttacatctgcattgaaagatgacggtccaaagctaccctcttccgccgaagttctcgccgcattacaagaggttgagggacttgatgaagacacataacttgagctttatgacatcctcacctctaatgcacgcaagtttgagtcgatgatggcactcccaatggaaaggaggaagaggtggcttatgatgcagctaaggaagtgaaacaacttatatatgaacttagatctctgtgttgaactgattatgtgacttgtctttgtgaaacttttgtgtgcgaacttgatggctatgtgaaattgttgtgtgcgaacttgatggctttatgaaactgctatgtgaagatttgatgtctttgtagaacttttatgt

SEQ ID NO: 1543 - DNA, 725 bp, Zea mays
gttttttatatgtgtggttctttgattgtagggacaagaaaacaaggggctatgttccttggaatgatgagatggataaggtactcctcgatacatttgtggactattacaaaggaaaaatattagctctcgcagcaagacctttgataagcactacaatatcattaatggtttgttgtccactagtggttttggatgggattgggagaagaacaagctcaaagttgatagtgacactgtatgggatgagtatgttgagaggaataaggaagcaaaaggatatagacataaggttgtgaagtttcgggatctactcagcctagtgtacaataaagaccaagcaaatggagagggtgctaaaacagcagctgaaagttcaaaggaaatggcaaaagagaatgataccggaggcaaggatgctccatattctgtatcttcctcgagtagtttaaaaaagacaaagatcaaatgattcatttaactctatatggtgtgataagtttgacatgcttacatctgcattgaaagatgatggtccaaagctaccctcttccgccgaagttctcgccgcattacaagaggttgaaggacttgatgaagacacataacttgagctttatgacatcctcacctctaatgcacgcaagtttgagtcgatgatggcacttccaatggaaaggaggaagaggtggcttatgatgcagctaaggaagtgaaacatctta

SEQ ID NO: 1544 - DNA, 1125 bp, Zea mays
attggaaaggtttagaaagttagctaggtttcagcctctcgcactgctcgtgcctcgagcacaacggtggcggcgacggcagcgggactgttctggccgacgacggcatcgacgacgacgaggagtgttaaaacagctcgttgttttgggatttgctgcctcaagtttcatctagctacctccaacaaacccttcaatctccatggctacatcagacaagaaaacaaggggctatgttccttggaatgatgagatggataaggtactccttgatacatttgtggactattacaataaaagtgatagatgtcagaatgggtggaagtctcatgtatacacagttgctgtgaagaatgtttgtgagaagtgtaatgtcaccattacaaaggaaaatattagctctcgcagcaagaactttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggttctacttagcctagtgtacaataaagaccaagcaaatggagagggtgctaaaacagcagttgaaagttcaaaggaaatggcaaaagagaatgataccggagacaaggatgctccatattctgtatcttcctcgagtagtttaaaaagacaaagatcagatgattcatttaactctatatggtgtgataagtttgacatgcttacatctgcattgaaagatgacggtccaaagctaccctcttccgccgaagttctcgccgcattacaagaggttgagggacttgatgaagacacataacttgagctttatgacatcctcacctctaatgcacgcaagtttgagtcgatgatggcactcccaatggaaaggaggaagaggtggcttatgatgcagctaaggaagtgaaacaacttatatatgaacttagatctctgtgttgaactgattatgtgacttgtctttgtgaaacttttgtgtgcgaacttgatggctatgtgaaattgttgtgtgcgaacttgatggctttatgaaactgctatgtg

SEQ ID NO: 1545 - DNA, 910 bp, Zea mays
gacaagaaaacaaggggctatgttccttggaatgatgagatggataaggtactccttgatacatttgtggactattacaataaaagtgatagatgtcagaatgggtggaagtctcatgtatacacagttgctgtgaagaatgtttgtgagaagtgtaatgtcaccattacaaaggaaaatattagctctcgcagcaagaactttgataagcactacaatatcattaatggtttgttgtccactagtggttttggatgggattgggagaagaacaagctcaaagttgatagtgacactgtatgggatgagtacgttgagaggaataaggaagcaaaaggatatagacataaggttgtgaagttttgggttctacttagcctagtgtacaataaagaccaagcaaatggagagggtgctaaaacagcagttgaaagttcaaaggaaatggcaaaagagaatgataccggagacaaggatgctccatattctgtatcttcctcgagtagtttaaaaagacaaagatcagatgattcatttaactctatatggtgtgataagtttgacatgcttacatctgcattgaaagatgacggtccaaagctaccctcttccgccgaagttctcgccgcattacaagaggttgagggacttgatgaagacacataacttgatctttatgacatcctcacctctaatgcacgcaagtttgagtcgatgatggcactcccaatggaaaggaggaagaggtggcttatgatgcagctaaggaagtgaaacaacttatatatgaacttagatctctgtgttgaactgattatgtgacttgtctttgtgaaacttttgtgtgcgaacttgatggctatgtgaaattgttgtgtgcgaacttgatggctttatgaaactgctatgt

SEQ ID NO: 1546 - DNA, 1256 bp, Sorghum bicolor
cattcctctccgccccctcagacccgcaagcgaaggccacccccgatccccgcctccattcccgggccggagaccccgcctgcccgcgccgccgccagccatgggaatggggccgttcaatgacgccgtgtcggccgtcgagtccgccgccgccgccgccgccgctgctgccggcgccgccgccggtgccgccgtcgtctcggccgtggccgctgaggtggtaccctcggcggggggcggctcgtacgcggtgcttcagtgcggcgaggactcggagtacgtgcgccagaagtacagcggctacttcaccgtcttccgcgcgctgctggaggaggacggcgagagctggcgggtgtaccgcgccgtccgcggggagctccccaccgacgccgaggcggcggccttcgacggcttcgtcatctccgggagctgcgccgacgcgcacgcggacgacccatggatcctcgacctcgtcggcctcatccgccgcctccacgccgccggcaagcgcttcctcggcgtctgcttcggacaccagatcctgtgccgcgcgctgggcggccgcacggggcggtcgaccaagggctgggacatcggcgtgagctgcatccacccgacggcggcggcggcgcggctgttcgcgccgctgaagctgcccgttcacatgccggtgatcgagttccaccaggacgaggtgtgggatcttccggccaacgccgaggtgctggcgcgctccgacaagacccgcgtcgagatgttccgcctcggcgaccgcgtcatgggcgtccagggccacccggagtacagcaaggacatcctcatgagcatcgccgaccgcctcctccgccataaccaaatcctggactgccaggtggacgtggcgaaggcgagcttcgacgtgcggcagccggacaaggagctgtggaagaaggtgtgcagggccttcctcaaggggaggctcccgtcgcagcagcagcagcagcagcaagctgtggcgctatagcatgcatgcatttccactaattaaaaggcaaggcaggcttaagctgacgagggaggaggaggagcaagttaccacaggagcaggaggaaattgggagcattccattggatgcctaggtttttttcatccttgttttgtgcttcatcagagctcaagagttgtacagaaactactattgaacgaagcattaataaagaggacaaggggaaaaaaattgttcgttggtttttatcatttctctggtccacagttc

SEQ ID NO: 1547 - DNA, 843 bp, Saccharum officinarum
caccacaaagagagcgagaggccgagaagcgctttagccgtagcgataagagtgagctggtgcaccggcatggcggccacggcgtactccgtggcgctcctcggcggcgcacgcctgccggccgccccgcgctccgccctcctccctcggcgcagcgtctgccagcttcgcctccaagatgcaccgaggctctccctgctccgtgcgaaggccgcgtccgaggacacatcggcctccggcgacgagctcatcgaggacctcaaagcaaagtgggacgccgttgaggacaagcccaccgtcctcttgtacggcggcggcgccatcgtcgccctctggctgacgtccgtggtcgtcggcgccatcaacgccgtgccgctgctccccaagatcctggagctcgttgggctcggctacaccggctggttcgtgtaccgctacctcctcttcaaggaaagcaggaaagagttggccgccgacattgagaccttgaagaaaaagatagctggaacagaataaactctcatgaaaagttttagagggtcctttcttctttggaaagatatctaatcggagaaccgtaccaatgcaactacttgagtaccattattgcacatgtgttgagtgatgtatatcttctgtatacaaaggaagcttcgtttgttgtgtagtagcattgtagtttaaatgtatcgtactacctatctgctaaattcttctttttttatttggtaaatttgtgagtacatattgtacgtaaataagaacgtaaaacaaatagagtgtgtaatcgacatcagtattaagaacttattcgataagataaataatatgcaattgtaacat

SEQ ID NO: 1548 - DNA, 888 bp, Sorghum bicolor
tactccatagcagcgcacaccacaccacaccacaccacaaagagagagcgggcaaaaggtgaggccgagaagcgctttagccgttaggcgataagagtgagctggtgcaccggcatggcggccacggcgtactccgtggcgctcctcggcggcgcacgcctcccggccgccccgcgctccgccctcctccctcgccgcagcgtctgccagcttcgcctccaagatgcaccgaggctctccctgctgcgtgcgaaggccgcgtccgaggacacgtcggcctccggcgacgagctcatcgaggacctcaaagcaaagtgggacgccattgaggacaagcccaccgtcctcttgtacggcggcggcgccatcgtcgccctctggctgacgtccgtggtcgtcggcgccatcaacgccgtgccgctgctccccaagatcctggagctcgttgggctcggctacaccggctggttcgtgtaccgctacctcctcttcaaggaaagcaggaaagagttggccgccgacattgagaccttgaagaaaaagattgctggaacagaataaactctcatggaaagttttagagggccctttcttctttggaaagatatctaatcggagaacaatgcaactacctgagtactacagcccatgtgtgtgtgtgatgtatatcttcagtatacaaaggaaacatcgtttgttgtgtagtagcattgtattagtttaaatgtatctctactacctatctgctaaattcttcttttgatttggcaaatttgtgagtacgtaaataagaacgtaaaacaaatagagtatctaacctatatgagtactaaaaacttattcgacaagattaaaaaaatacaattgtaacataaacaaatattccct

SEQ ID NO: 1549 - DNA, 850 bp, Setaria italica
gagcacacagcaagagagcagagcgcgagcgaaaaaaaaggagaggccgagaagcgcttcggctagccgtagcgataagggtagagtagtagctggtgccaccggcggcaatggcggccacggcgtactccgtggcgctcctcggcggcgcgcgcctccccgccgtcccacgcggctccgccctcctcccgcgccgcaccgcctgccagcttcgcctccaagatgcgccgaggctgtccctgctccgcgtgaaggccgcctccgaggacacatcggcctccggcgacgagctcatcgaggacctcaaagccaagtgggacgccgttgaggacaagcccaccgtcctcttgtacggcggcggcgccgtcgtcgccctctggctcacgtccgtggttgtcggcgccatcaacgccgtgccgctgctccccaaaatcttggagctcgttgggctcggctacaccggctggttcgtctaccgctacctcctcttcaaggagagccggaaagagttggctactgacattgagaccttgaagaagaagatcgccggaacagaataagcgctagctcttgggagagttttgggtggttctttcttcttgggggaaaaatatttaacgggagaaccgtctgcttgagtactactgcccatgtgtgctatatatctgtatacaaaggaagctttgttgtgttgtgcagtaacattgtagtttaaatgtatcgcaccaccagtttgtttaatctgtctcttcctctaccaaatttgtgagtacatgtacacacaaaatacataaaaccaagaaaaatagcatgcgtaatctatatccacaaagaaaatctcaatatactg

SEQ ID NO: 1550 - DNA, 829 bp, Pennisetum glaucum
gagcagagcgcgagcgaaagagaaaaaggtgaggcccagaagcgcgcttcggctagccgtagcgataacgataagggtagagtagtagcagctggtgccaccggcggcaatggcggccacggcgtactccgtggcgctcctcggcggcgcgcgcctccccgccgccccgcgcggctccgccctcctcccgcgccgcaccgtctgccagcttcgcctagatgcgccgaggctgtccctgctccgcgtgaaggccgcctccgaggacacctcggcatccggtgacgagctcatcgaggacctcaaagccaagtgggacgccatcgaggacaagccaaccgtcctcttgtacggcggcggcgccgtcgtcgccctctggctcacgtccgtggtcgtcggcgccatcaacgcagtgccgctgctccccaagatcctggagctcgttgggctcggctacaccggctggttcgtctaccgctacctcctcttcaaggagagccggaaagagttggctaccgacattgagaccttgaagaagaagatcgccggaacagaataagggctagctctgggagagttttgggtggttctttcatccttggggagaaaatatttaacaagagaaccgtctgcttgagtaatactgcccatgtgtgctatatgatgcctatatatctgtatacaaaggaagctttgttgtgttgtgcagcaacattgtagtttaaatgtatcgcaccaccagtttgtttaattttttttcttttttttcttttttttacgttttttaaacgtaaacgtaacttactttacttcttgtagtagtaagtaaagt

SEQ ID NO: 1551 - DNA, 746 bp, Panicum virgatum
gagagaccgagcgagcgagagggaaaaaaaaaggagaggccgagaagccgcttcagctagccgtcgtagcgataagggtagctgccccgagctagctggtgctccggcatgatggcggccacggcgtactccgtggcgctcctcggcggcgcgcgcctccccgccgccccgcgctccgccgccctcccgcgccgcagcgcctgccagctccgcctccaagatgcgccgaggctctccctgctccgcgtgaaggccgcctccgaggacacctcggcctccgccgacgagctcatcgaggacctcaaagccaagtgggacgccgttgaggacaaacccaccgtgctcctgtacggcggcggcgccatcgtcgcgctctggctgacgtccgtggtcgtcggcgccatcaacgccgtgcctctgctacccaagatcatggagctcgttggcctcggctacaccggctggttcgtctaccgctacctcctcttcaaggaaagccggaaagagttggctagcgacattgagaccttgaagaaaaagatcaccggaacagaataaacgcacgctcttggagagttttgagtggttctttcatcttgggggagaaaatatgtaatgggagaaccgtctgcttgagtactactgccgatgtgtgctatatatctggatacaaaggaagctttgttatgttgtgcagtaacattgtagtttaaatatatcgctctaccagtttgtttaatttctct

SEQ ID NO: 1552 - DNA, 712 bp, Panicum virgatum
caacgagagagcgagcgagcggaaaaaaggagaggccgagaacgaagccgagctagctggtgctccggcgtgatggcggccacggcgtactccgtggcgctcctcggcggcgcgcgcctccccgccgccccgcgctccgccctcctcccgcgccgcagcgcctgccagctccgcctccagcaagatgcgccgaggctctccctgctccgcgtgaaggccgcctccgaggacacctcctcggcctccgccgacgagctcatcgaggacctcaaagccaagtgggacgccgttgaggacaagcccaccgtgctcttgtacggcggcggcgccatcgtcgccctctggctgacctccgtggtcgtcggcgccatcaacgccgtgccgctgctgcccaagatcatggagctcgttggcctcggctacaccggctggttcgtctaccgctacctcctcttcaaggaaagtcggaaagacttggctagcgacattgagaccttgaagaagaagatcaccggaacagaataaacacacgctcttggagagttttgagtggttctttcatcttggggggaaaatatgtaatgggagaaccgtctgcttgagtactactgccgatttgtgctatatatctggatacaaaggaagctttgttatgttgtgcagtaacattgtagtttgaatatatcgcactaccagtttgtttaatttctct

SEQ ID NO: 1553 - DNA, 732 bp, Panicum virgatum
gagcgagcgagcggaaaaaaggagaggccgagaacgaagccgcttcggctagccgtcgtagcgataagggtagctgctgccgagctaactggtgctccggcgtgatggcggccacggcgtactccgtggcgctcctcggcggcgcgcgcctccccgccgccccgcggtccgccctcctcccgcgccgcagcgcctgccagctcagcctccagcaagatgcgccaaggctctccctgctccgcgtgaaggccgcctctgaggacacctcctcggcctccgccgacgagctcatcgaggacctcaaagccaagtgggacgccgttgaggacaagcccaccgtgctcttgtacggcggcggcgccatcgttgccctctggctgacctccgtggtcatcggcgccatcaacgccgtgccgctgctgcccaagatcatggagctcgttggcctcggctacaccggctggttcgtctaccgctacctcctcttcaaggaaagccggaaagagttggctagcgacattgagaccttgaagaaaaagatcactggaacagaataaacgcacgctcttggagagttttgagtggttctttcatcttggggggaaaatatgtaacgggagaaccgtctgcttgagtactactgatgtgtgctatatatttggatacaaaggaagctttgttatgttgtgcagtaacattgtagtttgaatatatcgcactaccagtttgttt

SEQ ID NO: 1554 - DNA, 695 bp, Cynodon dactylon
agaggagagagaaaaggagaggccacgaacgaagcgccacctctagcgataagactagctaggtaaggcacggacatggcggccacggcgtactccgtggcgctcctcggcggcgcacgcctccccgccgtcccgcactccggcctgctgccccggcgcagcagcgtctgcccgcttcgcgtccaagctgcgccgaggctctcgctgctccgcgtgaaagccgcctccgaggacacctcggcctccggcgacgagctcatcgaggaactcaaagccaagtgggacgcaattgaggacaagcccaccgtgctcttgtacggcggcggcgccatcgtcgccctctggctgacgtccgtggtcgtcggagccatcaactccgtgccgctgctccccaagatcctggagcttgttggactcggctacacaggctggtttgtgtaccgctacctcctcttcaaggaaagcaggaaagagttagccacagacattgagagcttgaagaaaaagatcactggaacagaataaactctagaaagttttggatggtcgcatcttcttggaggaaaattaaaaatctaatgggagaaccaacactatcgagtactgctatccatgttcgctatatatcctgtacacaaaggaagctttgttctgttgtgcagtaacattgtagtttaaatgtatggtattactgg

SEQ ID NO: 1555 - DNA, 687 bp, Eragrostis curvula
  misc_feature (39)..(39): n is a, c, g, or t
  misc_feature (47)..(47): n is a, c, g, or t
  misc_feature (96)..(96): n is a, c, g, or t
  misc_feature (110)..(110): n is a, c, g, or t
  misc_feature (192)..(192): n is a, c, g, or t
  misc_feature (289)..(289): n is a, c, g, or t
  misc_feature (367)..(367): n is a, c, g, or t
  misc_feature (543)..(543): n is a, c, g, or t
  misc_feature (558)..(558): n is a, c, g, or t
  misc_feature (563)..(563): n is a, c, g, or t
ggagaggagagcaaaaggagaggccacgaacgacgcgcnccctctancgataagactaggtaaggcagcggctatggcggccacggcgtactccgnggcgctcctcggcngcgcacgcctccccgccgtcccgcgctccggccttcttccccggcgcagcagcgtctgcacgcttcgcctccaagatgcgcngaggctctcgctgctccgcacgaaggcggcctcctccgaggactcctcggcctccgccgatgaactcatcgaggacctgaaagccaagtgggacgcnattgaggacaagcccaccgtgctgttgtacggcggcggcgccatcgtcgctctctggctgacgtccgtggtcgtcggngccatcaactccgtgccgctgctccccaagatcctggagcttgttgggctcggatacaccggctggttcgtgtaccgctacctcctcttcaaggaaagcaggaaagaattagccacagacattgagagcttgaagaaaaagatcgctggaacagaataaactctctagaaagtttnggatcgttgcatctncctgngtaagaaaaaaaatctgatgggggaaccaactacttgagtactgctgcccgtgtgcgccgtatgtctgtataccaaggaagctttgttatgtggtgcagtaactttgtagtttaaatgtacggt

SEQ ID NO: 1556 - DNA, 767 bp, Zea mays
gcacacaatatccattccaccttggtccatcagcagcgagcgaacaggcaaaaaggaaaggccgagaagcgctttatccggccgtacgtagcgataagactggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtcgcgctatggttgacgtccgttgtcgtcggcgccatcaacgccgtgccgctgctccccaagatcctggagctcgttggcctcggctacaccggctggttcgtctaccgctacctcctcttcaagcaaagcaggaaagagctggtcgacgacattgagaccctcaagaaaaagattgctggaacggcggaataagcgctagctctcgtggaaagctttagaaaaccaacgacgagaggggccgtttcttctttgcaaattaagatatcaaaccgaggaacgtaccaatgcagctactgtcgcccatgtcatgtgttgtgtgatgcatacccttaccttctgtatacataacgaaattaaagagaggacagcattttgccttgcca

SEQ ID NO: 1557 - DNA, 799 bp, Zea mays
acaagacatcaggaggcctactacgtgtacgtgcacacaatatccattccaccttggtccatcagcagcgagcgaacaggcaaaaaggaaaggccgagaagcgctttatccggccgtacgtagcgataagagtggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtcgcgctatggttgacgtccgttgtcgtcggcgccatcaacgccgtgccgctgctccccaagatcctggagctcgttggcctcggctacaccggctggttcgtctaccgctacctcctcttcaagcaaagcaggaaagagctggtcgacgacattgagaccctcaagaaaaagattgctggaacggcggaataagcgctagctctcgtggaaagctttagaaaaccaacgacgagaggggccgtttcttctttgcaaattaagatatcaaaccgaggaacgtaccaatgcagctactgtcgcccatgtcatgtgttgtgtgatgcatacccttaccttctgtatacataacgaaattaaagagaggacagcattttgccttgcca

SEQ ID NO: 1558 - DNA, 752 bp, Brachypodium distachyon
ggcttgtagatagcatagcggaagacagagcgagaggccgagaaggaatagcactagcgataagccactgacatggctaccacggcgtactccgtggcccttcacggcggagcacgcctccccaccgccggcgccggcgctcctcgctccccctccgcccttctcccgcggcgcgcctttcacccgctccgcctccaagatgcgccgaggacgtctctgctccgtgtgaaggccgcctccgaggacacctcggcgagcggcgacgagctcatcgaggacctgaaagccaagtgggaagcggttgaggacaagcccaccttcctcctgtacggcggcggcgccgtggttgcgctctggctcaccaccgtggtggttggcgccatcaactccgtgccgttgctccccaagctcctggagctcgttgggctcgggtacaccggatggtttgtgtaccgctatctcctcttcaaggaaagcaggaaagagttggccagcgacattgagaccttgaagaaaaagatcgctggaacagagtaaacttgagttctccggaaggttttggatgcttctttggtctatccatctaatggaagaacacctacttgcttagagtactaccaattgcctttgtgtgctacatatatatctgtatgcaaaaagaatctttggtatggtgtccaatgtcaatagtgaaattgtaccaagtgtttgaaagccttctctttctttttatataaatgtgtttgtgcgag

SEQ ID NO: 1559 - DNA, 675 bp, Zea mays
  misc_feature (66)..(66): n is a, c, g, or t
attccacctgcttggtccatcagcacgagcgaacagggaaaaaggagaggccgagaagcgctttanattaagactggtgcacccgtagcggcacggcatggcggccacggcgtactccgtggcgctcctcggcggcgcacctgccggccgccttcctccctcgacgcgcagcgtgtgccaccagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtcgcgctatggttgacgtccgttgttgtcggcgccatcaacgccgtgccgctgctccccaagatcctggagctcgttggcctcggctacaccggctggttcgtctaccgctacctcctcttcaagcaaagcaggaaagagctggtcgacgacattgagaccctcaagaaaaagattgctggaacggcggaataagcgctagctctcgtggaaagctttagaaccaacgacgagagggcccgtttcttctttgcaaattaagatatcaaaccgaggaacgtaccaatgcacctactgtcccccatgtcatgtgttatgtatacctt

SEQ ID NO: 1560 - DNA, 679 bp, Leymus cinereus x Leymus triticoides
  misc_feature (351)..(351): n is a, c, g, or t
gcacgaggaaccgttccagcttttgttgtttggttagcaccaacgaaacgcagagcgagaggccgaggaagcgatagctctagcgataaggcactgacagatcaatggctgccacggcgtactccgtggccctcctcggcggggcgcgcctccccggccccaccggcaacgccgccccccgctcctccgccctcctcccgcggcgcaacctccacccgctccgcctccaagatgcgccgaggccgtccctgctccgcgtgaaggccgcctccgaggacacgtcggcgagcggcgacgagatcatcgaggacctcaaagggaagtgggaggcgattgaggacaagcccaccntcctcctctacagcggcggcgccgtcgtcgcgctctggctcaccaccgtcgtcgtcggcgccatcaactccgtgccgttgctccccaagctcctggagctggttgggctcgggtacactgggtggttcgtctaccgctacctcctcttcaaggaaagtaggaaagagctggccaccgacatcgagagcttgaagaaaaagatcgctggaacagaataaactcaagttctctggaacgttttcgatggctcttttgtctgtccatgtaatggaagaacacctacttgcttagagtaccatccactgcatgtgtgtgttacatatctgta

SEQ ID NO: 1561 - DNA, 545 bp, Setaria italica
cagagcgagaggccgaggaagcgatagctctagcgataaggcactgacagatcaatggctgccacggcgtactccgtggccctcctcggaggggcacgcctccccgccgccaccggcaacgccgccccccgctcctccgccctcctcccgcggcgcaacttccaccctctccgcctccaagatgcgcccaggccgtccctgctccgcgtgaaggccgcctccgacgacacgtcggctagcggcgacgagatcatcgaggacctcaaggggaagtgggaggcgattgaggacaagcccaccttcctcctctacagcggcggcgccgtcgtcgcgctctggctcaccaccgtcgtcgtcggcgccatcaactccgtgccgttgctccccaagctcctggagctggttgggctcggctacaccgggtggttcgtgtaccgctacctcctcttcaaggaaagcaggaaagagttggccaccgacatcgagagcttgaagaagaagatcgccggaacagaataaactcaagttctctggaacgttttcga

SEQ ID NO: 1562 - DNA, 775 bp, Triticum aestivum
ccagcgaaacgcagagcgagaggccgaggaagcgatagctctagcgataaggcactgacggatcaatggctgccacggcgtactccgtggccctcctcggtggggcgcgcctccccgccgccaccggcaacctcgccccccgctcctccgcactcctcccgcggcgcaacctccacccgctccgcctccaagatgcgcccaggccgtccctgctccgcgtgaaggccgcctccgacgacacgtcggctagcggcgacgagatcatcgaggacctgaaagggaagtgggaggcgattgaggacaagcccaccttcctcctctacagcggcggcgccgtcgtggctctctggctcaccaccgtcgtcgtcggcgccatcaactccgtgccgttgctccccaagctcctggagctggttgggctcggctacaccgggtggttcgtgtaccgctacctcctcttcaaggaaagcaggaaagagttggccaccgacatcgagagcttgaagaagaagatcgccggaacagaataaactcaagttctctggaacgttttttatggctcttttgtctgtccatgtaatggaagaacacctacttgcttagagtaccatccactgcatttgtgtgttacatacatatctgtatgaacaaagaaatatgctttggttggtgtgcggtgacaatagtgaaattgtatcagtttctggaagtcttctattgttttctatatcaatgtgttcatatgggaaacgtgatccgtcgaattgactttata

SEQ ID NO: 1563 - DNA, 775 bp, Triticum aestivum
ccagcgaaacgcagagcgagaggccgaggaagcgatagctctagcgataaggcactgacagatcaatggctgccacggcgtactccgtggccctcctcggaggggcacgcctccccgccgccaccggcaacgccgccccccgctcctccgccctcctcccgcggcgcaacttccaccctctccgcctccaagatgcgcccaggccgtccctgctccgcgtgaaggccgcctccgacgacacgtcggcgagcggcgacgagatcatcgaggacctcaaggggaagtgggaggcgattgaggacaagcccaccttcctcctctacagcggcggcgccgtcgtggctctctggctcaccaccgtcgtcgtcggcgccatcaactccgtgccgttgctccccaagctcctggagctggttgggctcggctacaccgggtggttcgtctaccgctacctcctcttcaaggaaagcaggaaagagttggccaccgacatcgagagcttgaagaagaagatcgccggaacagaataaactcaagttctctggaacgttttcgatggctcctttgtctgtccatgtaatggaagaacacctacttgcttagagtaccatccactgcatttgtgtgttacatacatatctgtatgaaaaaagaaatgcgctttggttggtgtgcggtgacaatagtgaaattgtatcagtttctggaagtcttctattgttttctatatcaatgtgttcatatgggaaacgtgatctgtcgaattgactttata

SEQ ID NO: 1564 - DNA, 800 bp, Pseudoroegneria spicata
gcgcacagcgagaggccgaggaagcgatagctctagcgataaggcactgacagatcaatggctgccacggcgtactccgtggccctcctcggcggggcgcgcctccccgccgccaccggcaacgccgccccccgctcctccgccctcctcccgcggcgcaacctccacccgctccgcctccaagatgcgccgaggccgtccctgctccgcgtgaaggccgcctccgacgacacgtcggcgagcggcgacgagatcatcgaggacctcaaagggaagtgggaggcgattgaggacaagcccaccttcctcctctacagcggcggcgccgtcgtggctctctggctcaccaccgtcgtcgtcggcgccatcaactccgtgccgttgctccccaagctcctggagctggttgggctcgggtacaccgggtggttcgtgtaccgctacctcctcttcaaggaaagtaggaaagagttggccaccgacatcgagagcttgaagaaaaagatcgccggaacagaataaatgcaagttctccggaacgttcttgatggctcttttttctgtcaatgtaatggaagaacacctacttgcttagagtaccatccactgcatttgtgtgttacatacatatctgtatgaaacaagaaatatgctttggttggtgtgcggtgacaatagtgaaattgtatcagtttctggaagtcttctattgtttctatatcaatgtgttcatatggaaaatgtgatcgtcgaattgactttatatgaataaaatgaaactcgtattgtattgtagagga

SEQ ID NO: 1565 - DNA, 982 bp, Oryza sativa
tttcgtttcgctagtagatagcgtgacagtgtgagatcgagctgaaaaaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaagtgggaggcgatcgaggacaagccgacgttcctcctctacagcggcggcgccgtcgtcgccctctggctcaccaccgtcgtcgtcggcgccatcaactccgtgccgctgctccccaagatcctggagctcgtcggcctcggctacaccggctggttcgtctaccgctacctcctcttcaaggagagcaggaaagagttggcgaccgacatcgagaccttgaagaagaagatcgctggaacggagtaattaagcagctgcatttgtccggggaagttttggggggtgactctctagagtgcttgctgctgcttcctctgtgtgatgtttgtatatctctacgagaatatgttctgctcccatgtgcagtaacagcgtagtgcaaaaactgtatcaaacctactatcagttgtttcttcgaaattcaaaacaatttcttcgctttcttgttgcgtggaagtgttcatataatctggcgtatgacaatgagaatatatatctcggagaatggttgatcgactcattagaaaagaattgcaaatgagttgatgataaacatctctgaaatgcatcccctcatggccattaacgatcctgctgatttatgaagaagcaattatcccgttta

SEQ ID NO: 1566 - DNA, 860 bp, Avena sativa
ccgcctacacaacaaccgttccagcttttgttgtcgccacgtagctcccacagaggaaatcagagcgagaggccgagaagggacacacagagctctagcgataaggcaatggctgccacggcgtactccgtggcgctcctcggcggagcacgcctcccggccgccaccggcgctccccgctccgcctccgcctccgcccttctcccccggcgcaacctccacccgctccgcctccaagatgcgccgaggccgtcgctgctccgcgtgaaggccgcctccgacgacacgtcggccagcggcgacgagatcatcgaggacctcaaggggaagtgggaggcgattgaggacaagcccaccttcctcctctacagcggcggcgccgtcgtcgcgctctggctcaccaccgttgtcgtcggcgccatcaactccgtgccgctgctccccaagctcctggagctcgtcggactcggctacaccggctggttcgtctaccgctacctcctcttcaaggagagtaggaaggagctggccaccgacatcgagggcttgaagaaaaagatcgctggaacagaataatcttactgagtcctctcgaacgttttggatggttctttggtgtatctccatgtaatggaacaacacctgcttgcttagagtacttactacccactgcctttatgtgttacaaatatatatctctatgcaagaaatgctttggtactgtgtgcggcggtgacaatagtttaaatccgttggttttgtatgccctgtatctgttgatatataaaattgttttgtgttcatgtgaaaaacatggttcagattaactttacggaggtatactaggaactctatattat

SEQ ID NO: 1567 - DNA, 725 bp, Triticum aestivum
ccagcgaaacgcagagcgagaggccgaggaagcgatagctctagcgataaggcactgacagatcaatggctgccacggcgtactccgtggccctcctcggaggggcacgcctccccgccgccaccggcaacgccgccccccgctcctccgccctcctcccgcggcgcaacttccaccctctccgcctccaagatgcgcccaggccgtccctgctccgcgtgaaggccgcctccgacgacacgtcggcgagcggcgacgagatcatcgaggacctcaaggggaagtgggaggcgattgaggacaagcccaccttcctcctctacagcggcggcgccgtcgtggctctctggctcaccaccgtcgtcgtcggcgccatcaactccgtgccgttgctccccaagctcctggagctggttgggctcggctacaccgggtggttcgtctaccgctactcctcttcaaggaaagcaggaaagagttggccaccgacatcgagagcttgaagaagaagatcgccggaacagaataaactcaagttctctggaacgttttttatggctcttttgtctgtccatgtaatggaagaacacctacttgcttagagtaccatccactgcatttgtgtgttacatacatatctgtatgaaaaaagaaatgcgctttggttggtgtgcggtgacaatagtgaaattgtatcagtttctggaagtcttctattgttttct

SEQ ID NO: 1568 - DNA, 747 bp, Triticum aestivum
cagagcgagaggccgaggaagcgatagctctagcgataaggcactgacagatcaatggctgccacggcgtactccgtggccctcctcggcggagcgcgcctccccgccgccaccggcaacgccgccccccgctcctccgccttcctcccgcggcgcaacctccacccgctccgcctccaagatgcgcccaggccgtccctgctccgcgtgaaggccgcctccgacgacacgtcggcgagcggcgacgagatcatcgaggacctcaaggggaagtgggaggcgattgaggacaagccgaccttcctcctctacagcggcggcgccgtcgtcgcgctctggctcaccaccgtcgtcgtcggcgccatcaactccgtgccgttgctccccaagctcctggagctggttgggctcggctacaccgggtggttcgtgtaccgctacctcctcttcaaggaaagcaggaaagagttggccaccgacatcgaaagcttgaagaagaagattgccggaacagaataaactcaagttctctggaacgttttcgatggctcttttgtctgtccatgtaatggaagaacacctacttgcttagagtaccatccactgcatttgtgcgttacatacatatctgtatgaaaaaagaaatgcgctttggttggtgtgcggtgacaatagtgaaattgtatcagtttctggaagtcttctattgttttctatatcaatgtgttcatatgggaaacgtgatcc

SEQ ID NO: 1569 - DNA, 592 bp, Festuca arundinacea
ggcacgagggcagagcgagaggccgagaagggattagaagacagctctagcgataaggcaatggctgccacggcgtactccgcggcgctcctcggcggagcacgcctcccggccaccaccggcgccccccgcttcagctcctccgcgcttctgccccggcgcaacctccacccgctccgcctccaagatgcgccgaggccgtcgcttctccgcgtgaaggccgcctccgacgacacgtcggcgagcggcgacgagatcatcgaggacctcaagggcaagtgggaggcgattgaggacaagcccaccttcctcctctacagcggcggcgccgtcgtcgccctctggctcaccaccgtcgtcgtcggcgcaatcaactccgtgccgctgctccccaagctcctggagctcgtcgggctcggctacaccggctggttcgtgtaccgctacctcctcttcaaggaaagcaggaaagagctggccactgacatcgagtccttgaagaagaagatcgctggaacagagtaataaacctgtcgagttctctggaacgttttgggtggttgtttcggtgtatccggccatgtaatggaag

SEQ ID NO: 1570 - DNA, 766 bp, Hordeum vulgare
gaagcgatagctctagcgataaggcactgacggatcaatggctgccacggcgtactccgtggccctcctcggcggggcgcgcctccccgccgccaccagcaacgccgccccacgctcctccgccctcctcccgcggcgcaacctccacccgctccgcctccaagatgcgccgaggccgtccctgctccgcgtgaaggcggcctccgacgacacgtcggcgagcggcgatgagatcatcgaggacctcaaggggaagtgggaggcgattgaggacaagcccaccttcctcctctacagcggcggcgctgtcgtcgcgctctggctcaccaccgtcgtcgtcggcgccatcaactccgtcccgttgctccccaagctcctggagctggttgggctcgggtacaccgggtggttcgtgtaccgctacctcctcttcaaggaaagcaggaaagagttggccaccgacatcgagagcttcaagaagaagatcgcaggaacagaataaactcggttctctggaacgtttcggatggctcttttgtctaattatgtaatggaagaagatctacttgctgcttagagtaccatccactgcatttgtgtgttacatatatgtatgtatgaaaagaaatgcgctttggatggtgtgaggtgacaatagtgaaattgtatcagtttttggaattcttctatttctttctatataaatgtgttcatatggaaaacttgatccgtcgaattgactttatatgaataaaatgaaactcgt

SEQ ID NO: 1571 - DNA, 822 bp, Hordeum vulgare
gttgttgttgggcgagacacagagcgagaggccgaggaagcgatagctctagcgataaggcactgacggatcaatggctgccacggcgtactccgtggccctcctcggcggggcgcgcctccccgccgccaccagcaacgccgccccacgctcctccgccctcctcccgcggcgcaacctccacccgctccgcctccaagatgcgccgaggccgtccctgctccgcgtgaaggcggcctccgacgacacgtcggcgagcggcgatgagatcatcgaggacctcaaggggaagtgggaggcgattgaggacaagcccaccttcctcctctacagcggcggcgctgtcgtcgcgctctggctcaccaccgtcgtcgtcggcgccatcaactccgtcccgttgctccccaagctcctggagctggttgggctcgggtacaccgggtggttcgtgtaccgctacctcctcttcaaggaaagcaggaaagagttggccaccgacatcgagagcttcaagaagaagatcgcaggaacagaataaactcggttctctggaacgtttcggatggctcttttgtctaattatgtaatggaagaagatctacttgctgcttagagtaccatccactgcatttgtgtgttacatatatgtatgtatgaaaagaaatgcgctttggatggtgtgaggtgacaatagtgaaattgtatcagtttttggaattcttctatttctttctatataaatgtgttcatatggaaaacttgatccgtcgaattgactttatatgaataaaatgaaactcgtattgtattgtaaaaaaaaaa

SEQ ID NO: 1572 - DNA, 933 bp, Lolium multiflorum
cagaagcagagcgagaggccgagaagggttcagaagacagctctagcgataaggcaatggctgccacggcgtactccgtggcgctcctcggcggagcacgcctcccggccaccaccggcgccacccgcttcacctcctccgcgctcctgccccggcgcaacctccagccgctccgcctccaagatgcgccgaggccgtcgctgctccgcgtgaaggccgcctccgacgacacgtcggcgagcggcgacgagatcatcgaggacctcaagggcaagtgggaggcgattgaggacaagcccaccttcctcctctacagcggcggcgccgtcgtcgcgctctggctcaccaccgtcgtcgtcggcgcaatcaactccgtgccgctgctccccaagctcctggagctcgtcgggctcggctacaccggctggttcgtctaccgctacctcctcttcaaggaaagcaggaaagagctggccaccgacatcgagtccttgaagaagaagatcgctggaacagagtaataaacctgtcgagttctctggaacgttttgggtggttgtttcggtgtatccggccatgtaatggaagaacacacctacttgcttagagtacttgcccactgcttttgtacgtgtgttacatatatatctgtatgcaagaaaagctctggtatcgtgtgtgcggagattaattggttttgtatgccttgtatttgttgccatgtaaacgtgctcatgtgaaaagctgtgatccatccgatcaactttacattagtactaggcagatattcaggcttcgccgcgccgactgtatggcgttgttgcaggtaagattcagaaaaaatagaaaacagatacatattgcggtgactgagaaatgtcaattatggcaaaattcataatgcagagttcgcttttttcttgaaaaaaaaaa

SEQ ID NO: 1573 - DNA, 913 bp, Lolium multiflorum
ggaaagcagagcgagaggccgagaagggttcagaagacagctctagcgataaggcaatggctgccacggcgtactccgtggcgctcctcggcggagcacgcctcccggccaccaccggcgccacccgcttcacctcctccgcgctcctgccccggcgcaacctccagccgctccgcctccaagatgcgccgaggccgtcgctgctccgcgtgaaggccgcctccgacgacacgtcggcgagcggcgacgagatcatcgaggacctcaagggcaagtgggaggcgattgaggacaagcccaccttcctcctctacagcggcggcgccgtcgtcgcgctctggctcaccaccgtcgtcgtcggcgcaatcaactccgtgccgctgctccccaagctcctggagctcgtcgggctcggctacaccggctggttcgtctaccgctacctcctcttcaaggaaagcaggaaagagctggccaccgacatcgagtccttgaagaagaagatcgctggaacagagtaataaacctgtcgagttctctggaacgttttgggtggttgtttcggtgtatccggccatgtaatggaagaacacacctacttgcttagagtacttgcccactgcttttgtacgtgtgttacatatatatctgtatgcaagaaaagctctggtatcgtgtgtgcggagattaattggttttgtatgccttgtatttgttgccatgtaaacgtgctcatgtgaaaagctgtgatccatccgatcaactttacattagtactaggcagatattcaggcttcgccgcgccgactgtatggcgttgttgcaggtaagattcagaaaaaatagaaaacagatacatattgcggtgactgagaaatgtcaattatggcaaaattcataatgcagagttcgc

SEQ ID NO: 1574 - DNA, 689 bp, Triticum aestivum
cagagcgagaggccgaggaagcgatagctctagcgataaggcactgacagatcaatggctgccacggcgtactccgtggccctcctcggcggagcgcgcctccccgccgccaccggcaacgccgccccccgctcctccgccttcctcccgcggcgcaacctccacccgctccgcctccaagatgcgcccaggccgtccctgctccgcgtgaaggccgcctccgacgacacgtcggcgagcggcgacgagatcatcgaggacctcaaggggaagtgggaggcgattgaggacaagccgaccttcctcctctacagcggcggcgccgtcgtcgcgctctggctcaccaccgtcgtcgtcggcgccatcaactccgtgccgttgctccccaagctcctggagctggttgggctcggctacaccgggtggttcgtgtaccgctacctcctcttcaaggaagcaggaaagagttggcaccgacatcgaaagcttgaagaagaagattgccggaacagaataaactcaagttctctggaacgttttcgatggctcttttgtctgtccatggaatggaaaaaacacctacttgcttagagtacaatccactgcatttggtgcgttacatacatatctgaatgaaaaaaaaaatgccctttggttggtgtgcggggacaatagggaaattgtatcag

SEQ ID NO: 1575 - DNA, 739 bp, Secale cereale
  misc_feature (174)..(174): n is a, c, g, or t
  misc_feature (671)..(671): n is a, c, g, or t
gaaacgcagagcgagaggccgaggaagcgatactctagcgataaggcactgacagacagatcaatggctgccacggcgtactccgtggccctcctcggcggggcgcgcctccccgccgccaccggcaacgccgccccccgctcctccgccctcctcccgcggcgcaacctccanccgctccgcctccaagatgcgccgaggccgtccctgctccgcgtgaaggccgcctccgacgacacgtcgcgagcggcgacgagatcatcgaggacctcaaggggaagtgggaggcgattgaggacaagcccaccttcctcctctacagcggcggcgcgtcgtggctctctggctcaccaccgtcgtcgtcggcgccatcaactccgtgccgttgctccccaagctcctggagctggttgggctgggctacaccgggtggttcgtgtaccgctacctcctcttcaaggaaagtaggaaagagctggccactgacatcgagagcttgaagaagaagatcgccggaacagaataaactcaagttctctttaacgttttcgatggctcttttgtctgtccatgtaatggaagaacacctacttgcttagagtaccatccactgcatttgtgtgttacatacatatctgtatgaaaaaaatgcgctttggttggtgtgcggngacaatagtgaaattgtaccagtttctggaagtcttctattgttttctatatcaatgtgttcatatgg

SEQ ID NO: 1576 - DNA, 859 bp, Zea mays
agaggcagaggcgcaggatacgcgggggaaaaaaaaggaggctcactgtacaccgagctcacgcagggcgtagcaaatcaggtaggcgaaatcggagcagaggccagggacgcgccagcgcgagcgataaggcacactgacatggccgccacggcgtactccaccgcgctccccggcggggcgcgcctccccgctgccggagccgccgcaccgccctctgccctcctcctcccgcggcgtaataaactgtctccgctccctctccggctccaagatgcgccgaggctgtcgttgctccgggtgaaggcctcctccgacgactcctcggccgcgagcggggacgagctcatcgccgacttgaaagccaagtgggacgccgtcgagaacaagagcactgtcctcacctacgccggcggcgctgtcgtcgctctctggctgacgtccgtcatcgtcggcgccatcaactccgtgcctctgctccccaagatcatggagcttgtcggcctcggctacaccggatggttcgtctaccgctaccttctcttcaaggaaagcaggaaagagctcgccgacgacatcgagtcgctcaagaaaaaaattgctgggacagagtaaaacatgttgttctcgtgaaactttttttggacgattctttcgggaacacgttgcctcttgtctagactccagatcagtgctacatgtctttgcacttttttttttgttgcataccttatgtcctcgtctctctggagagctttgtacgacgatggagaacaacagtgtacgatcgaactggacgccatcctcggggattgttttcttaaaatgaaatagggtatgtatccgggttttcttttca

SEQ ID NO: 1577 - DNA, 845 bp, Zea mays
aggatacgcgggggaaaaaaaaggaggctcactgtacaccgagctcacgcagggcgtagcaaatcaggtaggcgaaatcggagcagaggccagggacgcgccagcgcgagcgataaggcacactgacatggccgccacggcgtactccaccgcgctccccggcggggcgcgcctccccgctgccggagccgccgcaccgccctctgccctcctcctcccgcggcgtaataaactgtctccgctccctctccggctccaagatgcgccgaggctgtcgttgctccgggtgaaggcctcctccgacgactcctcggccgcgagcggggacgagctcatcgccgacttgaaagccaagtgggacgccgtcgagaacaagagcactgtcctcacctacgccggcggcgctgtcgtcgctctctggctgacgtccgtcatcgtcggcgccatcaactccgtgcctctgctccccaagatcatggagcttgtcggcctcggctacaccggatggttcgtctaccgctaccttctcttcaaggaaagcaggaaagagctcgccgacgacatcgagtcgctcaagaaaaaaattgctgggacagagtaaaacatgttgttctcgtgaaactttttttggacgattctttcgggaacacgttgcctcttgtctagactccagatcagtgctacatgtctttgcacttttttttttgttgcataccttatgtcctcgtctctctggagagctttgtacgacgatggagaacaacagtgtacgatcgaactggacgccatcctcggggattgttttcttaaaatgaaatagggtatgtatccgggttttcttttca

SEQ ID NO: 1578 - DNA, 1508 bp, Brachypodium distachyon
atggccgacgccgcgcccaccgtctccaagtcgccgccggcgctcgtccctccggtggggcccaccccacggggcgcgctcccgctctcctccatcgacaagaccgccgccgtccgcgtctcggtcgacttcatccaggtcttccccccgtccaccgacggggccagcgccggggaccaggtggccgcgatgcgcgacgggttcgcgagggcgctggtgccctactaccccgtcgccggccgcatcgccgagccgacaccgggcgacctcgtcgtggactgcacaggcgagggcgtctggttcgtggaggccgccgcgagctgctcgctcgccgatgtcaacggcctcgagaggccgctgctcattcccaagggggaactcatccctcgccctccgcccgaggagaagctcgaggacctcatcctcatggcccaggtcacgaaattcacctgcggtggattcgccgtggggatctgcttcagccacctggttttcgacgggcagggcgcggcgcagttcctcaaggcggcgggcgagcttgcccgtggcctcccagcgccgtcggtggctccggtgtgggaccgcgacgcgatcccggatccacccaagctgccgcgcggcccgccgccgtcgttcacggcgttcaacttcgtgacccaggtggtcgagatctcgccggagaacatcgcgcgcatcaaggaagacttcaaggccgcgactggtggggagacctgctccaccttcgacgcggtgacggccgtggtgttcaagtgccgcgctctggcggtggagctcccggacaccgccgaggtccgtctcggcttcgctgccagcacgcggcacctcctccagggcgtgctgccgtcggtggacggctactacggcaactgcgtgtaccctgtggggatcacccggagcagcaagaccatccgggaggcggcattgacggaggtggtcggtgtgatgcgggaggccaaggaggcgctcaccgtgcggttcaccgactggatgcgcggcggcgctaaggacgaccactacaatgtgcctttggactacggcaccgtgactgtgtcggactggagccgcgttgggttcaacgaggtggactacggctttggtgagcctgggtacgtcttcacgctcaacgacgatgtcaacatcgttgcgtcagtgatctacctcaagccgccgacgcccaagcgcgggatccggctcatgctccgctgcgtggaggagccacacgctgccgtgttcgccgacgagatcgccaagtacgcctagctagactgttcttggcaattggccatgtctatgctcatgtgtgtaaccgctcttgcagtatctattcacacttcacattggtgtgtgcaatgttttcatttgggttacagtttggtgcttgtgcagctacagaaacactacaatttgtaatgtgttgatttcttttcaatgtggataattttagacttgcagcaacaagattgaaataatatccagattccagatta

SEQ ID NO: 1579 - DNA, 1747 bp, Sorghum bicolor
atcagcatcgccggccgaacccggcgacttccaaactccaatccagcgttaagctcgtgccaaacgaactcaagcgaggccgcagccggcaacaacctccgcactacttactgctggtgagcaccgcaagcaccaactccgcttcttgctactacttctacttgcacccaccgctccgctccaccagccgacgccgtcatgtctgccgccgccgccgcccccaccgtcctgaaatcggctccggagctcgtcgcgccagcggagccaacgcccggcggcaccctcccactgtcctccatcgacaagaccgcggcggtccgcgtctcggtggacttcatccaggttttccccccggccgcaggagccggcggggaccaagacgccgccgtggccgcgatgcgcgacggcttcgcgaaagcgctggtgccgtactacccggtggccggccgcatcgcagacgcgagccccggggagcccgtcgtggactgcaccgggcagggcgtctggttcgtggaggccgccgcgagctgcgcgctcgccgacgtcaactacctcgagcgccctctgctcatccccaaggaggagctcctcccgcgccctccccccgaggagaagctcgaggacctcgtcctcatggctcaggtgaccaagttcacctgcggcgggttctcggtcgggatctgcttcagccacctggtgttcgacgggcagggcgcggcgcagttcctcaaggcggctggcgagatggcgcgggggctgccggcgccgtcggtcgcgccggtctgggaccgcgacgcgatcccggaccgccctaagctgccgcgcgggccccgacgtcgttcacggcgctcaactccctgacccaggtggtggagatctcgccggagagcatcgcgcgcatcaaggacgagttcaaggacgcgacggggcaggcctgctccaccttcgacgccgtcacggcggtggtgttcaggtgccgcgcgctggcgatggcgctccccgacgacgccgaggtccggctcggcttcgccgccagcacgcggcacctcctccacggcgtgctgccgtcggtggacggctactacggcaactgcgtgtaccccgtgggcatcacccggtccagcaaggccatccgtgaggcgtcgcttccggaggtggtcggcgtgatgcgggaggccaaggaggcgctcaccacgcgcttcacggactggatgcgcggcggcgccaaggacgaccactacaacgtgccgctggactacggcacggtgacggtgtcggactggagccgcgtcgggttcaacgaggtggactacggcttcggcgagccggggtacgtcttcacgctcaacgacgacgtcaacatcgtcgcgtcggcgatctacctcaaaccgcccgcgcccaagcgcggcatccggctcatgctccgctgcgtcgaggaacctcacgctgcggcgttcgccgacgagctcgccaagttcgcgtagatcatggttgttattgggctattggcttagctatggccatgtgtgtgtgtgtgtgtggcttatctatacttcactggtgtcatacgttcatcgtcaacggcattgttggatgcaaacggcggtacttgcatcgtgccggcgaacttgcttgctaagagaatctccaacggattaccaatatcccatctcttagaagtacatacaagtgatcgtattaacttgtactttccccattctaaattataaattattgagtaaattgc

SEQ ID NO: 1580 - DNA, 1871 bp, Zea mays
cgattgatcagcagtaggacgaagcttcttgggcgaccaatctctgaactaacctataaagaaacaggcgtgaccaaaaaaagcatttagcttgagcagggtgccacatttgtgagctgcaaagttcagaaacaaccgatcatgccatgtgagccacaaagccaccaccatcaccaaccaaacccacttgccttgtgtttcagatcagattcgcctaacagaccccgacgacttccaaactccaatccagcgttgagctcgacagctcgtgccaaactaggccgcagctggaaataccctccgctccacttacctgctgctggtgagcaccgcaagcaccaactcgcgcccaccgctccgctacaccagccgacgccatcatgtctaccgtcgccgccgcccccaccgtcgtgaaatcggctccggagctcgtcgcgccagtggggccaacacccggcggcaccctcccactgtcctccatcgacaagaccgcggcggtgcgcgtgtcggtggatttcatccaggtttttcccccggccgtaggagcaggcggggacaaagacgccgccgtggccgcgatgcgcgacggcttcgcgaaggcgctggtgccgtactacccggtggccggccgcatcgcggacgccagccccggggagcccgtggtggagtgcaccgggcagggcgtctggttcgtggaggccgctgcgagctgcgcgctcgccgacgtcaactacctcgagcgccctctgctcatccccaaggaggagctcctcccgcgacctccccccgaggagaagctcgaggacctcgtcctcatggcacaggtgaccaagttcgcctgcggcgggttcgcggtcgggatctgcttcagccacctggtgttcgacgggcagggcgcggcgcagttcctcaaggcggccggcgagatggcgcgggggctgccggcgccgtcggttgcgccggtctgggaccgcgacgcgatcccggacccgcctaagctgccgcgcggccccccgccgtcgttcacggcgttcagcttcgtgacccaggtggtcgagatctcgccggagagcatcgcgcgcatcaaggacgacttcaaggacgcgacggggcagacctgctccaccttcgacgctgtcacggcggtggtgttcaagtgccgcgcgctggcgatggcgctccccgacgacgccgaggtccggctcggcttcgccgccagcacgcggcacctcctccacggcgtgctgccgtcggtggacggctactacggcaattgcgtgtaccccgtgggcatcacccggaccagcaaggcgatccgtgaggcgtcgcttccggaggtggtcggcgtgatgcgggaggccaaggaggcgctcaccacgcggttcacggactggatgcgcggcggcgccaaggacgaccactacaacgtgccgctggactacggcacggtgacggtgtcggactggagccgcgtcgggttcaacgaggtggactacggcttcggcgaaccggggtacgtcttcacgctcaacgacgacgtcaacatcgtcgcgtcggtgatctacctcaaaccgcccgcgcccaagcgcggcatccggctcatgcttcgctgcgtcgaggaacctcatgctgcggcgttcgccgaggagctcgccaaattcgcgtagatggttgtttagtcttgctttatctatacttcattggtgtcggacactcggacctcatcttttacaatattatctatacttcattggtgtcagacgctcattaattgtcatcggcattgttggatgtgggagaatgaaaaagctattacaagaacatttctggtatgcctaaaagtacacatattaaatcatgaccatttatct

SEQ ID NO: 1581 - DNA, 1827 bp, Zea mays
cgattgatcagcagtaggacgaagcttcttgggcgaccaatctctgaactaacctataaagaaacaggcgtgaccaaaaaaagcatttagcttgagcagggtgccacatttgtgagctgcaaagttcagaaacaaccgatcatgccatgtgagccacaaagccaccaccatcaccaaccaaacccacttgccttgtgtttcagatcagattcgcctaacagaccccgacgacttccaaactccaatccagcgttgagctcgacagctcgtgccaaactaggccgcagctggaaataccctccgctccacttacctgctgctggtgagcaccgcaagcaccaactcgcgcccaccgctccgctacaccagccgacgccatcatgtctaccgtcgccgccgcccccaccgtcgtgaaatcggctccggagctcgtcgcgccagtggggccaacacccggcggcaccctcccactgtcctccatcgacaagaccgcggcggtgcgcgtgtcggtggatttcatccaggtttttcccccggccgtaggagcaggcggggacaaagacgccgccgtggccgcgatgcgcgacggcttcgcgaaggcgctggtgccgtactacccggtggccggccgcatcgcggacgccagccccggggagcccgtggtggagtgcaccgggcagggcgtctggttcgtggaggccgctgcgagctgcgcgctcgccgacgtcaactacctcgagcgccctctgctcatccccaaggaggagctcctcccgcgacctccccccgaggagaagctcgaggacctcgtcctcatggcacaggtgaccaagttcgcctgcggcgggttcgcggtcgggatctgcttcagccacctggtgttcgacgggcagggcgcggcgcagttcctcaaggcggccggcgagatggcgcgggggctgccggcgccgtcggttgcgccggtctgggaccgcgacgcgatcccggacccgcctaagctgccgcgcggccccccgccgtcgttcacggcgttcagcttcgtgacccaggtggtcgagatctcgccggagagcatcgcgcgcatcaaggacgacttcaaggacgcgacggggcagacctgctccaccttcgacgctgtcacggcggtggtgttcaagtgccgcgcgctggcgatggcgctccccgacgacgccgaggtccggctcggcttcgccgccagcacgcggcacctcctccacggcgtgctgccgtcggtggacggctactacggcaattgcgtgtaccccgtgggcatcacccggaccagcaaggcgatccgtgaggcgtcgcttccggaggtggtcggcgtgatgcgggaggccaaggaggcgctcaccacgcggttcacggactggatgcgcggcggcgccaaggacgaccactacaacgtgccgctggactacggcacggtgacggtgtcggactggagccgcgtcgggttcaacgaggtggactacggcttcggcgaaccggggtacgtcttcacgctcaacgacgacgtcaacatcgtcgcgtcggtgatctacctcaaaccgcccgcgcccaagcgcggcatccggctcatgcttcgctgcgtcgaggaacctcatgctgcggcgttcgccgaggagctcgccaaattcgcgtagatggttgtttagtcttgctttatctatacttcattggtgtcggacactcggacctcatcttttacaatattatctatacttcattggtgtcagacgctcattaattgtcatcggcattgttggatgtgggagaatgaaaaagctattataaggaggtgta

SEQ ID NO: 1582 - DNA, 1522 bp, Saccharum officinarum
cgaggccgcagccggcaactacctccgcaccacttactgctggtgagcaccgaaagcaccaactccacttgttgctgcaactcgagcccaccgctccgctccaccagccgacgccgtcatgtctgccgccgcccacccggtgaaatcggctccggagctcgtcgcgccagcggggccaacacccggaggcaccctcccactgtcctccatcgacaagaccgcggcggtccgcgtgtcggtggatttcatccaggttttccccccggccgcagcagccggcggggaccaagacgccgcgttggccgcgatgcgcgacggcttcgcgagggcgctggtgccgtactacccggtggccggccgcatcgcggacgcgagccccggggagcccgtcgtgaactgcaccgggcagggcatctggttcgtggaggccgccgcgagctgcgcgctcaccgacgtgaactacctcgagcgccctctgctcatccccaaggaggagctcctcccgcgccctccccccgaggagaagctcgaggacctcgtcctcatggcacaggtgaccaagttcacctgcggcgggttcgcggtcgggatctgcttcagccacctggtgttcgacgggcagggcgcggcgcagttcctcaaggcggctggcgagatggcgcgggggctgccggcgccgtcgatcgcgccggtctgggaccgcgacgcgatcccggacccgcctaagctgccgcgcggccccccgccgtcgttcacggcgttcagcttcgtgacccaggtggtcgagatctcgccggagagcatcgcgcgcatcaaggacgagttcaagggcgcgacggggcagacctgctccaccttcgacgccgtcacggcggtggtgttcaagtgccgcgcgctggcgatggcgctcccggacgatgccgaggtccggctcggcttcgccgccagcacgcggcacctcctccacggcgtgctgccgtcggtggacggctactacggcaactgcgtgtaccccgtgggcatcacccggaccagcaaggcgatccgtgaggcgtcgcttccggaggtggtcggcgtgatgcgggaggccaaggaggcgctcaccgcgcgcttcacggactggatgcgcggcggcgccaaggacgaccactacaacgtgccgctggactacggcacggtgacggtgtcggactggagccgcgtcgggttcaacgaggtggactacggcttcggcgaaccggggtacgtcttcacgctcaacgacgacgtcaacatcgtcgcgtcggtgatctacctcaaaccgcccgcgcccaagcgcggcatccggctcatgctccgctgcgttgaggaacctcacgctgcggcgttcgccgacgagctcgccaagttcgcgtagatcatggttgttattgggctattggcttagctatggccatgtgtgtggtacctcatcttttataaaaagatttatacttcactggtgtcagacgttcactgtcaacgacattggcccggttaatct

SEQ ID NO: 1583 - DNA, 1583 bp, Avena sativa
gcgagccaaagcggcaaatcaaccaaccccgcgccctcccatttccccaccaacccaccagaccatggccgccgcagccgcgcccgccgtcgtcaagtcgccgccggcgctcgtccctcccgctgggcccaccccgggcggcgtgctcccgctctcctcaattgacaagaccgccgctgtccgcgtctcggtcgacttcatccaggtcttccccccgtcttcttccgatggggcagccggggaccaggtggccgcgatgcgcgacgggttcgcgagggcgctagtgccctactaccctgtcgccggccgcatcgcggagccgtccccgggggacctcgtggtggactgtaccggcgacggcgtctggttcgttgaggccgctgcgagctgctcgctcgccgttgtcaacggcctcgagcgcccgctgctcatccccaaggcggagctaatcccccgccctccccccgaagagaagctcgaggacctcatcctcatggcccaggtcacgaaattcacctgcggtggattcgctgtcgggatctgcttcagccacctggtgttcgatgggcagggcgcggcgcagttccttaaggccgcgggcgagctggcccgggggctcccggcgccgtcggtggctccggtgtgggaccgcgaagcgatcccggacccgcccaagctgccacgcggaccgccaccgtcgttcacggccttcaacttcgtgacccaggtcgtcgagatctcgccggagaacatcgcgcgcatcaaggacgagttcaaggccgccaccgggggccagacctgctccactttcgacgcggtgacggccgtggtgttcaagtgccgtgcactggcggtggagctccctgatgacgctgaagtccggctcggtttcgctgccagcacgcggcacctccttcagggcgtgctaccgtcagtggacggctactatggtaactgtgtgtacccggtggggatcacccggagcagcaagactatccgggaggcggcactgccggaggtggtcagcgtgatgcgggaggcgaaggtggcgctcactgtgcgcttcacggactggatgcatggcggcgccgccgaccactacaatgtaccgctggactacggcactgtgacggtgtcagactggagccgggtcgggttcaacgaggtggactacggcttcggtgagcctgggtacgtgttcacactcaacgatgacgtcaacatcgtcgcatctgtgatctacctcaaacccccgacgcccaagcgaggaatccgcctcatgctccgctgtgtggaggaaccacatgctgctgtattcgccgacgagcttgccaagtatgcttaagctggatggttcttctcaaccatggcctcatgtacatgtatatgctcatgcatgtaacaccctctcactgtactttttcttcacattgttgtgtgcaatgttttcatataggtcaccttctggtgctttgtgcttatataagcactgcagtagtgttttatcatgtcttgatttcttttcaatgtgcaaaattttagactcccagtcacaagaatgaataaagtccagattatggtat

SEQ ID NO: 1584 - DNA, 1619 bp, Triticum aestivum
gcacgaggcaaacaccgacggcaacaacctcaacctcctccattcatcattcctagtggggaagcgccaaagcaagcaaccagcgcgctcccattttgatttcccccaccaacccacgagaccatggccgcgcccaccgtcgccaagtcgccgccggagctcgtccctccggcggggcccaccccgggcggcgtgctcccgctctcctctatcgacaagaccgccgccgtccgcgtctcggtcgacttcatccaggtcttccccccgtcctccgaccggggcggcgacgaccaggtggcctcgatgcgccaagggttcgcgagggcgctggtgccctactatccggtagccggtcgcatcgcggagccctccccgggcgacctcgtggtggactgtaccggcgagggcgtctggttcgtggaggccacggcgagctgctcgctcgccgacgtcaacggcctcgagcgcccgctgctcatccccaaggcggagcttatcccccgccctccccccgaggagaagctcgaggacctcatcctcatggcgcaggtcacgaaattcacctgcggtggattcgccgtggggatctgcttcagccacctggtgttcgacgggcagggcgccgcgcagttcctgcaagcggcaggcgagctggcccgggggttcccggcgccatcagtggctcccgtgtgggaccgcgaaacgatcccggacccacccaagctgccgcgcggtccgccgccgtccttcacggcgttcagcttcgtgacacaggtggtcgagatctccccggagagcatcctgcgaatcaaggacgagttcaaggccgccacgggggagacctgctccaccttcgacgcggtgacggccgtggtcttcaagtgccgtgcgctggcggtggagctccccgacgccgctgaagtccgccttggcttcgccgccagcacgcgtcacctccttcagggcgtcctgccgtcagtggatggctactatggcaactgcgtgtacccggtcgggatcacccggagcagcaagaccatccgggaggcggcgctgcccgaagtggtcggcgtgatgcgagaggccaaggaggcgcttaaggtgaggttcacggactggatgcacggcggcgccaaggacgaccactacaatgtgccgctggattacggcaccgtgacggtgtcggactggagccgcgttggcttcaacgaggtggactacggcttcggcgagcctggatacgtgttcacgctcaacgacgacgtcaacatcgttgcgtcggtgatctacctcaagcccccggcgcccaagcgcgggatccggctcatgctccgctgcgtggaggagccacacgccgctgtgttcgccgacgagcttgccaagtacgcttagctggatgctgcttcttggccatggccgagtacatgttctcatacctgtaacaccttctcactgtactttttcttcacattggtgtgtgcaatgttttcatttaggtcacattctggtgctttgtgcaggtataaaccacactagtatctctgccatgtgttgatttcttttcaatgtggaacaattgtaagctgtcagccacaagaatgaataaaattcagtttatg

SEQ ID NO: 1585 - DNA, 452 bp, Saccharum officinarum
gtaagtagcagcacaacaacaatggcttccctgaaggcctcgaagcccgccggagttgcggcacagggcaaggagccggcacccaagctcagcgagacggcgacgaagccgtcggccgccaagagcggcggcgtcaagaaggctgagcagaagccccgggaaaccaaaaagaaggtgaagagcagcaaaccggcggcagccaaaaagtgacagcgtgagatgtagtggtggagcttcttgcttgagtgtcgccatgctatgttatgaattatgaacccagtccttcctttcttgtatcttccatgtgacggtgtgtgcgtccctcatgtgatgaccgatgaatactacaaataagacgttgtaattgtgttatcgccttcttcatcctttgccacttgatgttatattaatgatggtcattttaccagcataaaaaaaaaaaaaaaaaactc

SEQ ID NO: 1586 - DNA, 457 bp, Saccharum officinarum
  misc_feature (70)..(70): n is a, c, g, or t
  misc_feature (360)..(360): n is a, c, g, or t
ttaagcctcaagcagtgttagttgcgacagagtaagtagcagcacaacaacaatggcttccctgaaggcntcgaagcccgccggagttgcggcacagggcaaggagccggcacccaagctcagcgagacggcgacgaagccgtcggccgccaagagcggcggcgtcaagaaggctgagcagaagccccgggaaaccaaaaagaaggtgaagagcagcaaaccggcggcagccaaaaagtgacagcgtgagatgtagtggtggagcttcttgcatgagtgtcgccatgctatgttatgaatccagtccttcctttcttgtattttccatgtgacggtgtgtgcgtccctcatgtgatgacngatgaatactacaaataagacgttgtaattgtgtggtcatcgccttcatccttttttgccgcttcatgttaaagtaatgatagtcattattttcagc

SEQ ID NO: 1587 - DNA, 433 bp, Sorghum bicolor
atcaggtccaaagtgacattaagcttcaagcagtgttagttgcaacagagctactagtaagtagcacacaacaacgacaatggcttccctgaaggcctcgaagcccgccggagttgcagcgcagggcaaggagccggcacccaagctcagcgagacggcgacgaagccgtccgccgccaagagcggcggcgtcaagaaggctgagcagaagccccgggaaaccaaaaagaaggtgaagagcagcaaaccggcggcagccaaaaagtgacagtgtgagatgtagtggagcttcttcgcatgagtgtcttcatgctatgttattatgaattataaatccagtccttcctttcttgtgtcttccatgtgacggtgtgtgcgtccctatgtgtgatgactgatgaattaatactacaaataagacgttgtaattgtg

SEQ ID NO: 1588 - DNA, 530 bp, Saccharum officinarum
gtgagattaagcctcaagcagtgttagttgcgacagagtaagtagcagcacaacaacaatggcttccctgaaggcctcgaagcccgccggagttgcggcacagggcaaggagccggcacccaagctcagcgagacggcgacgaagccgtcggccgccaagagcggcggcgtcaagaaggctgagcagaagccccgggaaaccaaaaagaaggtgaagagcagcaaaccggcggcagccaaaaagtgacagtgtgagatgtagtggagctcattgcatgagtgtctccatgctatgctatgaatccagtccttcctttcttgtattttccatgtgacggtgtgtgcgtccctcatgtgatgacggatgaattaatactacaaataagacgttgtaattgtgtggtcatcgccttcatccttttttgccgcttcatgttaaagtaatgatagtcattattttcagcataactacttgctctagcatattgttttacacgattcagaatatcacgtgcctacgccttgttgag

SEQ ID NO: 1589 - DNA, 510 bp, Saccharum officinarum
gtaagtagcagcacaacaacaatggcttccctgaaggcctcgaagcccgccggagttgcggcacagggcaaggagccggcacccaagctcagcgagacggcgacgaagccgtcggccgccaagagcggcggcgtcaagaaggctgagcagaagccccgggaaaccaaaaagaaggtgaagagcagcaaaccggcggcagccaaaaagtgacagtgtgagatgtagtggagctcattgcatgagtgtctccatgctatgctatgaatccagtccttcctttcttgtattttccatgtgacggtgtgtgcgtccctcatgtgatgacggatgaattaatactacaaataagacgttgtaattgtgtggtcatcgccttcatccttttttgccgcttcatgttaaagtaatgatagtcattattttcagcataactacttgctctagcatattgttttacacgattcagaatatcacgtgcctacgccttgttgagcggacgcgtgggtcgac

SEQ ID NO: 1590 - DNA, 536 bp, Panicum virgatum
gatcaggtccagagcatcgacttgagcttccttcaagcagcgttacagcgcagagcagtagcacaagagcgatggcatccatgaaggccgtgaaggtcgccggagctgcagcgcaggccaaggagccggcgcccaagctcagcgagacggcgacgaagccgtcagccgccaagagcggcgtcaagaaggccgagcagaagccccgggagccgaagaagaaggtgaagagcagcaagccggcggcagccaaaaagtgacaatggaagctaagagaagtacaggagcttgcgcgagggggcctccatcatgctattacaaattcagtctttaccttcttctgtcttaatgatgtcatgaacttatgtccttagttggacgggtcgtgatggcgttcgcaccctaccctgatcaatactacaaataaaactattgtaactctggcatcgtgttcatcttttcatcacgattcacgattaatgttccggtggctccttccacttgtgaatcttttcttttgtttgaattccgataaacac

SEQ ID NO: 1591 - DNA, 472 bp, Panicum virgatum
gatcatgtccagggcatcaagttcgagctcccttcaagcagcggcgttacagcagagcggtagcaccagagcgatggcatccacgaaggccgtgaaggtcgctggagcagcagcgcaggccaaggagccggcgcccaagctcagcgagacggcgacgaagccgtcggccgccaagagcggcgtcaagaaggccgagcagaagccccgggagccgaagaagaaggtgaagagcagcaagccagcggcagccaaaaagtgacaatgagagaagtgaagcttgcgcgagggggcctccatcatgctatgatatcaattattacaaacccagtctttgccttcttctgtctaatgatgtcatcaacttgtgtccttagttggacggggtcttgatggcgtgtgcaccctaccctgatcaatactactacaaataaaactattgtaactatggaatcgtagtgttcatcttttcatc

SEQ ID NO: 1592 - DNA, 419 bp, Zostera marina
tcttgagcttccttcaagcagcgttacagcgcagagcagtatcacaagagcgatggcatccatgaaggccgtgaaggtcgccggagctgcagcgcaggccaaggagccggcgcccaagctcagcgagacggcgacgaagccgtcagccgccaagagcggcgtcaagaaggccgagcagaagcccggagccgaagaagaaggtgaagagcagcaagccggcggcagccaaaaagtgacaatggaagctaagagaagtacaggagcttgcgcgagggggcctccgatcatgctattacaaattcagtctttactcttctgtcttaatgatgtcatgaacttatgtccttagttggacgggtcgtgatggcgttcgcaccctaccctgatcaatactacaaataaaactattagtaactctg

SEQ ID NO: 1593 - DNA, 422 bp, Eragrostis curvula
ggggaggaagtcccaagcaggttaagcatcaagcagtgttagaacagagtagcaccaatactatggcctccctgaaggccgtgaagcccgccggacaagcagggcaggccaaggagccagcaccccaactcagtagacggcgacaaagccgtctgctgcaaagggtggcgtcaagaaagttgagcagaagccccgggagccaaagaagaaggctaagagcagcaagccagcagcagcaaagaagtgacgattcaagcaagataaatggggtctccatgttatgcatacttgtccagtctttcccatcttttgtcttccattccatgtgatgtcatgaactcatgatcgtgcctgtaaccatcatcggacaggtttcgacgatgtgtgcatcctcctgtgatttatactaaaaataagatgct

SEQ ID NO: 1594 - DNA, 476 bp, Panicum virgatum
atgtccagggcatcaagttcgagctcccttcaagcagcggcgttacagcagagcggtagcaccagagcgatggcatccacgaaggctgcgaaggtcgccggagcagcagcgcaggccaaggagccggcgcccaagctcagcgagacggtgacgaagccgtcggccgccaagagcggcgtcaagaaggccgagcagaagccccgggagccaaagaagaaggtgaagagcagcaagccggcggcggccaaaaagtgacaatggaagctagaaatggagcttgcgcgagggggcctccatcgtgctatgatatcaattattacaaacccagtctttgccttcttgtgtctaatgatgtcatcaacttgtgtccttagttggacggggtcttgatggcgtgtgcaccctaccctgatcaatactactacaaataaaactattgtaactatggcatcgtagtgttcatcttttcatcacga

SEQ ID NO: 1595 - DNA, 452 bp, Pennisetum glaucum
gaggatcaaagcatcaagcttagctttgttcaagcggtagtgtcagatcgagctgagtggtagcacagcagcgatcgatggcgtccgtgaaggccgtgaagatcaccggagctgcagccaaggagccggcacccaagctcagcgagacggcgacgaagccgtcagccgccaagaacggcgtcaagaagaaggccgagcagaagccccgggaaccaagaagaaggtgaagagcagcaagccggcggcatccaaaaagtgacagtggaagcgaagagacatggagcttgagcgagggtcgatctccgtgctatgttattgctacgaatccagtcctttcccttttccacctttcataatgtcttgacttgtgcccttagtcggacaggtctttgactgtgtgtgcacgccctcatgtgatgaatcaaaataggctgctgtgctgtcgcattcat

SEQ ID NO: 1596 - DNA, 1770 bp, Brachypodium distachyon
ggaaataaaaaatcgagtctttaatcctctccgataggccacaaagcccattcctttctccccttgccgcaatccacacagcctcgcccctccgcccgcgcccctgcccccgcctgcggctccggctccggcttccgatggggtacgtgctgtcggcggtggcgagggtgctccagcagcccacggcgtggggcgccgcctgcgagatggcgctcctcgcggggccgctctgggcggcggccctcgtcgggctcctcctcggctgggcctggcgcccgcgctgggcggccggcatcgtcgccaccgccgacccgccgcaattcgccacggccgaattctggaggggccagctccccgcccgcctccgcgcgcctctcgactacttcgccggtggcaccgccgccaccgccgcggcgcagcaggaggaggaagagacctccctgcaagggtcatcggagatggcgaacgaggagctggcggtggggaaggatgacctggtgaagctctggaggctggtggaaggcaacgacggtggcccatcgtggatcaagatgatggagaaggcgctgcctgacatgacctaccaggcatggaggagggatccccagaatggtcctccgcaataccagagcagcacaatctttgagaatgcaaccccggaagaagttagggacttctttggggacgatgagttccggatgtctaacaagtgggatgatatgcttatctctcacaaaacattggaggagtgtcagacaactgggatgatgaaagtgcattgggttcgcaagttccccttcttctgtagcgacagggagtacatcattgcccgtcggatatggaaacttggaagcgcatactactgtgttacaaagggtgtgcaatgttcatccatcccacggcgcagcaaacctcgtagagtggatctgtattactcaagctggtgcatccgtgccgtggagtcaagacgagggaacggtggatcaacggcctgtgagattctcttattccaccatgaggacatgggcatcccatatgaaattgcaaagattggcattcggcagggtatgtggggatgcgtaaagagaattgaacctggacttcgtgcctatcaggaagcaagggctgctggggagccaccatcaccgagtgcattgatggcacggatcaataccaaggttggcgacaattttgttcgggcattggaatccaacagcaaccaatcagatatcgtggaagcagaagagaaacctgtgaagaaccgcgtagcgagattccttgtgctcggcggggctgtggctttggcttgtactcttgaccaaggactcttgactaaggctctaatctttggcgttgcacggaaatttgtgggacagaggaatgcactgtagtttctgatctttctcagtcctctgatccaatttgcatggagaaaagagatgatctggctaactgtagcacatgcctttgagggcagatgaaggagattggtgtatatatgctgccggcagctgatgagaggagaggcgatggagtaaaacgatgtactttacatttggaaaaggaattccagctatatatgaatttagtctttgcttcgtgtaatcttctatgcgaactggttctgataattccatgtaaatcagaatataaatattttttgttctttgaggtgctcggagactgcttaaaagtctggagcaactatgcccaaccttcctctgtttcaaaatgcatgacattttattatggacacaatattttagatgc

SEQ ID NO: 1597 - DNA, 1643 bp, Pseudoroegneria spicata
cgcaaagcccccccattcctttctccccttgccgcaatcctcacctccgcccccgtcccccgcctccggctccggctgcggcgccgatggggtacgtgctgtcggcggtggcgagggtgctggagcagccgacggcgtggggcgcggcctgcgagatggcgctgctcgcggggccgctctgggcggcggccctcgtcggcctcctgctcggctgggcctggcgcccgcgctgggccgccggcatcgtcgcccccgccgacccgccgcaggtcgccacgctcgacttctggagggcccagctccccacccgcatccgcgcccctctcgactacctcgccggcgcgcggcagcagcagcagcggcaggagcaggaggacgacgagacttccctgcaagggtcgtcggagatggcgaacgaggagctggcggtggggaaggctgaccttgtgaacctctggaggctggtggagggcaacgacggcggcccggcctggatcaacatgatggagaaggcgctgcccaacatgacctaccaggcctggcggagggatccccagaatgggcctccgcagtaccagagcagcacaatctttgagaatgcaaccccggatgaagtaagagacttttttggagatgatgagttccggatgtccaacaagtgggatgatatgctcatctctcaccagacgctggaggagtgtcagacaaccgggacgatgaaagtgcattgggttcgcaagttccccttcttctgtagtgacagggagtacatcattgctcgccggatatggaaactgggaagcgcgtactattgtgttacaaagggtgtgccatgttcatccatcccgcggcgcagcaaacctcgcagagtagatttgtattactcaagctggtgcatccgtgcagtggagtcaagacgagggaacggtggatcgaccgcctgtgagatcctcttgttccaccatgaggatatgggcataccatatgagattgcaaagattggcattcggcagggcatgtggggatgtgtgaagagaatcgaacctggattccgggcctatcagaaagccagggctgctggggagccaccttcgccgagcgccttgatggcacggatcaacaccaaggtcggtgacaattttgtccgaggactggagtccaacagtgaccaatcagacatcatggaagctgaagagaaacctgtgaaaaaccgcatggcgaggttccttgtgctcggcggggccgtggccttagcgtgtactctcgaccaagggctcctgacaaaggctctcatcttcggcgtggcacggaggtttgtggggcagaggaatacattgtaggatctgacatcttcctcacaatcctctgagccaatttgcgtggagagaacggagatgatctggctaactgtagcacatgccgttgacggcagatgaaggacattggtgtatatatgctgccggcggtcgatgggagagggagaggcaacggagtaaaaagatgtaatttacatttggaaaagggattccagctatatatgaattttatctttgtttcatgctatgtgaactgaattatgaggaaacgtaaatgaggatgtaattactcttttgttctttatgaagtatgtagttttcgaatca

SEQ ID NO: 1598 - DNA, 1726 bp, Hordeum vulgare
cccccccatttccttctctcccctcgccgcaatcctcacccccgccccggccccggcccccgcccccggctgcggcgccgatggggtacgtgctgtcagcggtggcgagggtgctggagcagccgacggcgtggggcgcggcctgcgagatggcgctgctcgccgggccgctctgggcggccgccctcgtcggcctcctgctcggctgggcctggcgcccgcgctgggccgccggcatcgtcgcccccgccgacccgccgcagctcgcctcgctcgacttctggcgggcccagctccccgcccgcatccgcgcccccctcgactacctcgccggcgcgcggcagcagcaggaggacgacgacgaggcctccctgcacgggtcgtcggagatggggaaggaggagctggcggtggggaaggacgacctggtgaacctctggaggctggtggagggcaacgacggcggcccggcgtggatcaagatgatggagaaggcgctgcccaacatgacctaccaggcctggaggagggatccccagaatgggcctccgcaataccagagcagcacaatctttgagaacgcaaccccggatgaagtaagggacttttttggggacgatgagttccggatgtccaacaagtgggacgatatgctcatctctcaccagacgctggaggagtgccagacaaccgggacgatgaaagtgcattgggttcgcaagttccccttcttctgtagtgacagggagtacatcattgctcgccggatatggaaactgggaagcgcgtactattgtgttacaaagggtgtgccatgttcatccatcccacggcgcagcaaacctcgcagagtagattcgtattactcaagctggtgcatccgtgcagtggagtcaagacgagggaacggtggatcgtctgcctgcgagatcctcttgttccaccatgaggatatgggcatcccaaatgagattgcgaagattggcattcggcagggcatgtggggatgcgtgaagagaatcgaacccggactccgggcctatcagaaagccagggctgctggggagccaccttcgccgagcgccttgatggcacggatcaacaccaaggtcggtgacaattttgtccgaggactggagtccaacagtgaccaatcagatatcatggaagccgaagagaaacctgtgaaaaaccgtatggcgaggttccttgtgctcggcggggccgtggccttggcgtgtacactggaccaagggctcctgacaaaggctctcatctttggcgttgcgcggaagtttgtggggcagaggaacgcattgtaggatctgacatcttcctcacaatcctctgagccaatttgcgtggagagagcggagatgatctggctaactgtagcacatgccgttgacggcagatgaaggacattggtgtacatatgctgccggcagtcgatgagagagagggaggcaacagagtaaaaagatgtaatttacatttggaaaagggattccagctatatatgaatttttatctttgtttcatgttatcttctatgtgaactggatatgaggaaacgtaaatgaggatgtaattactcttttgttctttatgaagtatgtagtggctcctccattctgatggtgaaagcgagtaaaatagttcttgaatcagtttcacttcacgttgtaaaaaatggatacttgccaatcactatttgatttggtca

SEQ ID NO: 1599 - DNA, 1791 bp, Hordeum vulgare
aatcctcctccgataggccgcagcgcaaagccccccccatttccttctctcccctcgccgcaatcctcacccccgccccggccccggcccccgcccccggctgcggcgccgatggggtacgtgctgtcagcggtggcgagggtgctggagcagccgacggcgtggggcgcggcctgcgagatggcgctgctcgccgggccgctctgggcggccgccctcgtcggcctcctgctcggctgggcctggcgcccgcgctgggccgccggcatcgtcgcccccgccgacccgccgcagctcgcctcgctcgacttctggcgggcccagctccccgcccgcatccgcgcccccctcgactacctcgccggcgcgcggcagcagcaggaggacgacgacgaggcctccctgcacgggtcgtcggagatggggaaggaggagctggcggtggggaaggacgacctggtgaacctctggaggctggtggagggcaacgacggcggcccggcgtggatcaagatgatggagaaggcgctgcccaacatgacctaccaggcctggaggagggatccccagaatgggcctccgcaataccagagcagcacaatctttgagaacgcaaccccggatgaagtaagggacttttttggggacgatgagttccggatgtccaacaagtgggacgatatgctcatctctcaccagacgctggaggagtgccagacaaccgggacgatgaaagtgcattgggttcgcaagttccccttcttctgtagtgacagggagtacatcattgctcgccggatatggaaactgggaagcgcgtactattgtgttacaaagggtgtgccatgttcatccatcccacggcgcagcaaacctcgcagagtagattcgtattactcaagctggtgcatccgtgcagtggagtcaagacgagggaacggtggatcgtctgcctgcgagatcctcttgttccaccatgaggatatgggcatcccaaatgagattgcgaagattggcattcggcagggcatgtggggatgcgtgaagagaatcgaacccggactccgggcctatcagaaagccagggctgctggggagccaccttcgccgagcgccttgatggcacggatcaacaccaaggtcggtgacaattttgtccgaggactggagtccaacagtgaccaatcagatatcatggaagccgaagagaaacctgtgaaaaaccgtatggcgaggttccttgtgctcggcggggccgtggccttggcgtgtacactggaccaagggctcctgacaaaggctctcatctttggcgttgcgcggaagtttgtggggcagaggaacgcattgtaggatctgacatcttcctcacaatcctctgagccaatttgcgtggagagagcggagatgatctggctaactgtagcacatgccgttgacggcagatgaaggacattggtgtacatatgctgccggcagtcgatgagagagagggaggcaacagagtaaaaagatgtaatttacatttggaaaagggattccagctatatatgaatttttatctttgtttcatgttatcttctatgtgaactggatatgaggaaacgtaaatgaggatgtaattactcttttgttctttatgaagtatgtagtggctcctccattctgatggtgaaagcgagtaaaatagttcttgaatcagtttcacttcacgttgtaaaaaatggatacttgccaatcactatttgatttggtcagaggcgatacgcactgatatatttctgttgctta

SEQ ID NO: 1600 - DNA, 1658 bp, Leymus cinereus x Leymus triticoides
  misc_feature (9)..(12): n is a, c, g, or t
  misc_feature (48)..(49): n is a, c, g, or t
  misc_feature (106)..(106): n is a, c, g, or t
  misc_feature (158)..(158): n is a, c, g, or t
  misc_feature (228)..(228): n is a, c, g, or t
  misc_feature (395)..(395): n is a, c, g, or t
  misc_feature (716)..(716): n is a, c, g, or t
  misc_feature (766)..(766): n is a, c, g, or t
  misc_feature (789)..(789): n is a, c, g, or t
  misc_feature (794)..(794): n is a, c, g, or t
aggcccctnnnnccccccattcctttctccccttgccgcaatccacanntccgcccccgcctccggctccggcgccgatggggtacgtgctgtcggcggtggcganggtgctggagcagccgacggcgtggggcgcggtctgcgagatggcgctgctngcggggccgctctgggcggcggccctcgtcggcctcctgctcggctgggcctggcgcccgcgctgggcanccggcatcgtcgccaccgccgacccgccgcagttcgcctcgctcgacttctggaggggccagctccccgcctgcatccgcacccctctcgactacctcgccggcgcgcggcagcagcagcggcaggagcaggaggaggacgagacttccctgcaagggtcgtcgganatggcgaaggaggagctggcggtggggaaggatgacctggtgaacctctggaggctggtggagggcaacgacggcggcccggcgtggatcaagatgatggagaaggcgctgcccaacatgacctaccaggcgtggaggagggatccccagaatgggcctccgcaataccagagccgcacaatctttgagaatgcaaccccggatgaagtaagagacttttttggagacgatgagttccggatgtccaacaagtgggacgatatgcttatctctcaccagacgctggaggagtgtcagacaaccgggacgatgaaagtgcantgggttcgcaagttccccttcttctgtagtgacagggagtacatcattgntcgccggatatggaaactgggangcgcntactattgtgttacaaagggtgtgccatgttcatccatcccgcggcgcagcaaacctcgcagagtagatttgtattactcaagctggtgcatccgtgcagtggagtcaagacgagggaacggtggatcgactgcgtgcgagatcctcttgttccaccatgaggatatgggcatcccatatgagattgcaaagattggtattcggcagggcatgtggggatgtgtgaagagaatcgaacctggactccgtgcctatcagaaagccagggctgctggggagccaccttcgcagagcgccttaatggcacggatcaacaccaaggtcggtgacaattttgtccgaggactggagtccaacagtgaccaatcagacatcatggaagccgaagagaaacctgtgaaaaaccgcatggcgaggttccttgtgctcggcggggctgtggctttagcctgtactctcgaccaagggctcctgacaaaggctctcatctttggcgttgcgcggaagtttgtggggcagaggaacacattgtaggatctgacatcttcctcacaatcctctgagccaatttgcgtggagagagcggagatgatctggctaactgtagcacatgccgttgacggcagatgaaggacattggtgtatatatgctgccggcagtcgatgagagagggagaggcaacggagtaaaaagatgtaatttacatttggaaaagggattccagctatatatgaatttttatctttgtttcatgcgatcttctatgtgaactggatatatgagaaaccgtaaatcagaatgtaattactttttggttctttattatggagtatgtatgcagtggctcttccattctaatggta

SEQ ID NO: 1601 - DNA, 2014 bp, Sorghum bicolor
ccctgcccgtgcaccacaccttccccttccccaaacaaaccaaaaaaatccaaaaaaaatcgagtctttaatcctcgccataggccgcaaagcccccccattccttcctccctcccccaccctacctccacacgcaccgccgcgtccgtccccccacgccgtcgcttcccggccggtcggctccgatggggtacgtgctgtcggcggtggcgagggtgctggagcagcccacggcgtggggggcggcctgggagatggcgctcctcgcagggcccctctgggcggcggccctcctcggcctcctgctcggctgggcctggcgcccgcgctgggcagccggcctcgtcgtcgccaccgccgacggcggcagcgccgctgctgctgcgcaggcgctggcgcaaccgcccttcgccacgctcgacttctggaaggcccagctccccgcccgtctccgcgccccgcttggctacgccggcgccgccgtgcagcagagggaggaggacgaggacgccgtgcaagggtcgtcggagggggcgaacgaggagctggcggtgggaaaggatgacctggtgaacctctggaggctggtggagggcagggacggcggcccggcctggatcaagatgatggagaaatcgctgcccaccatgacctaccaggcgtggaggagggatacgcagaccgggcctccacagtaccagagtagcagtatctttgagaacgctacaccggaggaagtgagggacttcttcggggacgacgagttccgtatgtccaacaagtgggatgatatgcttatttatcataagacactagaggagtgccagaccactgggacgatgaaagtacattgggtccggaagttccccttcttctgcagtgacagagagtacataattgctcgccggatatggaaactggggggcgcctattattgtgtcacaaagggtataccatgctcatccgttccacggcgtaataaacctcgaagagttgatttgtattattcaagctggtgcatccgtgcagtggaatccaagagagggaacggagggttgacagcctgtgaggttctcttgtttcaccatgaggacatgggtatcccatatgagattgcaaagcttgggattcggcaaggaatgtggggatgtgtaaagaaaattgagcctggactccgggcctatcaggaagccagggctgcaggggagccagcgtcacggagtgccttgatggcccgaatcaatactaaggtcggtgacaattttgttcggtcactggaatccaacagcgacgaatcagaaatcgtggaagcagaagagaagcctgcgaggaaccacgtggcaaggttccttgtactcggaggggcagttgctctggcctgtactcttgatcaagggctcctaaccaaggctctcatctttggcgtcgcacggaaattcgttgggcagaggaagacattgtagcatctctgatctttcccagcgtcctccacgtggcccatgtgctgattagactcgccctgattcgctgacctggagcggaggaaagaggtgattcagtggctggtttattggcgctaattccattgtgactggaagagagcagatgaagagcattttggtgtacatatattctgtgccggctgtcggataatgaggaagagggaatagggtaaacgatgtacttcccatttggaaaaggaattccttactatatatataaatttgtttcatgtaatcttgtatctcagaaccagaccagatcagatgattatgcagatgagaagaacaagtgtttttctgtgtagcgtagctgttcttggtaagggtgagaaaaaatgggtggcactgatcagacagtttgaatccatatgctagtgctcgaattttcctggaaacttatactgatatgagggtattgaatgtagaactgcagggcgacaatagtttgaatatatcactgatgatctccgtggacacggtttccctgcttacctatagccttttttccgttc

SEQ ID NO: 1602 - DNA, 1689 bp, Saccharum officinarum
tctccctccaccccacccccccacacgcaccgccgcgtccgtccccccacgccgtcgctgcccggacggtcggctccgatggggtacgtgctgtcggcggtggcgagggtgctgcagcagcccacggcgtggggggcggcctgggagatggcgctcctcgcggggcccctctgggcggcggccctcctcggcctcctgctcggctgggcctggcgcccgcgctgggcagccggcctcgtcgtcgccaccgccgacggcggcagcgccgctgctgctgcgcaggcgccggcgcagccgcccttcgccacgctcgacttctggaaggcccagctccccgcccgtctccgcgccccgctcggctacgccggcgccgccgtgcagcagagggaggacgacgaggacgccgtgcaagggtcgtcggagatggcgaacgaggagctggcggtggggaaggatgacctggtgaacctctggaggctggtggagggcagggacggcggcccggcctggatcaagatgatggagaagtcgctgcccaccatgacctaccaggcgtggaggagggatgcccagactggacctccacaatatcagagtagcagcatctttgagaacgccactccagaggaagtgagggacttcttcggggacgacgagttccgaatgtccaacaagtgggatgatatgcttatttatcataagacgctggaggagtgccagaccactgggacgatgaaagtacagtgggtccggaagttccccttcttctgcagtgacagagagtacataattgctcgtcggatatggaaactggggggcgcctattattgtgtcacaaagggtataccatgctcttccattccacggcgcaacaaacctcgaagagttgatttgtattattcaagctggtgcatccgtgcagtggaatccaagagagggaacggagggttgacagcctgtgaggttctcttgtttcaccatgaggacatgggtatcccatatgagattgcaaagcttggtattaggcaaggaatgtggggatgtgtaaagaaaattgagcctggactccgggcctatcaggaagccagggctgccggggtgccagcgtcacggagtgccttgatggcccgaatcaatactaaggttggtgacaattttgttcggtcattggagtccaacagcgacgaatcagaaatcgtggaagcagaagagaagcctgcgaggaaccatgtggcaaggttccttgtactcggaggggcagttgctctggcctgtactcttgatcaagggctcctaacgaaggctctcatcttcggcgtcgcgcgaaaattcgtcgggcagaggaagacattgtagcatctctgatctttcccagcgtcctccgcttggcccatgtgctaattggacttgccctgattcgctgacgtggagtggaggaaagaggtgattcggtggctggtttattggcgctaattccattgtgactgaagagcagatgaagagcattttggtgtacatatatgctgccggctgtcggataatgaggaagagggaatagggcaaacaatgtacttcccatttggaaaaggaattcctactatatatataaatttgtttcatgtaatcttgtatctcaggcaagaccagatcagatgatgcagatgagaacaagtatttttcggtgtagct

SEQ ID NO: 1603 - DNA, 1689 bp, Saccharum officinarum
tctccctccaccccacccccccacacgcaccgccgcgtccgtccccccacgccgtcgctgcccggacggtcggctccgatggggtacgtgctgtcggcggtggcgagggtgctgcagcagcccacggcgtggggggcggcctgggagatggcgctcctcgcggggcccctctgggcggcggccctcctcggcctcctgctcggctgggcctggcgcccgcgctgggcagccggcctcgtcgtcgccaccgccgacggcggcagcgccgctgctgctgcgcaggcgccggcgcagccgcccttcgccacgctcgacttctggaaggcccagctccccgcccgtctccgcgccccgctcggctacgccggcgccaccgtgcagcagagggaggacgacgaggacgccgtgcaagggtcgtcggagatggcgaacgaggagctggcggtggggaaggatgacctggtgaacctctggaggctggtggagggcagggacggcggcccggcctggatcaagatgatggagaagtcgctgcccaccatgacctaccaggcgtggaggagggatgcccagactggacctccacaatatcagagtagcagcatctttgagaacgccactccagaggaagtgagggacttcttcggggacgacgagttccgaatgtccaacaagtgggatgatatgcttatttatcataagacgctggaggagtgccagaccactgggacgatgaaagtacagtgggtccggaagttccccttcttctgcagtgacagagagtacataattgctcgtcggatatggaaactggggggcgcctattattgtgtcacaaagggtataccatgctcttccattccacggcgcaacaaacctcgaagagttgatttgtattattcaagctggtgcatccgtgcagtggaatccaagagagggaacggagggttgacagcctgtgaggttctcttgtttcaccatgaggacatgggtatcccatatgagattgcaaagcttggtattaggcaaggaatgtggggatgtgtaaagaaaattgagcctggactccgggcctatcaggaagccagggctgccggggtgccagcgtcacggagtgccttgatggcccgaatcaatactaaggttggtgacaattttgttcggtcattggagtccaacagcgacgaatcagaaatcgtggaagcagaagagaagcctgcgaggaaccatgtggcaaggttccttgtactcggaggggcagttgctctggcctgtactcttgatcaagggctcctaacgaaggctctcatcttcggcgtcgcgcgaaaattcgtcgggcagaggaagacattgtagcatctctgatctttcccagcgtcctccgcttggcccatgtgctaattggacttgccctgattcgctgacgtggagtggaggaaagaggtgattcggtggctggtttattggcgctaattccattgtgactgaagagcagatgaagagcattttggtgtacatatatgctgccggctgtcggataatgaggaagagggaatagggcaaacaatgtacttcccatttggaaaaggaattcctactatatatataaatttgtttcatgtaatcttgtatctcaggcaagaccagatcagatgatgcagatgagaacaagtatttttcggtgtagct

SEQ ID NO: 1604 - DNA, 1708 bp, Panicum virgatum
acgccgtcgccgcccgcccggtcggcgacaatggggtacgtgctgtcggcggtgacgagggtgctggagcagcccacagcgtggggggcggtctgggagatggcgcgcctcgcggggcccctctgggcggcggccctcctcggcctcctgctcggctgggcctggcgcccgcgctgggccgccggcctggtcgccaccgctgacggcaacgccgctgcagcggcgccggcgcaaccgcccttcgccacgctcgacttctggaaggcccagctccccgcccgcctccgggcgccgcttggctactgcgagaccgccgtgcagcagcaggaggacgtgggcgccgcgcatgggtcgtcggagatggcgaacgaggagctggctgtggggaaggactacctggtgaacctctggaggttggtggagggcagggacggcgggccggcctggatcaagatgatggagaagtcgctgcccaccatgacctatcaggcgtggaggagggatgcccagactggacctccacaatatcagagtagtactatctttgagaatgcaactccagaggaagtgagggacttttttggggacgatgagttccggatgtccaacaagtgggatgatatgcttatctatcataagacgctggaggagtgccacacaaccgggacaatgaaggtgcattgggtccggaagttccccttcttctgcagtgacagagagtacataattgctcgtcggatatggaaattggggggcgcctactattgtgtcacaaagggtataccatgctcatccatcccacggcgtaacaaacctagaagagttgacttgtattattcaagctggtgcatccgtgcagtggaatcaaagagagggaatggagggttgacagcctgtgagattatcctgtttcaccatgaggacatgggtataccatacgagattgcaaagcttgggattcggcagggaatgtggggatgtgtaaagaaaattgagcctggactccgggcctatcaggaggccagggctgctggggagccagcatcaaagagtgccttgatggcccggatcaatactaaggttggcgacaactttgttcggtcactggagaccaacagcgacgaatcagaaattgtggaagcagaagaaaaacctgcgagaagcaatgtgtcgaggttccttgtgctcggcggggcagtcgctctggcgtgcaccctcgatcaagggctcctgacgaaggctgtcatctttggcattgcgcggaaatttgtggggcagaggaagacattgtagagttgctgtttatttttttctcggtgtcctccgccttggccaatgtggttattgggctcgccctgattcactgtcgtggattggagggaagaggtgattcaatgcctggttaattggggcaaatgccatcgagactgaagagagcagatgcagagcattttgatgtatatatctgctgccggccgtcagataacgaatattagagggagtagggtaaaaatcattgcacttcatatttggggaaggaattccaactatatatgtataaattcgtttcatgtaaccttctatctcaagaccaaactagagatgactatgcagatcgaattaaaagtgttttgttccttattctgttgagcatatatatgctggtaaatcgtgaaacaaaatgcgctctggttgagctttgatgccc

SEQ ID NO: 1605 - DNA, 1726 bp, Panicum virgatum
gcgcaaagcccccattcctcccttccctttgttctccgccccccaccccacccgcaccgccgcgtccgcccccccacgcctcgccgcccgccgggtcggctccgatggggtacgtgctgtcggcggtggcgagggtgctggagcagcccaccgcgtggggggcggtctgggagatgtccctcctcgcggtgcccctctgggcggcggccctcctcggtctcctgctcggttgggcctggcgcccgcgctgggccgccggcctggtcgccaccgctgacggcaacgccgctgcaccggcgccggcgcaaccgccctttgccacgctcgacttctggaaggcccagctccccgcccgcctccgggcgccgcttggctactccgagaccgccgtgcagcagcaggaggacgaggcaaccgcgcatgggtcgccggagatggcaaacgaggagatggctgtggggaaggacgacctggtgaacctatggaggctggtggagggcagggacggcggcccgtcctggatcaagatgatggagaagtcgctgcccaccatgacctaccaggcgtggaggagggatgcccagactggacctccacaatatcagagtagtactatctttgagaatgcaactccagaggaagtgagggacttcttcggggacgatgagttccggatgtccaacaagtgggatgatatgcttatctatcataagacgctggaggagtgccacacaaccgggacaatgaaagtgcattgggtccggaagttccccttcttctgcagtgacagagagtacataattgctcgtcggatatggaacttggggggcgcctactattgtgtcacaaagggtataccatgctcatccatcccacgccgcaacaaacctagacgagttgacttatattattcaagctggtgcatccgtgcagtggaatcaaagagagggaatggagggttgacagcctgtgagattctcctgtttcaccatgaggacatgggtatcccgtacgagattgcaaagcttgggattcggcagggaatgtggggatgtgtaaagaaaattgagcctggactccgggcctatcaggaggccagggctgctggggagccagcatcgaagagtgccttgatggcccggatcaatactaaggttggcgacaactttgttcggtcactggagaccaacagcgatgaatcagaaattgtggaagcagaagagaaacctgtgagaagcaatgtggcgaggttcctcgtgctcggcggggcagtcgctctggcgtgcacccttgatcaagggctcatgacgaaggctgtcatctttggcgttgcgcggaaattcgtggggcagaggaagacattgtagagttgctgttttttctgggcgtcctccgccttggccaatatggttattggactcgccctgattcactgtcgtagattggagggagaggtgattcaatgcctggttaattggggcaaatgccatcgagactgaagagagcggatgcaaagcattttgatgtgtatatatgctgccggccgtcaacgaatatgagagggagtagggtaaaaatcattgtactttacatttggggaaggaattccaactatatatgtataaattcgtttcatgtaaccttctatctcaaggtcaaactagagaggactacgcagatggaattataagtgtttttttttgccttattcagttgagcatagata

SEQ ID NO: 1606 - DNA, 1713 bp, Zea mays
ctcctcccaccccaaaccaaacgaacaaaaaaaaatccaaaaaaaacgagtctttaatcctcgccatcgaccgcaaagcccccctctgccccctccttttcccctccctcccacacgcaccgccgcgtccgcccccttcgctgcccctgcccggtcggttccgatggggtacgtgctgtcggcggtggcgagggtgctggagcagcccacggcgtggggggcggccccggagatggcgctcctcgcggggccgctctgggcggcggtcctcctcggcctcctgctcggctgggcctggcgcccgcgctgggcagctggcctcgtcgccgcccccgcccccgccgccgctgcgcagccgcccttcgccacgctcggtttctggaaggcccagctccccgcccgtctccgcgccccgctcggctccgccgccgccgtgcggcacggggaggaggaggaggaggacgaggtctccgtgcgagggtcgtcggaggcggggagcgaggagctggcggtggggaagcgtgacctggccaacctctggaggctggtggagggcagggacggcggcccggcctggatcaagatgatggacaggtcgcttcccaccatgacctaccaggcgtggcggagggacgcgcagaccggaccaccacagtatcagagtagcagcatctttgaggacgccactccggaggaagtgagggacttcttcggggacgacgagttccgtgtgtccaacaagtgggacgacatgcttgtttaccataagacgctggaggagtgccagaccaccgggacgatgaaagtgcattgggtccggaagttccccttcttctgcagtgacagagagtacataattgctcgccggatatggaaactggggggcgcctattattgtgtcacaaagggtataccatgctcgtccattccacggcgcaacaaacctcgaagagttgatctgtattattcaagctggtgcatccgtgcagtggaatccaggagagggaacggagggtcgacagcttgtgaggtgctcttgttccaccacgaggacatgggcatcccgtacgagatcgcaaagctcggtatccggcaagggatgtggggatgcgtgaagagaatcgagcctgggctccgggcctatcagcaagccagggctgcaggggagccggtgtcacggagtgccctgatggcccagatcaacaccaaagtcggcgacagctttgtccggtcgctggagtccgacagcgacgggtccgaaaccgtggaagcggaagagaagcctgcgaggaaccgtgtggcgaggttccttgtgcttggaggggcagttgctctggcctgtactcttgaccaagggctcctgacgaaggctctcatcttcggcgtcgcgcggaaattcgtcgggcagaggaaggcactgtagcatctctggcatttatttctcagcgtcgtccgcttggcccgtggtccgcactaaccggacctgtcctttcactgtcgtagagtggaggatagaggtggttcagtgtctgcctaattggggcaaatgccattgaccattgtggctgaaagagaacagagctgatgaaaaacattttggtgtacagatatgctgccggctgttggatagcgaggaatggggaatagagcaaacaatgtacttctcgtttggagaacggaactcctacgatatatataaatgtgtttcatcta

SEQ ID NO: 1607 - DNA, 1719 bp, Zea mays
ctcctcccaccccaaaccaaacgaacaaaaaaaaatccaaaaaaaacgagtctttaatcctcgccatcgaccgcaaagcccccctctgccccctccttttcccctccctcccacacgcaccgccgcgtccgcccccttcgctgcccctgcccggtcggttccgatggggtacgtgctgtcggcggtggcgagggtgctggagcagcccacggcgtggggggcggccccggagatggcgctcctcgcggggccgctctgggcggcggtcctcctcggcctcctgctcggctgggcctggcgcccgcgctgggcagctggcctcgtcgccgcccccgcccccgccgccgctgcgcagccgcccttcgccacgctcggtttctggaaggcccagctccccgcccgtctccgcgccccgctcggctccgccgccgccgtgcggcacggggaggaggaggaggaggacgaggtctccgtgcgaggtggcaggtcgtcggaggcggggagcgaggagctggcggtggggaagcgtgacctggccaacctctggaggctggtggagggcagggacggcggcccggcctggatcaagatgatggacaggtcgcttcccaccatgacctaccaggcgtggcggagggacgcgcagaccggaccaccacagtatcagagtagcagcatctttgaggacgccactccggaggaagtgagggacttcttcggggacgacgagttccgtgtgtccaacaagtgggacgacatgcttgtttaccataagacgctggaggagtgccagaccaccgggacgatgaaagtgcattgggtccggaagttccccttcttctgcagtgacagagagtacataattgctcgccggatatggaaactggggggcgcctattattgtgtcacaaagggtataccatgctcgtccattccacggcgcaacaaacctcgaagagttgatctgtattattcaagctggtgcatccgtgcagtggaatccaggagagggaacggagggtcgacagcttgtgaggtgctcttgttccaccacgaggacatgggcatcccgtacgagatcgcaaagctcggtatccggcaagggatgtggggatgcgtgaagagaatcgagcctgggctccgggcctatcagcaagccagggctgcaggggagccggtgtcacggagtgccctgatggcccagatcaacaccaaagtcggcgacagctttgtccggtcgctggagtccgacagcgacgggtccgaaaccgtggaagcggaagagaagcctgcgaggaaccgtgtggcgaggttccttgtgcttggaggggcagttgctctggcctgtactcttgaccaagggctcctgacgaaggctctcatcttcggcgtcgcgcggaaattcgtcgggcagaggaaggcactgtagcatctctggcatttatttctcagcgtcgtccgcttggcccgtggtccgcactaaccggacctgtcctttcactgtcgtagagtggaggatagaggtggttcagtgtctgcctaattggggcaaatgccattgaccattgtggctgaaagagaacagagctgatgaaaaacattttggtgtacagatatgctgccggctgttggatagcgaggaatggggaatagagcaaacaatgtacttctcgtttggagaacggaactcctacgatatatataaatgtgtttcatcta

SEQ ID NO: 1608 - DNA, 1553 bp, Setaria italica
tgctggagcagcccacggcgtggggggcggtctgggagatggcgctcctcgcggggcccctctgggcggcggccctcatcggccttctgctcggctgggcctggcgcccgcgctgggccgccggtctcgtcgccaccgccgacggcagcgccgctgcaccggcgccggcgcaagcgcccttcgccacgctcgacttctggaaggcccagctccccgcccgtctccgggtgccgctcggctacgctgggaccgccgtgcagcagcgggaggaggacaaggccgccgcgcaagggtcgtcggagatggcgaacgaggagctagctgtggggaaggaagacctggtgaacctttggaggctggtggaaggcagggacggcggcccggcctggatcaagatgatggagaagtcgctgcccaccatgacctaccaggcgtggaggagggatgcccagaccggacctccccaatatcagagtagtactatctttgagaatgcaactccagaggaagtgagggacttctttggagatgatgagttccggatgtccaacaagtgggatgatatgcttatctatcataagacgctggaggagtgccagacaaccggaacgatgaaagtgcattgggtccgaaagttccccttcttttgcagtgacagagagtacataattggtcgtcggatatggaaattgggtggcgcctactattgtgtcacaaagggtataccatgctcatccatcccacggcgtaacaaacctcgaagagttgacttgtattactcaagctggtgcatccgggcagtggaatcaaagagagggaatggagggttgacagcctgtgagattctcctgttccaccatgaggacatgggtatcccgtatgagattgcaaagcttgggattcggcaaggaatgtggggatgtgtaaagaaaattgagcctggactccgggcctatcaggaggccagggctgctggggagccagcgtcaaagagtgccttgatggcccggatcaacactaaggttggtgacaactttgttcggtccctggagtccaacagcgaggaatcagaaatcgtggaagcagaagagaaaccggcaagaaacaatgtggcgaggttccttgtacttggtggcgcggtggctctggcttgtacccttgatcaagggctcctgacgaaggctctcatctttggcgtcgcgaggaaattcgtggggcagaggaagacgttgtagcatctctggtctctctcggtgtcccccgcttggccaatgcgcttattggactcgccctgattcaccatcctggagcggagggaagaggcgattcgattccaggttgggactgaagagagcagatgaagagcattttgatgtgtatatgctgccacggctgtgagataatggggaagagagggaatagggtaaacattgtacttttttcatttggaaaaggaattccaactatatgtataaattcatcttatgtaaccttctatctcgagacaaaactagagaggactatgcagaccaaattaaaagcatttgcctccg

SEQ ID NO: 1609 - DNA, 5464 bp, Brachypodium distachyon
cgcgtctcgcccatggcggcggcgcgagggtcccgatctggggtctcgggggcggcgttggcgttgcttgcggcggtgctcgtcggatgcctcgccgggggcgcctcggcggctgagatccggcggcagaagaacgtgcaggtggcgctccgggccaagtgggcaggcacgccgctgctgctcgaagccaatgaactgctctcaaaagaggggaaggatcttttttggggttttgttgaccattggaaggagctggacaaaggttctgaatgtttgacggccaagtgttgtgtccagaagattgttgaggatgtccactcacttattggcgagccactggcttcaatttttgagttctctcttacactcagatcagcgtcgccaaggctagtgctttataggcagcttgcagaagagtcattatcttcagttcctgttgaggatgatgcactggagcaaatttctggccatggtcctgtggaaggaacttgctgctgggtagacacagggagtgctctattgtttaactcagctgatctacataaatggcttgagggatcaggcaagcgaaccatggactccactggacaaccagaactatttgactttgaccatgtatatcctcgctcaaatgttactgctccagttgctatactttatggggctgttgggacaaaatgcttcaaggagctgcacgttcgtctagcagaagcatcaaagaagggaaaagtcagatatgctctgcgccctgttctgccatctggatgccaggctacatctagcttttgtgcttccattggtgctgtagatgcagtcactttgagtggttatggggtggaactcgccctaaaaaacatggaatacaaggccatggatgacactgctataaagaagggtgttgctctcgaagatccgaaaactgaggacctcggtcaagaagtcagagggttcatattttccaagattttggagcgcaagccagagctaaatgacgaggcaatggccttccgggattatttattgtcatcgacagtatctgacacacttgaagtctgggaactcaaagatttgggtcatcagacagcacagaggatccttcatgcatcagatcctttgcagtcaatgcaggaaatcaatcaaaattttccgagtgtagtttcttcactgtcacggatgaagcttgatgattccatcaaagatgaaatcatagcaaatcagcggatggttccacctggcaagtcattaatggctttgaatggtgctttgattaacatcgaggatcttgatctctacctgttaatggatatggtccgtgaagaattatctctggctgatcagttcatccgattaaagttgcctaaaagtgctgtccacaagatcctgtcagcagcgccaccagcagaatctaattcattccgtgttgacttccgggcttcccatgttcactatcttaataacttggaggaggatgacttgtataaaaggtggagaagcaacctcaatgagctattgatgccagtctaccctggtcagatgcgctacatccgcaaaaatctattccatgctgtttatgtacttgatccggcttcagcatgtgtctggtgtttgctattttcacttataactttacagactattgacacgatcatgtctctatatcaagatagtgtccctgtaaggttcggtatcataatgtactcttcaagattcataaatgttattgaagaaaatgatggcactcatcaagtaaacgatggatctaagagcgaagatgacacttccactttgataataaggcttttcttgtacatcaaggagacatactcaacacagttggctttcgaattcctaagcaatatacataaattgaggaatggtggcgatgactatagtgaagagcctgtggaagctcatcatgtggaagaggcatttgttgattccgtactgtcaggtgctaaatctcaccctcaagacgtgctgctaaagttgcaaaaggagaacatgtacaagcaagaggctgaagaaaattctcgttttgttcacaaacttgggttgtataagctccactgctgtttattgatgaacggactcgtgcatgaatcaaatgaggatgcgaccatgaatgctatgaatgatgagcttcctaggatacaagaacaagtctattatgggcatatccagtcccatacagatgttttggagaaatttttgtcagaaagtagctacaagcggtacaatccatccattactggcaagagtacagagaagaagagatttgtctcactatttgcatcgtatcatcaggaagattctgtccttcatgacattaactacttacattctgatggaactacagatgatgtgaagcctgtaactcatctacttgctgttgatctttcttcaaagattgggacaaagttgcttcatgaggccatatgttacctgatggacgggtctaatagagctcgtgttggtctactactttatgctcgcagtgatagtgcttcaaacattttacttatgaaggatatcattgatagaactatttcatctttcagtgacaaggaaaaggtactgggcttcctacatgggttttgcaaattttatgaaagccaacatatgcctgcctctactgcggtcggcgataggattagccccatgatggacgaggtgtataacttggctgctgaaacagacttgcctgttgatgattataagtcgtggcttgcaagtttttctgctgacacagttctcaaaaggattgataagctgaatgacttcttgtttggtcaactggggcttgagttcggtagcaacgctgttatcacaaatggacgggagcccaagaacatgagatttctgcaatcaactgagggagtaggcggggcagtagtgctcggccgttctcgtgaagtttctgcacgtgaatctggacctcgatgcgtgggaggcgctggacacggtggcaagccacgctggcctgaccggtgggccgtccttgtcagcttcgggatttttgttgtgggtgtaggtgactcgtttttgaccgatgatttaggtctccttgagtctatggagtatgagttaagaacgaaatacatacatgaaatagttgaagaggttgaatgggctggtgttgaccctgattacctgacaagcaaattctacagtgatatcaccatgttggtctcatcgtcaatgtctgtccgtgaaagaccatccgaaagagcccactttgaaattttacacgcggaacacagtgcaattaaactgaactatatgaattcaagtattcacattgatgctgtcattgatccgctaagtcccgctgggcaaaaactttctcctcttctacgcatactatggagacagattcagccgagcatgagaattgtcctcaatcctattagttcccttgctgatcttcctttaaagaactactacagatttgttcttccatcgatggatgattttagcaacacagattattctgtacatggacctaaagctttcttctcaaacatgccactatctaaaacacttactatgaacatcgatgttcctgaaccatggcttgtcgagcctgtcgttgccatccatgatttggataatattctattggagaatcttggtgatgttaggacactgcaagcagtatttgaacttgaagcgctcctcctgacaggtcattgcatggaaaaggaccgagaacctccccgtggtctgcagtttatacttggaaccaaacaaatgccacacttggtagacacacttgtcatggccaacttgggttactggcagatgaaagtttctccaggggtgtggtacctacaacttgctcctggacgtagtgctgatttgtatgaattgccttcgaaactcattgctatagatagcttgaggggcaaacttatacacattgaagtgcaaaagaaaaagggcaaggaacatgaggacttactaaatgctgatgatgagaaccatttccaggaaaagatggataacaaaggctggaatagcaaccttttgaaatgggcgtctagtttcattagtggtgatgcatcattaaaaaagaaatctgagaaaattaatgaccttaaggatgcaagacaaggggagacaattaacattttttctgttgcttctgggcatctgtatgagcgtttcctcaaaattatgattttgagtgttttgaagaagacacaaaggccagtgaaattttggttcataaagaattatctatctccacagtttaaggatgtcataccccacatggctcaggaatatggattcggttatgagcttatcacgtataaatggccaacatggttgcacaaacagaaagagaagcaacggattatatgggcatacaagatcttgtttctggatgtcatattcccactttctttgaggaaggttatttttgttgatgcggatcaaattgtgaggacagacatgggagaactgtatgacatgaatttgaagggccgcccccttgcatataccccattctgtgataacaacaaggagatggatggctaccgattttggaaacaaggtttctggaaagatcatctgcgcggaagaccataccatatcagtgctctttatgttgttgatttggccaaatttcgacaaactgctgctggggatactctacgggtcgtttatgaaacactcagcaaggaccccaatagtctctcaaatcttgatcaggatctcccaaattatgctcaacatacagtgcccatattctcactccctcaagaatggctatggtgtgaatcttggtgtggaaacgcgacaaaggccagagcaaagaccattgatctctgcaacaatccaatgacaaaggaaccaaagctccagggtgctagaagaatagttccagagtgggttgatttcgacagtgaagcaaggcagttcaccgcacgaatccttggggagaatttagagagtgcagaggccacttccgtaccttctgatgcaccaaagcctgacgataaagactcgagacaggatgtgaaagatgagctatgaccaccagctgtaaccctagcttgatcatcttccagaaaaggctatactgaaccgatgccccccgcagaaaacagagttggcgcacaggataaacgcagtccaggttcccatagcaattgtaaacgcactataccacagcgacgcacagcagcagaacgttttgtacaccctgatcccgtaaggctaactcgcccaaattatgtggaagagggaactagtagtgatctaggtggtagatgtgaaaaacattgtaatagtcaacttcggggtgctggtatctgtgagacgctgtaaaatgtatcattggcatcatacaattttgttttgcttcaatttgatgaccgtgaattttgtgacagcccacgccatttacttggattctatttttatgtgatgcttcgaaccataaattctggtgggtttc

SEQ ID NO: 1610 - DNA, 1530 bp, Brachypodium distachyon
tcctctctatccacttgcacagtgtggactgtagtgcccaacttggcaaccacctgctcctcctcctcctttccccacggccaccggcgacgccacgccatgccgtccagctccacctacgccgacgcgctggcggcggcgcgcccgttccttcgtggcgaggaggagctccaaccggacccatccctcccagccctcgccgcggtcctcagcgccgcgggcgccggcgagtgctggcacaagcatggcaccttcctcgcgcacctcctcgacgtgcaccgcatcctccgcctctggtcggcgcccgacgccgtcgcccgctgcggcctctaccactccgcctactccaactcctacgtcaacctcgccatcttcgagcccgacgtcggccgggcccacgtcgccggcgtggtcggcgccgaggccgagcggctcgtgcacctcttctgcgtcgtgccgcggcagcagctgattcacgatgacttgctgttccactatgaggatgaggacctggtggttgacctggcgagatccgaggagtctctcgcggacgcgcggggaggggtgtttgaggaggacgagccatggcggcgtaagatccagcggctgctcccggcctccggaatcactgtcaagcacatcaggactggtgaggatgtggctctgtctaggcgggtagctgcggcattccttctgatgacaatggcagacttcagtgaccagctcttcgactggcaggaccgcctcttcgacaacaccaatggccgccttgagttccgaggcaacacctggacgtccctctggcctggcaccggcaagcctggtctttggactacctccatctcccgcatgggcgcgctttactccctcattgtgcgtgaagaggagatatacatagctcacagaacacataccaccggccaggaaggcgatgagactgccacacgcgacgaggacatcgccctggtgatccctcccgtgttcaatggctgcaccaaggtgctcaatgccgatgaccagaaggcagcacgagacctctattgggaagcagtgtgcagcgacgaagaggcgatggaccggcacagagtagaggagctcctcaggcagaccgtcgccaagaaccctttcgttggggaacctcgcctggtcctcgcacaggtgtgccttaatgcagagatgtatgaggaggcgcaggagcaggcggaggaagggctgaagctgctgctggagtgggggagcagctgggacaagaggatgacatgggaggggtgggtgtcatggggaagagccatgctgaccaaggccaaggagaaggactggcctcatacctccttcggcatcctcagcctagggctcgtcaagtagatgtttgtgtaatcatctcagcaatcgccacatacgtacatacgcttagctcgaaaggtatgaaataatatacctcgctagcaattaaataattggctcgacatacattgtaatagatgcacgattgcaccgacagtatataaatgcataaattaattttcacaa

SEQ ID NO: 1611 - DNA, 1689 bp, Panicum virgatum
catccatctcacgcaaccaaggcgatgccgccgccgccgccgcgttccctggacgacgccctggccgcggcgcgcccgttcctgcgcggcgaggaggcgcaggtggacccggcgctgccggagctcgccgccgtcctgcgcgccgcgggcgccggcgagtgctggcacaagcacggcaccttcctcgcccacctcctggacgtgtaccgcatcctccggctgtggggcgcgcccgacgccgtggcgcgctgcggcctctaccactccgcctactccaactcgtacgtcaacctcgccatcttccagcccgacacgggccgcgcccacgtcgccgccgtcgtcggcgcccccgccgagcgcctcgtccacctcttctgcgtcgtcccgcgccagcagctcatccacgaccacctcctcttccactacacggaccacgacctcgtcgccgacctccagcggtcggaggcgtcgctccaggacgcgcgccgcggggtgttccaccacgacgagccctggcgccggaagatccaacgcctcctcccgcccgccggcatcaccgtcaagcacatcaggacaggggaggatgtggccctgtccaggcgcatcgccgcatcgttcctcctgatgaccatggcagacttcagcgaccagctcttcgactggcaggaccggctcttcgacaacgccgacggccgccttgagttccgtggcaacacctggacctccctctggcctggcaccggcaagccaggcctctgggtcacctccatctcccgcatgggcgcgctctacgccctcattgtccgcgaggaggagatacacattgctcaccggggggcgcatgccgccacagcccaagaacaaggcagtgaccgcgacgaggacatccacctggtgctcccgccggtgttggacggctgcaccaaggtgctcgacgcccaagaccagaaggtggcgcgagacctctactgggaggcagtgtgcggcggcgacgatgactggcgcaaagtggagcagctcctccagcagagcattgccaagaacccattcgtaggagaaccacacctggtgcttgcgcaggtataccttaacatggacaggtacggtgacgcgcagatccaggcggaagaaggtctcaagctgctgctcgagtggggcagctgctgggacaagagaatgccatgggagggctgggtgtcctggggcagggccatgctcaccaaagccagggacaaggattggccccatacctcattcggcatcctcagcctagggcttgtcaagtgatcaggaggagtgcagctgtctgtgccttgtgtaggctgcagctgctgatgccgatccatgcactcagccatgttaattatatatcttctcagcgtatgcgtatgtgtagtgtagcaccaactgtatgaaatattgaacccacggtcggtcaaaatggatatatagatgctaataatgtgcaggttcaaatatgtatgtagtttacgagttcaaggaaccaagtggtataggagtatgtatgcaactctgggaacatatggtccagtccaccccatgttttaaaggcgaggcgagctgggtacccctggacgcctaggcgacaaggcgtggttgtcgcctaggcgacccctttagaactatgagtgtacctacgaaagaaatggtacctactatatatgttac

SEQ ID NO: 1612 - DNA, 2830 bp, Brachypodium distachyon
caccggtggggccgcacgccatggcgagcggcggaggcggctgcttgcccgcgatggatctgatgcggtcggagcctatgcagcttctgcaggtcatcatccccaccgagtccgcgcacctcgccgtctcctacctcggcgatctgggcctaatccagttcaaagacctcaatgcagacaagagcccgtttcaacggacgtatgctgctcagatcaaaagatgtggtgaaatggctcgcaagttgaggttttttaaggaacaaatgtccaaggctggcatacaaatttctcctgtgcaattaaccgaaactcctctggattttgatgacatggagataaagcttggagagctagaagctgaactaactgaagtcaatgcaaacgatgagaagttacagcggacctacaatgaactgttggaatacagtactgttcttcaaaaagctggtgaatttttctattcggctcaaagaagtgctgcagcgcaacagagggaaatggagacaagtcaatctggtgatatttcactggagagtcctctgttggagcaggatatgtttacagatgcatcaaaacaagtgaaacttggctctttgagtggtcttgttccaaaggaaaaggcaatggcttttgagcgtatattattccgtgcgacaaggggcaacattttgctcagacaagagtccgttgatgaacctgtcactgatccacaatccggagaaaaggtttccaaaaatacattcgtcatattctactccggtgagagagcaaaagccaaaattctgaagatatgtgatgcttttcgtgcaaaccgttacccttttcctgaagaccttggaaaacaaatgcatactgttcaggaggtatctggaaagatatcggagttaaaggcaacaattgacatgggattagctcaccgtgacagcatacttaaaactattgcattggagtatgagcactggaaccatctggcaaagaaggaaaaatcaatttaccacactctaaacatgttgagtgttgatgtgacgaagaaatgcttagttggtgagggctggagtccagtttttgcaactagtcaggttcaggatgcgcttcagcgtgctactcttgagagcaaatcccaagttggctcgatttttcaagttctgaacacaaaagaatctcctccaacatatttccagacaaacaaatttacttcagccttccaggaaattgttgatgcatatggggtagccaagtatcaagaagctaaccctggtgtattcactgttatcacttttcctttcttgtttgctgtaatgtttggagattggggccatggaatttgcatattacttgcaacgctctatctgataatccgagagaagaaattcgcttcccagaaacttggagacataatggagatgatgtttggagggcgctatataattatgatgatggcgcttttttcaatctacacaggattaatatacaatgaatttttctctgtcccatttgagctttttgctaaatcagcctatgcgtgccgtgatccttcttgtggggatgctaccactgaaggattggtgaagataaggccgacatacccatttggtgtggaccctgtgtggcatgggagtcgtagcgagctaccgtttctcaactcactgaagatgaaaatgtcaattcttcttggagttgcacaaatgaaccttggaattatgatgagttacttcaatgcgaaattcttcaggaacagtgtaaatgtgtggtaccagtttgttccccagcttatcttcctaaacagcttgtttggctacctgtccatgcttatcatcatcaagtggtgcacagggtcaaaagcagatctgtaccatgttatgatatatatgttcctcagcccgacagacgagctgggagagaacgagttatttcctggccagaaaacagtgcagcttgtcttacttctgcttgctctggtgtctgttccctggatgctgatcccgaaaccatttttcttgaagatggaacacgagcgaaggcatcaaggacaccaatacgccatgcttgagggcgcagatgaatcagtggtcgcagagcttggggaacaccatgaagagtcaaaccaccatgaggagtttgagttcagtgaaatttttgttcaccagctgatccatacaattgagtttgttcttggtgcggtctcaaatactgcttcatatcttcgtctctgggctctcagtcttgcacattcggagttgtccactgtgttctatgataaagttcttcttctgacgttggggtacaataacctattcatcctcgctattggtgtcttcgtcttcatctgcgccactgttggcgtgttgcttgttatggagaccctaagtgcattccttcatgccttgaggctccattgggtggagttccagaacaagttctacgagggtgatggttacaagttcgcgccattctcttttgcactgatcaccgaggaggaagagtgagttcgtccaaattcttgtatctattagtctttgtaatatctcgggtggcctttgtttccagaaaaaaaacattattttatcaaggaagagtcataaacctccagccccttgttcaagcaagggaagtgcaatatcatttttatttaggtatggattacacagaaggattagtatttttttctggggagggttggcaacaaaactctagtgcatcacccttacttctgcgtaattctaataacgagttttgcctcgtgttgctgttacggcgctgtgtatttggatataaataagcatgtaataaaaggatgttccactgtgattattgtcaagcgcttcaatcc

SEQ ID NO: 1613 - DNA, 3024 bp, Sorghum bicolor
ctgtctctacctccccggctcccccctcgctcacctcctcacgacgcgaggaaccgatcaggccaccgccggacacgcaggagatccgctccgcccccgcgattccgatcagaaacacctcgtcggatctccagggatctgacggaggagcagcgcgtcggctgctgacccggcggggcacgcgcgcacgccagccatggcgcgtggtggcggaggcggctgctgcccgcagatggatctgatgcggtcggaggcgatgcagctggtgcaggtcatcatacctgctgagtccgcgcatctcaccgtctcctacctcggcgacctcggcctcctccagttcaaagaccttaatgcagagaagagcccatttcaacgaacatatgctgcccagatcaaaaggtgtagcgaaatggctcgtaaattgaggttttttaaggagcagatgtcaaaagctgacataacaacctctcctacacaactaaatgaaactcatctggattttgatgacttggagataaagcttggagaactggaagctgagctaactgaagttaatgcaaacaatgagaagttgcagaggacctacaatgagctattagagtaccatactgttctccaaaaggctggtgattttttctattcagctcaaagaactgctgcagcacaacaaagggaaatggaggcaaaccaatctggtcaaacttcactggagagccctctgttggaacaggagatgtcaaatgatccatcaaaacaagtgaagcttggctcattgagtggccttgttccaaaggaaaaggcaatggcttttgaaaggatcttattccgtgccacaaggggtaatattttccttaggcaagagcctgttgatgagcccgtcactgatccagtttctggggagaaggtaacgaagaatgcatttgttatattctactctggagagagggcaaaaaccaaaattctgaagatatgtgatgccttcaatgcaaaccgttacccgtttccagaagatgttagcaaacaactccatgctgttcaggaggtatctgggaagatctcagagttgaaggcaacaattgacatgggtttagctcatcgtgacagtatactaaaaaatattgcttctgattttgaacagtggaaccatctggcgaagaaggaaaaagcaatttatcacaccttgaacatgctgagcgttgatgttacgaagaaatgcctagttgctgagggctggagtccagtttttgcaagcgttcagattcaagatgctcttcagcgtgctactgttgatagcaaatcccaagttggatcaatatttcaagttctcaacacaaaagaatctcctccaacatatttccagacaaataaatttactacagcgttccaggaaattgttgatgcgtatggtgtggccaaatatcaagaagcaaatcctggagtatttaccattgtgactttccctttcttatttgctgtcatgtttggtgattggggccatggaatttgcctgttacttgcaacactttatctgataatccgggagaagaaactagcttcacagaaacttggagacataatggagatgatgtttggtgggcgttatgtaattatgatgatggcagttttttcaatctacacaggattaatatacaatgaatttttctctgttccatttgagctttttggtaaatctgcctatgaatgccgtgatccttcttgtagtgatgctactactgatggactaattaaggtcagagatgcatacccttttggtgtggaccctgtctggcatggtagccgcagcgagctgccgtttctcaattcactgaagatgaagatgtcaattcttcttggagttgcacaaatgaaccttgggattgtgattagttacttcaatgcaaaatttttcaggaacagtcttaatgtgtggtaccagttcattccccagctgatcttcttgaacagcttatttggttacctgtccttgctcattattattaagtggtgcacggggtcaaaagcagatctataccatgttatgatctacatgttccttagcccaacagatgagcttggtgagaaccagttgtttagtggccagaagacagtgcagcttgttctacttctgcttgctttggtgtctgtaccttggatgttgattccaaaacctcttctattgaagaagcaacatcagcaaaggcatcaaggtcaccagtacgctatgcttcagggcactgatgaatcagtgggagcagagttgggggaacatcatgaggacgcacatgaccatgaggagtttgagttcagtgaagtttttgttcaccaactgattcacacgatcgaatttgttcttggtgcagtctccaacacagcttcataccttcgtctttgggctcttagtcttgcacactccgagttgtccactgtattctatgataaagtactactaacggcattggggcttaacaatatttttgcccttattatcggtggcattgtctttgtctttgccacggttggtgtcttgcttgttatggagaccctgagtgcattccttcacgcgctgaggcttcactgggtggagttccagaacaagttctatgaaggtgatggttacaagttcgccccattctccttcgcactgattcgtgaggaggaagattgagctcgccccaacatttgtatttattgtagccgatgtaaaatctatctttggtggcctttgttcccagaacagatcattttttcatctgttgtctccgatggatcataaacctcagtccctttgtttaagcatgggacgaacagcatcatttttccttccttagctatgcagaggatttttttggttagctggcaacaaatatggggtgatatcacccttgtatgatgctaataagtagttgccgattgggtagtatgttggatataaataagcactgtattgaaggctaaacattcccactacgttcattgtcaataaagagtgctatttacgctgcttgttatagtcgtttcgtggtc

SEQ ID NO: 1614 - DNA, 2915 bp, Triticum aestivum
ccgatcggggccgtactgctcgcctgcccacctccgccggagaggagcaggaagaggagcaatcgcccgtaccgggcctgcacgccatggcgcgcagcggagggggctgctgcccctccatggatctgatgcggtcggaggcgatgcagctcctgcaggtcatcatccccaccgagtccgcgcacctcgccgtctcccacctcggcgatctgggcctcatccagttcaaagacctcaacgcagacaagagcccgtttcaacgcacctatgctgcccagatcaaaaggtgtgctgaaatggcccgcaagctgcgattttttaaggaacaaatgtcgaaagctggaatactagtttctcctatgcaatcaaccgaaactcctctggattttgatgacatggaggtaaagcttggagaactggaagctgaactaactgaagtaaatgcaaacgatgaaaaattacaacgggcccacaatgagctactggagtacagtactgttcttcaaaaggctggtgagtttttctattcagctcaaagaagcgctgcagcacaacacaggcaaatggaagcaaatcagtctggtgagacttccctggagagtcctctgctggaacaggatatgttaacagatgcatcgaaacaagtgaaacttggctctttgagtggtcttgtgccaaaggaaaaggccatggcttttgaacgtatcttattccgtgccacgaggggcaacattttgctcagacaagagtctgttgatgaacctgtcactgatccgcaatccggagaaaaggtgtacaaaaatacatttgtcgtattctactctggggagagggcaaaggccaaaattctgaagatatgtgatgcttttcgtgcaaaccgttacccttttcctgaagaccttgctaaacaaacacatactgttcaggaggtatctggaaagatatcagagttaaaggcaacaattgacatgggattagctcatcgtgacagtatactcaaaactattgcatcagagtttgagcattggaaccatctggccaaaaaggaaaaatcaatttaccacactctaaacatgttgagcgttgatgtgacgaagaaatgcttagttggtgagggctggagtccagttttcgcagctaatcagattcaggatgcactaaagcgtgctactctcgagagcaaatcccaagttggctcgatttttcaggtccttaacacaaaagagtctcctccaacatatttccaaacaaacaaatttacctcagccttccaggaaattgttgacgcatatggagtagctaagtatcaagaagcgaatcctggtgtatacactattatcacttttcctttcttatttgctgtcatgtttggagattggggtcatggaatttgcatattacttgcgacactctatctgataatccgagagaagaaattcgcttcacagaaacttggagacataatggagatgatgtttggaggccgctacataattatgatgatgtcaattttctcaatctacacaggattaatatacaatgagtttttctccgttccatttgaactttttgctaaatcagcctatgcatgccgcgattcttcttgtagtgattctactactgaagggttaatcaaggtaagggatacttacccgttcggcgtggaccctgtgtggcatggtagtcgaagtgagctgccatttctcaactcactgaagatgaaaatgtcaattcttcttggagtgtcacaaatgaaccttggaatttttatgagttacttcaatgcgaaattcttcaggaacagtgttaatgtctggtaccagtttgttccccagctgatcttcttgaacagcttgtttggctacctatccatgcttatcatcattaagtggtgcacagggtcaaaagcagatctgtaccatgttatgatatatatgttccttagccccacagatgacatgggagagaaccagttatttcctggccagaaaactttacagcaagttttgcttctgcttgctctggtatctgttccctggatgctgattccaaagccatttttcttgaaatgggaacatgagcgaaggcatcaaggacatcagtacgccatgcttgagggtgcagatgaatcagttgtagcagagttgggggagcataatgaagaatcgaaccaccatgaggagtttgagttcagtgaaatatttgttcaccagctgatccatacaattgagtttgttcttggtgcagtctcaaatactgcttcatatcttcgtctctgggctctcagtcttgcacactcggagttgtccactgtgttctatgataaagttctccttctgacgttggggtacaacaatatttttatcctcgctattggtgtcgttgtcttcatctgcgccactgtcggtgtgttgcttgttatggagaccctaagcgcattccttcacgccttgaggctccattgggtggagttccagaacaagttctatgagggtgatggttacaagttcgcaccattctcgtttgctctaatcagtgaggatgaagagtgagctcgtccaaattcttgtatctattgtagtctctgtaatatcttgcgggtggccttgttgccagaacaatcattgtttgtcacggatcaatcataaaactccagccccttgttcgagcaagggaggtgcaacatcatttttctttagatgtggattacacgaagggtaggaatttttttgtggaggtttggcagcaaaactctagtggcatcacccttattttggtgtaatgctaataacgagttgtgcactcgtggttgcctttgggtgatgtgcattctggacataaataagcatgtaataaaaggttatttccattgtggttaaaaaaaaaaaaaaagccccctcggccgcgaccacgct

SEQ ID NO: 1615 - DNA, 2914 bp, Triticum aestivum
  misc_feature (464)..(464): n is a, c, g, or t
  misc_feature (642)..(642): n is a, c, g, or t
  misc_feature (647)..(647): n is a, c, g, or t
  misc_feature (665)..(665): n is a, c, g, or t
  misc_feature (750)..(750): n is a, c, g, or t
  misc_feature (905)..(905): n is a, c, g, or t
cctcgccccctccctgctccgcacgacgcgaagccgatcggggccgtactgctcgcctgcccacctccgccggagaggagcaggaagaggagcaatcgcccgtaccgggcctgcacgccatggcgcgcagcggagggggctgctgcccctccatggatctgatgcggtcggaggcgatgcagctcctgcaggtcatcatccccaccgagtccgcgcacctcgccgtctcccacctcggcgatctgggcctcatccagttcaaagacctcaacgcagacaagagcccgtttcaacgcacctatgctgcccagatcaaaaggtgtgctgaaatggcccgcaagctgcgattttttaaggaacaaatgtcgaaagctggaatactagtttctcctatgcaatcaaccgaaactcctctggattttgatgacatggaggtaaagcttggagaactggaagctgaactnactgaagtaaatgcaaacgatgaaaaattacaacgggcccacaatgagctgctggagtacagtactgttcttcaaaaggctggtgagtttttctattcagctcaaagaagcgctgcagcacaacacaggcaaatggaagcaaatcagtctggtgagacttccctggagagtcctctgntggancaggatatgttaacagangcatcgaaacaagtgaaacttggctctttgagtggtcttgtgccaaaggaaaaggccatggcttttgaacgtatcttattccgtnccacgaggggcaacattttgctcagacaagagtctgttgatgaacctgtcactgatccgcaatccggagaaaaggtgtacaaaaatacatttgtcgtattctactctggggagagggcaaaggccaaaattctgaagatatgtgatgcttttcgngcaaaccgttacccttttcctgaagaccttgctaaacaaacacatactgttcaggaggtatctggaaagatatcagagttaaaggcaacaattgacatgggattagctcatcgtgacagtatactcaaaactattgcatcagagtttgagcattggaaccatctggccaaaaaggaaaaatcaatttaccacactctaaacatgttgagcgttgatgtgacgaagaaatgcttagttggtgagggctggagtccagttttcgcagctaatcagattcaggatgcactaaagcgtgctactctcgagagcaaatcccaagttggctcgatttttcaggtccttaacacaaaagagtctcctccaacatatttccaaacaaacaaatttacctcagccttccaggaaattgttgacgcatatggagtagctaagtatcaagaagcgaatcctggtgtatacactattatcacttttcctttcttatttgctgtcatgtttggagattggggtcatggaatttgcatattacttgcgacactctatctgataatccgagagaagaaattcgcttcacagaaacttggagacataatggagatgatgtttggaggccgctacataattatgatgatgtcaattttctcaatctacacaggattaatatacaatgagtttttctccgttccatttgaactttttgctaaatcagcctatgcatgccgcgattcttcttgtagtgattctactactgaagggttaatcaaggtaagggatacttacccgttcggcgtggaccctgtgtggcatggtagtcgaagtgagctgccatttctcaactcactgaagatgaaaatgtcaattcttcttggagtgtcacaaatgaaccttggaatttttatgagttactttaatgcgaaattcttcaggaacagtgttaatatctggtaccagtttgttccccagctgatcttcttgaacagcttgtttggctacctatccatgcttatcatcattaagtggtgcacagggtcaaaagcagatctgtaccatgttatgatatatatgttccttagccccacagatgacatgggagagaaccagttatttcctggccagaaaactttacagcaagttttgcttctgcttgctctggtatctgttccctggatgctgattccaaagccatttttcttgaaatgggaacatgagcgaaggcatcaaggacatcagtacgccatgcttgagggtgcagatgaatcagttgtagcagagttgggggagcataatgaagaatcaaaccaccatgaggagttcgagttcagtgaaatatttgttcaccagctgatccatacaattgagtttgttcttggtgcagtctcaaataccgcttcatatcttcgtctctgggctctcagtcttgcacactcggagttgtccactgtgttctatgataaagttctccttctgacgctggggtacaacaatatttttatcctcgctattggtgtcgttgtcttcatctgcgccactgtcggtgtgttgcttgttatggagaccctaagtgcattccttcacgccttgaggctccattgggtggagttccagaacaagttctatgagggtgatggttacaagttcgcaccattctcgtttgctctaatcagtgaggacgaagagtgagctcgtccaaattcttgtatctattgtagtctctgtaatgtcttgcgggtggccttgttgccagaacaatcattgtttgtcacggatcaatcataaaaccccagccccttgttcgagcaagggaggtgcagcatcatttttctttagatgtgtattacacgaagggtaggaatttttttgtggacgtttggcagcaaaactctagtggcatcacccttatttcggtgtgatgctaataacgagttgtgcactcgtggttgccgtttgggtgatgtgcattctggacataaataagcatgtaataaaaggttatttccattgtggttaaa

SEQ ID NO: 1616 - DNA, 3029 bp, Zea mays
cgcgtaacccacatggtccacaaccccccggctgtctctacctccttcctcgctcacctcctcacgacgtgaggaatcgatcaggccaccgccgtacccgtcggagatccgctccgcccgcgcgatttcgatccgaaacacctcgtcggatcttcagggatctgactgaggggcagcgcgccggctgctgacacggcgggcacgcgcgcagccagccatggcgcgtggtggcggaggcggctgctgcccgccaatggatctgatgcgatcggaggcgatgcagctggtgcaggtcatcatacccgctgagtcagcgcacctcaccgtctcctacctcggagacctcggcctcctccagttcaaagaccttaatatagataagagcccgtttcaacggacatatgctgcccagattaaaaggtgtagtgaaatggctcgtaaattaaggttttttaaggagcagatgtcaaaagctgacataacagcctctcctacacaactaaatggaactcatatggattttgatgaattggagataaagcttggagaactggaagctgagctaactgaagttaatgcaaacaatgaaaaattacagaggacctataatgagctattagagtaccatactgttctccaaaaggctggtgaatttttctattcagctcaaagaactgctgcagcgcaacaaatggaaatggaggcaaatcaatctggtcaaacttcactggagagccctctgttggaacaggagatgacaactgatccatcaaaacaagtgaagcttggctcattgagtggacttgttccaaaggaaaaggcaatggcttttgaacggatcttattccgtgccacaaggggtaacattttccttaggcaagagcctgttgatgagccagtcactgatccagtttctagggagaaggtaacgaaaaatgcatttgtcatattctactctggagagagagcaaaaaccaaaattctgaagatatgtgatgcctttaatgcgaaccgttacccgtttccagaagatgttggcaaacaacttcatgctgttcaggaggtatctgggaagatctcagagttgaagacaacaattgacatgggtttagctcatcgtgacagtatactaaaaaatattgcttctgattttgaacagtggaaccatctggtcaaaaaggaaaaggcaatttatcacaccttgaacatgctaagtgttgatgttacgaagaaatgtttagttgctgagggctggagtccaatttttgcaagcattcagattcaagacgctcttcagcgtgctactcttgatagcaaatcccaagttggctcaatatttcaagttctcaacacaaaagaatctcctccaacatatttccagacaaataaatttacttcagcgttccaggaaattgttgatgcgtatggtgtagccaagtatcaagaagcaaatcctggagtattcaccattgtgactttccctttcttatttgctgtcatgtttggtgattggggccatggaatttgcttgttacttgcaacactctatcttataatccgggagaagaaactagcttcacagaaacttggagacataatggagatgatgtttggtgggcgttatgtaattatgatgatggcagttttttcaatctacacaggattaatatacaatgaatttttctctgttccatttgggcttttcggtaaatctgcctatgcatgccgtgattcttcttgcagtgatgctactaccgaaggacttcttaaagtaagagatgcatacccttttggtgtggaccctgtctggcatggtagccgcagtgagctaccgtttctcaactcactgaagatgaagatgtcgattcttcttggagttgcacaaatgaaccttgggattgtgattagttacttcaatgcaaaatttttcaggaacagtattaatgtgtggtaccagttcattccccagctgatcttcttgaacagcttatttggctacctgtccttgctcattattattaagtggtgcacggggtcgaaagcagatctataccacgttatgatctacatgttccttagcccaacagatgatcttagtgagaaccagttgtttagtggccagaagacagtgcagcttgttctacttctgcttgctttagtgtctgtaccttggatgttgattccaaaacctcttcttttgaagaaacaacatcagcaaaggcatcaaggtcaccagtacgctatgcttcagggcattgatgaatcagtgggagcagaattgggggaacatcatgaggacgcacatgaccacgaggagtttgagttcggtgaagtttttgttcaccaactgattcacacgatagaatttgttctgggtgcagtctcaaacaccgcttcataccttcgtctttgggctctgagtcttgcacactctgagttgtccactgtattctacgagaaagtactaatgacggcatatgggtttaacaatgttttcatccttattattggtgtcgtcatcttcatctttgccacgattggtgtcttgcttgttatggagaccctgagtgcattccttcacgcgctgaggcttcactgggtggagttccagaacaagttctatgaaggtgatggctacaagtttgccccattctccttcgcgctgattcgtgaggaggaagattgagcttgtctcaacatttgtatttattgtagccgataaaaaatctttggtggtctttgttcccagaccaaatcattttttcatctgttgtgtcggatgtggatcataaaccaccgtccctttgtttaaactgggacgaacagcatcatttttccttagctatgcagaggattcttgggttggttggcaacagatatggggtgatgtcacccttgtatgatgctaataagtagttgccgattgggcggtgtgttggatataaataagcactgtattgaaggttagacaatctccatcacgttcattgtcaataaaataaagagtgctatttacgctgctggtgtta

SEQ ID NO: 1617 - DNA, 2978 bp, Zea mays
acctcctcacgacgtgaggaatcgatcaggccaccgccgtacccgtcggagatccgctccgcccgcgcgatttcgatccgaaacacctcgtcggatcttcagggatctgactgaggggcagcgcgccggctgctgacacggcgggcacgcgcgcagccagccatggcgcgtggtggcggaggcggctgctgcccgccaatggatctgatgcgatcggaggcgatgcagctggtgcaggtcatcatacccgctgagtcagcgcacctcaccgtctcctacctcggagacctcggcctcctccagttcaaagaccttaatatagataagagcccgtttcaacggacatatgctgcccagattaaaaggtgtagtgaaatggctcgtaaattaaggtttttttaaggagcagatgtcaaaagctgacataacagcctctcctacacaactaaatggaactcatatggattttgatgaattggagataaagcttggagaactggaagctgagctaactgaagttaatgcaaacaatgaaaaattacagaggacctataatgagctattagagtaccatactgttctccaaaaggctggtgaatttttctattcagctcaaagaactgctgcagcgcaacaaatggaaatggaggcaaatcaatctggtcaaacttcactggagagccctctgttggaacaggagatgacaactgatccatcaaaacaagtgaagcttggctcattgagtggacttgttccaaaggaaaaggcaatggcttttgaacggatcttattccgtgccacaaggggtaacattttccttaggcaagagcctgttgatgagccagtcactgatccagtttctagggagaaggtaacgaaaaatgcatttgtcatattctactctggagagagagcaaaaaccaaaattctgaagatatgtgatgcctttaatgcgaaccgttacccgtttccagaagatgttggcaaacaacttcatgctgttcaggaggtatctgggaagatctcagagttgaagacaacaattgacatgggtttagctcatcgtgacagtatactaaaaaatattgcttctgattttgaacagtggaaccatctggtcaaaaaggaaaaggcaatttatcacaccttgaacatgctaagtgttgatgttacgaagaaatgtttagttgctgagggctggagtccaatttttgcaagcattcagattcaagacgctcttcagcgtgctactcttgatagcaaatcccaagttggctcaatatttcaagttctcaacacaaaagaatctcctccaacatatttccagacaaataaatttacttcagcgttccaggaaattgttgatgcgtatggtgtagccaagtatcaagaagcaaatcctggagtattcaccattgtgactttccctttcttatttgctgtcatgtttggtgattggggccatggaatttgcttgttacttgcaacactctatcttataatccgggagaagaaactagcttcacagaaacttggagacataatggagatgatgtttggtgggcgttatgtaattatgatgatggcagttttttcaatctacacaggattaatatacaatgaatttttctctgttccatttgggcttttcggtaaatctgcctatgcatgccgtgattcttcttgcagtgatgctactaccgaaggacttcttaaagtaagagatgcatacccttttggtgtggaccctgtctggcatggtagccgcagtgagctaccgtttctcaactcactgaagatgaagatgtcgattcttcttggagttgcacaaatgaaccttgggattgtgattagttacttcaatgcaaaatttttcaggaacagtattaatgtgtggtaccagttcattccccagctgatcttcttgaacagcttatttggctacctgtccttgctcattattattaagtggtgcacggggtcgaaagcagatctataccacgttatgatctacatgttccttagcccaacagatgatcttagtgagaaccagttgtttagtggccagaagacagtgcagcttgttctacttctgcttgctttagtgtctgtaccttggatgttgattccaaaacctcttcttttgaagaaacaacatcagcaaaggcatcaaggtcaccagtacgctatgcttcagggcattgatgaatcagtgggagcagaattgggggaacatcatgaggacgcacatgaccacgaggagtttgagttcggtgaagtttttgttcaccaactgattcacacgatagaatttgttctgggtgcagtctcaaacaccgcttcataccttcgtctttgggctctgagtcttgcacactctgagttgtccactgtattctacgagaaagtactaatgacggcatatgggtttaacaatgttttcatccttattattggtgtcgtcatcttcatctttgccacgattggtgtcttgcttgttatggagaccctgagtgcattccttcacgcgctgaggcttcactgggtggagttccagaacaagttctatgaaggtgatggctacaagtttgccccattctccttcgcgctgattcgtgaggaggaagattgagcttgtctcaacatttgtatttattgtagccgataaaaaatctttggtggtctttgttcccagaccaaatcattttttcatctgttgtgtcggatgtggatcataaaccaccgtccctttgtttaaactgggacgaacagcatcatttttccttagctatgcagaggattcttgggttggttggcaacagatatggggtgatgtcacccttgtatgatgctaataagtagttgccgattgggcggtgtgttggatataaataagcactgtattgaaggttagacaatctccatcacgttcattgtcaataaaataaagagtgctatttacgctgctggtgttaatc

SEQ ID NO: 1618 - DNA, 2980 bp, Hordeum vulgare
ggggccctgcgcgtatcggtccctccccgcccagccacgtctcggcataatagcacatggtcgacaggacccggcctgtctcatcctcctctcgccccctccctgctccgcacgacgcgaaaccgatcggggccgcgctgctcgccgcccgcccatccccgccggagaggaggaggaggaggaggagccttcgcccgccgcgggcctgcacgccatggcgcgcagcggagggggctgctgcccctcgatggatctgatgcggtcggaggcgatgcagctcctgcaggtcattatccccaccgagtccgcgcacctcgccgtctcccacctcggcgatctgggcctcatccagttcaaagacctcaacgcagacaaaagcccgtttcaacgcacctacgctgcacagatcaaaaggtgtgctgaaatgtcccgcaagttgagattttttaaggaacagatgtcgaaagctggaatacaagttcctcccatgcaatcaaccgaaactcctctagattttgatgacatggaggtaaagcttggagagctggaagctgaactaactgaagtaaatgcaaacgatgaaaaattacagcgagcccacaacgagctactggagtacagtactgttcttcaaaaggctggtgagtttttctattcagctcaaagaagcgctgcagcacaacacaggcaaatggaagcaaatcagtctggtgagacttccctggagagtcctctgttggagcaggatatgttaacagatgcatcgaaacaagtgaaacttggctctttgagtggtcttgtgccaaaggaaaaggccatggcttttgaacgtatcttattccgttctacaaggggcaacattttgcttagacaagagtctgttgatgaacctgtcactgatccgcaatccggagaaaaggtgtccaaaaatacatttgtcgtattctactctggggagagggcaaaggccaaaattctgaagatatgtgatgcttttcgtgcaaaccgttacccttttcctgaagaccttgctaaacaaacacatactgttcaggaggtagctggaaagatatcagagttaaaggcaacgattgacatgggattagctcatcgtgacagtatactcaaaactattgcatcagagtttgagcattggaaccatctggcaaagaaggaaaaatcaatttaccacactctgaacatgttgagcgttgatgtgacgaagaaatgcttagttggtgagggctggagtccagttttcgcaactaatcaggttcaggatgcacttcagcgtgctactcttgagagcaagtcccaagttggctcgatttttcaggttcttaacacaaaagagtctcctccaacatatttccagacaaacaaatttacctcagcattccaggaaattgtcgacgcatatggggtagccaagtatcaagaagcgaatcctggtgtatacactattatcacttttcctttcttattcgctgtcatgtttggagattggggtcatggaatctgcatattacttgcaacactctatctgataatccgagagaagaaattcgcttcacagaaacttggagacataatggagatgatgtttggaggccgctacataattatgatgatgtcaattttctcaatctacacaggattaatatacaatgaatttttctctgttccatttgaactttttgctaaatcagcctatgcatgccgcgattcttcttgtagtgattctactactgaaggattaatcaaggtaagggatacttacccgtttggcgtggaccctgtgtggcatggtagtcgtagtgagctgccatttcttaactcactgaagatgaaaatgtcaattcttcttggagtgtcacaaatgaaccttggaatttttatgagttacttcaatgcgaaattcttcaggaacagtgttaatgtctggtaccagtttgttccccagctgatcttcttgaacagcttgtttggctacctatccatgcttatcatcattaagtggtgcacagggtcaaaagcagatctgtaccatgttatgatatatatgttccttagccccacagatgagatgggagagaaccagttatttcctggccagaaaactgtacagcaagttttgcttctgcttgctctcgtatctgttccctggatgctgattccaaagccatttttcttgaaatgggaacacgagcgaaggcatcaaggacatcagtacgccatgcttgagggtgcagatgaatcagttatagcagagttgggggaccataatgaagaaccgaaccaccatgaggagttcgagttcagtgaaatatttgttcaccagctgatccatacaattgagtttgttcttggtgcagtttcaaataccgcttcataccttcgcctctgggctctcagtcttgcacactcggagttgtccactgtgttctatgataaagttctcattttgacgctggggtacaacaacattttaatccttgctattggtgtcgttgtcttcatctgcgctactgtcggtgtgttgcttgttatggagaccctaagtgcattccttcatgccttgaggctccactgggtggagttccagaacaagttctatgagggtgatggttacaagttcgcaccattctcgtttgcgctaatcagtgaggacgaagagtgagctcgtccaaattcttgtatctattgtagtctctgtaatatcttgcgggtggccttgttgccagaacagtcattatttgtcacggatcaatcataaaaccccagccccttgttcgaatgagggtggtgcagcatcatttttctttagatgtggattacacgaagggtaggaatttttttgtggacgtttggcaacaaaactctagtggcattacccttattttggcgtaatgctaataacgagttgtgtactcgtggttgctctttggatgatgtgcattctggatataaataagcatgc

SEQ ID NO: 1619 - DNA, 2837 bp, Setaria italica
gggggcgggggcgggcgctgcccgccgatggatctgatgcggtcggaggcgatgcagctggtgcaggtcatcatacccgccgagtccgcgcacctcaccgtctcctaccttggcgacctcggcctcatccagttcaaagaccttaatgcagagaagagcccatttcaacggacatatgctgcccagatcaaaaggtgtagtgaaatggctcgcaagttgaggttttttaaggagcagatgtcaaaagctaacatatcaccctctcctacacaactaaatgaagctcatctggaatttgatgacttggagataaagcttggagaactggaagctgagctaactgaagttaatgcaaacaacgaaaagttacagcggacctataatgagctgttagagtacaataccgttctccaaaaggctggtgaatttttctattcagctcaaagaagcgctgcagcacaacaaagggaaatggaggcaaatcaatctagtcaaacttcactggagagccccctgttggaacaggagatgtcaacagatccatcaaaacaagtgaagcttggctcattgagtggtcttgtgccaaaggaaaaggcgatggcttttgagcggatcttattccgtgccaccaggggtaacatattccttagacaagagcctattgatgagcctgtcacagatccagtttctggggagaaggtagcgaaaaatgcatttgttattttctactctggagagagatcaaaagccaaaattctgaagatatgtgatgcctttaatgcaaatcgttacccattcccagaagatgttaccaaacaacttcatgctgttcaagaggtatctggaaggatctcagagttgaaggcaacaattgacatgggcctagctcatcgtgacagtatactcaaaagtattgcatctgattttgagcagtggaaccatctggcaaagagggaaaaagcaatttatcacactttaaatatgttgagtgttgatgtaacgaagaaatgcctagtcgccgagggctggagtcctgtttttgctagcgttcagattcaagatgctctccagcgtgctactgttgatagcaaatcccaagttggctcaatctttcaaattctcaacacaaaagaatcccctccaacatatttccagacaaacaagttcacaacagcgttccaggaaattgttgatgcgtatggggtagccaaatatcaagaagcaaatcctggagtattcaccattgtcactttccctttcttatttgctgtcatgtttggcgattggggccatggaatttgcttgttacttgggacactatttctgataatccgggagaagaaactagcttcacagaaacttggagatataacggagatgatgtttggtgggcgttatgtaattatgatgatgtccattttttcaatctacacgggattaatatacaacgaatttttctctgtcccatttgagcttttcggtaaatctgcctatgcgtgccgtgatccgtcttgtagagattccactactgaaggattgattaaggtaaggggtacatacccttttggtgtggaccctgtctggcatggtagccgcagtgagctgccatttctgaactcactgaagatgaagatgtcaatccttcttggagttgcacaaatgaaccttggaattgtgatgagctacttcaatgcaaagtttttcaggaacagtattaatgtgtggtaccagttcattccccagctgattttcttgaactttggttacctgtccttgcttatcattattaagtggtgcacggggtcaaaagcagatctgtaccatgttatgatctatatgttccttagcccaacagatgagcttggggagaaccagttatttagtggccagaagacggtgcagcttgttttgcttctacttgctttggtgtccgtgccttggatgttgattccaaagccagttctattgaagaagcaacatgagcgaaggcatcaaggtcaccaatacgctatgcttcagggcaccgatgaatcagtgggagcagagttgggggaacatcatgatgaatcacatgaccatgaggagtttgagtttagtgaagttttcgttcaccaactgatccacacaatcgaatttgttcttggtgccgtctcaaacacagcttcgtaccttcgtctttgggctctgagtcttgcacactcggagttgtccactgtattctacgataaagttctcatgttaacgtggaggatgaacaatgttgttgcccttattcttggcgtcatcatcttcatctttgccacgattggtgtcttgcttgttatggagactctgagtgcattccttcacgcgttgaggcttcactgggtggagttccagaacaagttttacgaaggtgatggttacaagtttgcaccattctctttcgcgctgatccgtgaggaggaagattgagctcatcggaacatttgtatttattgtagccgttgtaaaatcttgggtggcctttgttcccagaacaatcattttttcatctgttgtcttggaaggatcataaacctccagtcccttgtttaagcgtgggatgaaactgcatcatttttccttccttattattagctacgaagagtgcagggggatttttgggttggttggcaacacatctggggtgatatcacccttgtatgatgctaataagtagttgccgattgggcgatgtgtatgttggatataaataagcactgtatcgaaggttgaacattccattgtgtccattgccaataaaaagtgctatttatatccaacatacacatcgcccaatcggcaactacttatta

SEQ ID NO: 1620 - DNA, 2881 bp, Avena sativa
tcctccctgctccgcacgacgcgaaaccgatcgaggccaagtcgcctgcgcccgccggagaggaggaggaccttcgcccgccccggaaccgcacgccatgccgcgcggcggagggggctgcttgcccccgatggatctgatgcggtcggaggcgatgcagctgctgcaggtcatcatccccaccgagtccgcgcacctcgccgtctccaatctcggcgaactcggactcatccagttcaaagatctcaatgcagacaagagcccgtttcaacggacattcgctgcccagatcaaaaggactggtgaaatggctcgcaaactgaggtattttaaggaacaaatgtcgaaagctggcatacaagtttctcccctgcaatcgaccgaaactgctctggattttgatgacatggagataaaacttggagaactggaagctgaactaattgaagttaatgcaaacgatgaaaagttacagcggacctacaatgaactgatggagtacagtactgttcttcgaaaggctggtgaatttttctattcggctcaaagaagcgctgcagcacaacagacagaactaggagcaaaccagtctggttctggtgagacttcactggagagtcctctattggagcaggatatgtttacagatgcatcgaaacaagtgaaacttggctctttgagtggtcttgtgccaaaggaaaaggcaatggcttttgaacgtatcttattccgtgcaacaaggggcaacattttgctcagacaagaatctgttgatgaacttgtcactgatccacaatctggagaaaaggtttccaaaaatacattcgtcgtgttctactctggggagagagcaaaagccaaaattttgaagatatgtgatgcttttcgtgcaaaccggtacccttttcctgaagaccttgctaaacaaatgcataccattgaggaggtatctggaaagataaaggagttgaaggcaacaattaacatgggactggctcatcgtgacactatacttaaatctattgcatcggagtttgagcactggaaccatgtgacaaaaaaggaaaaatcaatttaccacactttaaacatgttgagtgttgacgtgacgaagaaatgtttagttggtgagggctggagtccagttttcgcaactaatcaggttcaggatgcgcttcagcgtgctactcttgagagcaaatcccaagttggctcaatttttcaagttcttaatacaaaagaatctcctccaacatatttccagacaaacaaatttacttcagccttccaggaaattgttgatgcatatggggtagctaagtatcaagaagcaaatcctggcgtatttactgttgtcacgtttcctttcttatttgctgtcatgtttggagattggggtcatggaatttgcttattacttgcaacactctatctgataatccgggagaagaaatttgcttcacagaaacttggagatataatggagatgatgtttggaggacgctatatcattatgatgatggcacttttctcaatctacacaggatttatatacaatgaatttttctcagttccatttgagctttttgctaaatcagcctatgcatgccgtgatccttcttgtggtgatgctactactgaaggattaattaaagtaaggccgacatacccatttggtgtggaccctgtgtggcatgggagtcgtagcgagctgccgtttctcaactctctcaagatgaaaatgtcaattcttcttggagtttcacaaatgaaccttggaattatgatgagttactttaatgcgaaattcttcaggaataatgttaatatcttctaccaattcattccccagctgctcttcttgaacagcctgtttggctatctgtccatgcttatcatcattaagtggtgcacagggtcaaaagcagatctgtaccatgttatgatctatatgttcctcagccccacagatgacatgggtgagaacgagctatttcctcaccagaagtacgtgcagcaggctttgcttgtgattgctttgatatctgttccatggatgctgattccaaagccatttatcttgaagaacgaacatgagcgaagacatcaaggacaccaatatgcccagcttgagggtgcagatgaatcagtgatagcagagttgggggtacatcatgaagagtcaaaccaccatgaggagttcgagttcagtgaagtttttgttcaccagttgatccatacaattgagtttgttcttggtgcagtctcaaatactgcttcatatcttcgtctctgggctctaagccttgcgcattcggagttgtccactgtgttctacgataaagtactccttctgacgttgggatacaacaacattatcatcctcgctattggggttgtcatcttcatctttgccactgttggcgtgttgcttgttatggagacccttagtgcattccttcatgccttgaggctccattgggtggagtaccagaacaagttctatgagggcgatggttacaagtttgcaccattttcatttgcactgatcagtgatgaagaagagtgaactcgtccagattcatgtatttattgtagtctttgtaatattggggtggcgtttgttgccggaacaatcattatttgtcacggaagaatcataaaactccagctccttgttttctagcaagggacgctcagcgtcatttttctttagatgtggattacacggaggataggattttttttgtggagggttggcaacaactctagtggcatcacccttatttcggtgtaatgctaataacgagttttgtactcgaagttgccgtttgggtgctgtgtattttggacataaataagaatgtaataaaaagttatt

SEQ ID NO: 1621 - DNA, 2865 bp, Oryza sativa
gagttcaccgtcagccgggccaccgcgatgtcgcgcggcggcggcgggtgctgcccgtcgatggatctgatgcggtcggaggcgatgcagctggtgcaggtcatcatcccggcggagtccgcgcacctcgccgtctcctacctcggcgacctcggcctcctccagttcaaagaccttaatgccgacaaaagcccattccagcggacttatgcttcccagatcaagaggtgtggtgaaatggctcgcaagttgcggttttttagggaacaaatgtcaaaagctgccatagcaacttctacacaattttcagggacttctttggaaattgatgatttagaggtcaaacttggagaactagaagttgagctgactgaagttaatgcaaataatgacaagttacagaggacatacaacgagctggtggagtacaacattgttctgcagaaggctggtgaatttttctattcagctcaacgaagtgcaacagaacaacagagggaaatgtcagcagatcaatctggcgattcttctctggagagtcctttattgcagcaggaaatggtgacagatccatcaaaacaagtgaagcttggttccctgagcggtcttgtgccgaaggaaaaggctatggcctttgaacgcatacttttccgtgctactaggggtaacatgttccttagacaagaacctgtcgatgaaactgtcactgatccattatctggagaaaaggtcattaaaaatgcatttgttatattctactctggggagagagcaaaatccaagattgtgaaaatatgtgatgcttttggtgccaaccgttacccatttccagaagatctaggcaaacagctgcagactattcaggaggtatctggaaaaatatcagagttgaaggcaactattgaaataggtttagctcaccgtgacagcatacttaaaaatatttcttccgagtttgagcaatggaacaccctggtaaagaaagaaaaagctatttaccacacattaaacatgttgagtcttgatgtgacaaagaaatgcttggttgctgagggatggagtccggtgtttgcaacaagtcagatccaagatgcacttcagcgtgctactgttgatagcaaatcccaagttggttcaattttccaagttctcaacacacaagaatctcctccaacatttttccagacaaataaatttacttctgcattccaggagattgtggatgcctatgggattgccaagtatcaagaagcgaatcctggtgtctttaccattgtaacatttcctttcttatttgctatcatgttcggagactggggccatggaatttgtttactacttgcaacactgtacctcataatcagagagaagaagctagcttcacagaaactggatgatataatggatatgatgtttggtggtcgctacgtgattttgatgatgtcactcttttcaatttacactgggttgatatacaacgaatttttctcagtcccatttgaactctttggtaaatctgcctatgcgtgccgtgatccttcttgtggagatgctactacagaaggattaattaaggtgaggccagcatattcgtttggcgtcgatcctgtatggcatggtagccgcagtgagctgccttttcttaactccttgaagatgaagctgtctattcttattggagttgcacaaatgaaccttggaataatgatgagttactttaacgcaaagtttttcagaaatgctattaatgtttggtatcagtttattcctcagctgatattcttgaacagcttatttggttacctttcactcctcatcattattaagtggtgcacgggctcaaaagctgacctttaccatgtgatgatatatatgttcctgagtccaactgatgatcttggggagaacgagctatttcctgggcagaaactagtgcagcttgtactacttctgcttgctctggtttctgtgccttggatgctgattccgaaaccatttttcctgaagaagcaacatgagcagaggcaccaaggccagcagtacaccatgcttcaggccactgatgaatcagtgacagagctagaagaacaccaggatgaccctcaccaccatgaggagtttgaattcagtgaagtctttgttcaccagctgatccacacaattgagtttgtgctcggtgcagtctcaaatacagcctcttaccttcgtctttgggctcttagtcttgcacactcggagctgtccactgtcttctacgagaaagttcttgttctatcatgggggtacaataacattttcatcctgatcattggagcagtgatctttctctttgccactattggtgtcttacttgtgatggagaccctaagtgcattcttgcatgctctgaggctccactgggtggagttccagaacaagttttacgagggtgatggatacaagtttgtaccctttgctttcgcatcaatcatcgaggaggaagattgaatctgaattgttgtatgtaatctagaatgtaaaatcgtaagagtccttcccttgaataatcattgtttatcaccattggtgaagattcagaaaaccccagttcgttgtgtctgagcaggggatgccaaatcattcttttttgcctacacgattagccatgctaggttattctgtatattatgatctgttattactttgagcggtgacaggagcggctgggacgaagttgcaaataagtctagtgcatagcataactgcctttttacatggtgctatgttaataaaagttctgtactcatggctgtgacacgagtgatgtgtcttttgaattacacttgtggaaataaataagttccattctttgtgattattatttca

SEQ ID NO: 1622 - DNA, 2659 bp, Brachypodium distachyon
gatgtcgcgcggcggcggcggcggcggcgggtgctgcccgccaatggatctaatgcggtcggaggcgatgcagctggtgcaggtcatcatccccgccgagtcagcgcgcctcgtcgtctccaacctcggcgacctcggcctcgtccagttcaaagaccttaatggggataagagcccattccaacgggcttatgccgcccagatcaagaggtgtggtgaaatggctcgcaagttgcgatttttcaaggaacaaatgttgaaagctgcgatattgactggtgcgacacaattttcaggaagtcctttggaaattgatgacctggagataaaacttgaggaatttgaagctgatctaattgaagtaaatagaaataacggaaagttgcagaggacatacaatgagctcgtggagtacaatgttcttctaaaaacgattggtgattttttctattcagctcaaagaagtgcgacacggcaacagagggaaatggtggcagatcagtctggcgactcttctctggagagtcctttattagagcaggaaatggtgatagatccatcaaaacaagtgaagcttggttccctgagtggtcttgtgccaaagcaaaagtccatggcctttgaacgcatacttttccgtgccacaaggggcaacatgttactccgacaagaatctgttgatgaacctgtcactcatccacagtctggagagaaggtcgtgaaaaattcatttgtcatattctactctggggagagagcaaaatcaaagattgtgaaaatttgtgattcttttggcgccaaccgttatccatttccagaagacctcgctaaacaaacacagactattcaggaggtatctggaaaaatatcagagttgaaggcaactattgaaataggtttagctcatcgtgacagcatccttaaaaatattgcctatgaatttgaacaatggagtaacttgttaaagaaggaaaaagctatttaccacaccttaaacatgttcagtcttgatgtaacaaagaaatgctttgttgctgagggatggagtccagtttttgccacagatcaggtccaagatgcacttcatcgtgctactactgacagcaactcccaagtaggttcgattttccaagttctcaacacgcaagagtctcctccaacgtatttccagacaaataaatttacttcctcattccaggacattgtcgatgcctacggtattgccaagtatcaagaagcaaatcctggtttatttactatcgtaacatttcccttcttatttgctgtcatgtttggagactggggtcatggaatttgtctactacttagtgcactgtacctcgtaatccgagaaaagaagctagcttcacagaaactcgatgatatagtggagataatgtttggtggtcgctatgtaattttgatgatgtccctattttcaatttacactggattaatatataatgaatttttctcggtgccatttgagctatttggtaaatctgcctatgcatgccgtgatccttcttgtgtggatgctacaagtgaaggattaataaaggttaggcaaacatacccatttggtgttgatcctgtatggcatggtagccgcagcgagctgccatttctcaactccctaaagatgaagatgtcaatccttattggagtttcacaaatgaaccttggaattgtgatgagtttctttaatgcgaagtatttcaaaaattctgttaatgtttggtaccagtttgttcctcagctgatattcttgaacagcttatttggttacctatcactcctcatcattattaagtggtgcacaggctcaaaagctgacctttaccatgtaatgatatatatgttccttggtccaactgatgatattggggagaaccagctatttcctggacagaaaattgttcagattgttctacttctacttgctctggtgtccgtgccgtggatgttgattccgaagccattattcttgaaaaagcaacatgagcagagacaccaaggccagcagtacaccatgatccaggccacaactgaatcagtaacgggattgcaaagacaccacgaaaacccacaccaccacgacgagtttgaattcagtgaggtttttgttcaccagctgatccacacaattgagtttgtgctgggtgcagtctcaaatactgcctcataccttcgcctttgggctctcagtcttgcacactcggagctgtccagtgtcttctatgacaaagttcttcttctagcatggggatacaataacattaccatccttgttgttggagtaatcgtctttctctttgccactattggtgttttgctttccatggagacccttagtgcattcctgcatgccttgaggctccactgggtcgaattccagaacaaattttacgagggtgatgggtacaaatttgcacccttcgcattcgcgtcgatcatcgaggaggaagattgagtcccactcgttgtatgtatattgtataataatgtaagatcctatgaggactttccgccgtggatcatcattgttcattcaccattacaggaagattcagaaaatttgtgctcttgggtcagagaatggtacgctgaatcatgcatcttgcatttgattagcgacagtaggttattctgtaaattg

SEQ ID NO: 1623 - DNA, 2777 bp, Pennisetum glaucum
ggcgcgcggtggcgggggcgggtgctgcccgccgatggatctgatgcggtcggaggcgatgcagctggtgcaggtcatcatacccgccgagtccgcgcacctcaccgtctcctaccttggcgacctgggcttcatccagttcaaagaccttaatgcagagaagagcccatttcaacggacatatgctgcccagatcaaaaggtgtagtgaaatggctcgcaagttgaggttttttaaggagcagatgtcaaaagctgacatatcaccctctcctacacaactaaatgaagctcatctggaatttgacgacctggagataaagcttggagaactggaagctgagctaactgaagttaatgcaaacaatgaaaagttacagcggacgtacaatgagctgttagagtacaatactgttctccaaaaggctggtgaatttttctattcagctcaaagaagcgctgcagcacaacaaagggaaatggaggcaaatcaatctagtgaaacttcactggagagtcccctgttagaacaggagatgtcaacagatccatcaaaacaagtgaagcttggctcattgagtggtcttgtgccaaaggaaaaggcaatggcttttgagcggatcttattccgtgccaccaggggtaacatattccttagacaagagcctattgatgagcctgtcacagatccagtttctggggagaaggtagcgaaaaatgcatttgtaatattctactctggagagagagcaaaagccaaaattttgaagatatgtgatgcctttaatgcaaatcgttacccatttccagaagatgttactaaacaacttcatgctgttcaagaggtatctgcaagaatctcagagttgaaggcaacaattgacatgggcctagctcatcgtgacagtatactaaaaaatatagcatctgattttgagcagtggaaccatctggcaaagagggaaaaagcaatttaccacactttaaatatgtttagtgttgatgtaacaaagaaatgcctagtagctgagggctggagtcctgtttttgcaagcgttcagattcaagatgctctccagcgtgctactgttgatagcaaatcccaagttggctcaatctttcaagttctcaacacaaaagaatatcctccaacatatttccagacaaacaagtttacatcagcattccaggaaattgttgatgcgtatggggtagccagatatcaagaagcaaatcctggagtattcaccattgtcactttccctttcttatttgctgtcatgtttggtgattggggccatggaatttgcatttttctcgcgacactatatctgataatccgggagaagaaactagcttcacagaaacttggagacatgatggagatgatgtttggtgggcgttatgtaattttgatgatgtccctcttttcaatctacacgggattaatatataacgaatttttctctgtcccgtttgagcttttcggtaaatctgcctatgcatgccgtgatccgtcttgtagagattctactactgaaggattaattaaggtaaggggcacatacccttttggtgtggaccctgtctggcatggtagccgtagtgagctgccatttctgaactcactgaagatgaagatgtcaatccttcttggagttgcacaaatgaaccttggaattgtgatgagctacttcaatgcaaagttcttcaggaacagtattaatgtgtggtaccagttcattccccagctgattttcttgaacagcttatttggttatctgtccttgcttatcattattaagtggtgcacggggtcaaaagcagatctgtaccatgttatgatctacatgtttcttagcccaacagatgagcttggggagaaccaattgtttagtggccagaagacagtgcagcttgttctgcttctacttgcttttgtgtccgtgccttggatgttgattccaaagccatttctattgaagaagcaacatgagcgaaggcatcaaggccaccaatacgctatgcttcagggtactgatgaatcagtgggagcagagttgggagaacatcatgatgagtcgcatgaccatgaggagttcgagtttagcgaagttttcgttcaccaactgatccacacaatcgaatttgttcttggcgcagtctcaaacacagcttcataccttcgtctttgggctctgagtcttgcacactcggagttgtccacggtattctatgataaatttttgctcttattgctggcgtcatcatcttcatctttgccacgattggtgtcttgcttcttatggagactctgagtgcattccttcacgcgctgaggcttcactgggtggagttccagaacaagttttacgaaggtgatggttacaagtttgcaccattctctttcgcgctgatccgtgaggaggaagattgagctcgtcggaccatttgtatttattgtagccgttgtaaagtcttgggggttcccagaacaatcattttttcatctgttgtcttggaaggatcataaacctcctgccccttgtttaagcgtgggacgaaactgcatcatttttcccctgttttagctacgaagattgcagggggatttttttggttggttggcaacacatcttgtatgatgctaataagtagttgccgattgggcgatgtgtatcttggatataaataagcactgtatcgaaggttaaacattccattgtatccattgccaataaaaagtgctatttgcgttgcgaaaaaaaaaaaaaaaaa

SEQ ID NO: 1624 - DNA, 2808 bp, Zea mays
ccatggcgcgtggtggcggaggcgggtgctgcccgccgatggatctgatgcggtcggaggcgatgcagctggtgcaggtcatcatacccgctgagtctgcgcacctcacagtctcctatctcggcgacctcggcctcctccagttcaaaagaccttaatgcagagaagagcccgtttcaacgtacatatgctgcccagatcaaaaggtgtagtgaaatggctcgtaaattgaggttttttaaggagcagatgtcaaaagctgacataggtcctacacaactaaatgaaactcatctggattttgatgacttggagataaagcttggagaactggaagctgagctaactgaagtcaatgcaaacaatgaaaagttactgaggacctacaatgagctattagagtaccatactgttctccaaaaggctggtgattttttctattcagctcaaagaactgctgcatcacaacaaagggaattggaggcaaatcaatctggtcaaacttcactggagagccctctgttggaacaggagatgtcaactgatccatcaaaacaagtgaagcttggttcattgagtggccttgttccaaaggaaaaggcaatggctttcgaacggatcttattccgtgccacaaggggtaacattttccttaggcaggagcctgttgatgagcctgtcactgacccagtttctggggagaaggtaacgaagaatgcatttgttatattctactctggagagagggcaaaaaccaaaattctgaagatatgtgatgccttcaatgcgaaccgttacccattcccagaagatgttagcaaacaacttcatgctgttcaggaggtatctggaaagatctcagagttgaaggcaacaattgacatgggtttagctcatcgtgacagtatactaaaaaatattgcttctgattttgaacagtggaaccatctggtgaagaaggaaaaagcaatttatcacaccttgaacatgctgagcgttgatgttacgaagaaatgcctagttgctgagggctggagtccagtttttgcaagcattcagattcaagatgctcttcagcgtgctactgttaatagcaaatcccaagttggttcaatatttgaagttctcaacacaaaagaatctccaccaacatatttccagacaaataaatttacttcagcgttccaggaaattgttgatgcatatggtgtagccaaatatcaagaagcaaatcctggagtattcaccatcgtgactttcccttttctatttgccgtcatgtttggtgattggggccatgggatttgcttgttacttgcaacactttatctgataatacgggagaagaaactagcttcacagaaacttggagacataatggagatgatgtttggtgggcgttatgtaattatgatgatggcagttttttcaatctacacaggattaatatacaatgaatttttctctgttccatttgggctttttggtaaatctgcctatgcatgccgtgattcttcttgtagtgatgctactactgaaggactaattaaggtaagagatgcatacccttttggtgtggaccctgtttggcatggtagccgcagcgagctgccgtttctcaattcactgaagatgaagatgtccattcttcttggagttgcacaaatgaaccttgggattgtgatcagctacttcaatgcaaaattttttaggaacagtcttaatgtgtggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaaccagttgtttagtggccagaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgaccatgaggagtttgagttcagcgaagtttttgttcaccagctgattcacacgatcgaatttgttcttggtgcagtctcaaacacagcttcgtaccttcgcctttgggctctgagtcttgcacactccgagttgtccactgtattctacgataaagtactactcatggcatgggggtttaacaatgtcatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttttccttgtttagctatgcagaggatttttgggtcggttggcggcaaacatggggggtgatatcaccattgtatgatgctaataagtagttgccgattgggcggtgtgttggatataaataagcactgtattgaaggttaaacattccgctacgttcgttgtcaataaagagtgctatttacgctgctggcgttagtcatttcctggtc

SEQ ID NO: 1625 - DNA, 2805 bp, Zea mays
atggcgcgtggtggcggaggcgggtgctgcccgccgatggatctgatgcggtcggaggcgatgcagctggtgcaggtcatcatacccgctgagtctgcgcacctcacagtctcctatctcggcgacctcggcctcctccagttcaaaagaccttaatgcagagaagagcccgtttcaacgtacatatgctgcccagatcaaaaggtgtagtgaaatggctcgtaaattgaggttttttaaggagcagatgtcaaaagctgacataggtcctacacaactaaatgaaactcatctggattttgatgacttggagataaagcttggagaactggaagctgagctaactgaagtcaatgcaaacaatgaaaagttactgaggacctacaatgagctattagagtaccatactgttctccaaaaggctggtgattttttctattcagctcaaagaactgctgcatcacaacaaagggaattggaggcaaatcaatctggtcaaacttcactggagagccctctgttggaacaggagatgtcaactgatccatcaaaacaagtgaagcttggttcattgagtggccttgttccaaaggaaaaggcaatggctttcgaacggatcttattccgtgccacaaggggtaacattttccttaggcaggagcctgttgatgagcctgtcactgacccagtttctggggagaaggtaacgaagaatgcatttgttatattctactctggagagagggcaaaaaccaaaattctgaagatatgtgatgccttcaatgcgaaccgttacccattcccagaagatgttagcaaacaacttcatgctgttcaggaggtatctggaaagatctcagagttgaaggcaacaattgacatgggtttagctcatcgtgacagtatactaaaaaatattgcttctgattttgaacagtggaaccatctggtgaagaaggaaaaagcaatttatcacaccttgaacatgctgagcgttgatgttacgaagaaatgcctagttgctgagggctggagtccagtttttgcaagcattcagattcaagatgctcttcagcgtgctactgttaatagcaaatcccaagttggttcaatatttgaagttctcaacacaaaagaatctccaccaacatatttccagacaaataaatttacttcagcgttccaggaaattgttgatgcatatggtgtagccaaatatcaagaagcaaatcctggagtattcaccatcgtgactttcccttttctatttgccgtcatgtttggtgattggggccatgggatttgcttgttacttgcaacactttatctgataatacgggagaagaaactagcttcacagaaacttggagacataatggagatgatgtttggtgggcgttatgtaattatgatgatggcagttttttcaatctacacaggattaatatacaatgaatttttctctgttccatttgggctttttggtaaatctgcctatgcatgccgtgattcttcttgtagtgatgctactactgaaggactaattaaggtaagagatgcatacccttttggtgtggaccctgtttggcatggtagccgcagcgagctgccgtttctcaattcactgaagatgaagatgtccattcttcttggagttgcacaaatgaaccttgggattgtgatcagctacttcaatgcaaaattttttaggaacagtcttaatgtgtggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaaccagttgtttagtggccagaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgaccatgaggagtttgagttcagcgaagtttttgttcaccagctgattcacacgatcgaatttgttcttggtgcagtctcaaacacagcttcgtaccttcgcctttgggctctgagtcttgcacactccgagttgtccactgtattctacgataaagtactactcatggcatgggggtttaacaatgttatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttttccttgtttagctatgcagaggatttttgggtcggttggcggcaaacatgggggtgatatcaccattgtatgatgctaataagtagttgccgattgggcggtgtgttggatataaataagcactgtattgaaggttaaacattccgctacgttcgttgtcaataaagagtgctatttacgctgctggcgttagtcatttcctggtc

SEQ ID NO: 1626 - DNA, 4978 bp, Brachypodium distachyon
gatttcctgtttccttgggacaggggactccggtgaacatcatcgtcgggtcgcaggtgtggctggaggatcccgacgacgcgtgggtcgacggcgaggtcaccgggatcaagggcggagacgtcaccgtcgccaccaccaatggcaaaacggttgtggctagccttgcgagtatacaccccaaagacacggaagcgcccccggcaggagtcgatgacatgacgaagctggcctaccttcatgaaccaggggtcttgcataacctcgcttgtcggtacggccttaacgagatatacacatacaccgggaacatcttgattgcagtcaaccctttccagaggctgcctcatctctatgatgtgcacatgatggagcagtacaaaggcgccaccttcggggagctcagcccccatctctttgcgattgcagattcttgttacagggcaatgatcaatgaacatggaagccagtcaatcttggtaagtggtgagagtggtgctggtaagacggagacaacgaagatgctcatgaggtaccttgcattcatgggaggaaggtctggaacagagggacgaaccgttgagcaacaagtattagagtctaatccagtactggaagcatttggcaacgcaaagacggtgaagaacaacaactcaagccgtttcggtaagtttgttgaaatccaattcgacaagtacggaaagatatctggtgcggctgttcgcacatacctccttgaacgatcacgagtatgccaggtctctgatcctgaacggaactaccattgcttttacatgctatgttctgcaccaccggaggatgtgaaaaggtttaaggtgggagacccaagatcatttcattacctgaaccaaacaaactgctatgaagtagctaatgtggatgatgcaagagaatacctagaaacgagaaatgctatggatatagttggcatttgtgaagaagagcaggatgcaatctttagagtagtagcggcaatacttcatctaggaaacattaatttctccaaaggggaagaaattgattcgtcaaggttgagggatgagaaatcagtctaccacctgaaaacagtggcagaactgctaatgtgtgatgagaagtacctcgaagactctctttgtaagcgtgttattgtaacacctgatggaaatatcacaaaacctctcgatccagactctgctttacagagtcgtgatgccttagcaaagacggtgtattcacgacttttcgactggatagtggataagattaataactctattggtcaagatcctgatgcaatcagcataataggggtcctggatatatatggatttgagagtttcaagatcaacagttttgagcaactatgcatcaacatgacaaatgaaaagttgcagcagcactttaatcagcacgtattcaagatggagcaagaagaatacacaagggacgaaatagactggagctatgtggaattcgtggacaatcaggatgtgctggacctgattgagaagaaacctggagggataattgcactactggatgaggcatgcatgtttccgaagtccactcatgagacatttgcacaaaagatgtatcaaacatacaaagcacataagcgcttcagcaagcccaaacttgcaaggactgcatttacaatcaaccactatgcaggagatgtcacataccaagctgaccagtttcttgacaagaacaaagactatgtggtggctgaacatcaagctctactaaattactcaaggtgcccttttgtagcaaacctctttcctccattacctgaggaaagttctaaacagtccaaattctcttccatcggcactcgctttaagcaacaactacaagccttgatggaaacactgagtacgacagagccacactacattagatgtgtgaagcctaatactgtactgaaacctggcatcttcgagaactacaatgtcttgaatcaactgagatgtggtggtgttttggaagcaatcaggatcagttgtgctggctatccgacaaagagaacatttgatgagttcattgatcgatttggagtgcttgcaccggagcttgtggacagttctgatgagaaggcagcttgcgcagcaatatgtgatagaatgggattgaagggatatcagatagggaaaacaaaggtattcctaagagctggtcagatggcagagctggatgctagaagagcagaagtattggccaatgccgttcgacttatccagaggcgtataagaacacatcttatgcgaaaggaattcaccaacttaagaaaagcttccattcaaactcagaagttctggagagcacgactagctcgaaagctttttgagcacatgagaagagtggctgctgcaattacgatacagaagcacacacgtactcgttctgcctggaaagcatatctacaaatctacagatcatcaataacaatacagacaggattacgtgcaatggcagctcgcaatgagcacagattcagaagacagaccaaagctgccataatcatccagactcgatggcgccagcacaaagcttatgttgcttacaaacagcaaaaaaaagcttctttgattctccagtgctcgtggagggcacgtgtggcaagaaaggaacttagaaagctcaaaatggaagcaagagacaatggtgcactgaaagaagcaaaagacaagctggaaaagagagttgaggaactcacctggagattagacgttgagaagcatttgaggattgaccttgagatatccaagggtcaagaaattgcaaagttacaatctgcgttgcaagaaatgcgagaaaagcttgaggaagcccatacagcaataataaaggagaaagaggatgcaaagctagcaattgagcaggcaccaccaaagatagtagaggtgccagtggtggataatgaaaaagttgagttgctgacaagtcaaaacgaggaacttgagggcaaatttggtatgtttaaaaagaaagctgatgatcttgagaacaaagttattgagattcaaaaacagtttgacaaattgtcacgggagacacaagagcgagactccaaaattaatcaacttgaagagatgatttctaggcttgaaacaaatttatccagcatggaatctgaaaaccatgttctgcgtcaacaatcgttgcttgcatcagcagatgatgataaatcaagacaaatagagagtctggagagcaagattgccaacttggagtcagagaatcaattgctccgcaacaattctgcactagctgttcaggcagcagtcactcctgaagtgattcagccatcagttattgaggttctcgaaaatggacagcagcttggagaacttaaaatcttcaatgagcaggtggttgttcccccggtaaagaatttaagcaaacagaaatcgctcacggaccggcagcaagaaaatcatgatgtacttatcaaaagcctggctgaagacaggagatatgacaaccgtagaccagctgcagcatgtatcgtctataaatcactcctgcactggcactcattcgaagcagagaagactaacatatttgaccgtatcatccatacaattaggtcatctattgagagtgctgaaggttctggagaactggcttattggttgtcgacaacatcgaccctcctttaccttctacaaaatacccttaaaactagcagttcatcgactaaaggatcaaaccgcagcaggacctcaaccggcaacttattcaatagaatgatgcaaaatgctcgatcatcatcgtcaggattaggcatttcaagcggttacagtggaatgataggaaggactgacattgcatcaatggtagaggctaagtatcccgctgttcgtttcaagcagcagttaacagcatatgtggagaagatatatggcatgatgagagatagcctgaagaaggaaataagtacaatattgattatgtgcatacaggctccgagagctgttcgtgtgagatcatctagaggatcattgaaaagcatacactctagtgcactatcaaggcaagtatcaaatgtgcattggcaaaacattgttatgtgcctgaataatacattggaaacaatgaacagcaattatgtacctccaatgataattaggaaaacattcagtcaagtgttcgcatttatgaacgtccaactctttaacagcttgctactccgccgtgaatgctgctcctttagcaatggcgaattcttgaaggccggcttacaggaactggagcagtggtgctctagaacaactgaagagtttgcaggaacatcttgggatgaaatgaaacacataaggcaggcagttgggttcctggttttgcatcagaagtcgcacaaaaccttggatgaaatcacagatgagctatgccccgttctgagcatcacccaaatatgtcgtataggaacaatgttctgggacgacaaatatggtgcacaaggtctatctcaagaggtaattggaaatatgagaacattgacgaccgatgactcggtagctactccaaatagttctttcttgctagatgacgattcaagcataccgatatccttggatgatatctcacggctgatgcttgacatcaacccgtctgacgtggagccgccaccgctgctgaggcagaactctcaatttcactttcttctgcaacaatgtacataatgattgcattgtatatacaggaaatacagaaaggtaaagtttttttttccgaaggacctgggttactgaagattttgttttactggagtgcatagtttgagttgtggtttctttctatcttcaactgggaattttgggtggatttttgttagtaagtgtgaaaaatgttataagaaagggaaaaaaatagaagatttgatagttttcttttcattttttatgacggaggaaacattgtaattcttttgtataagtgtatgaatggaacttcactgtggaagtatgtg

SEQ ID NO: 1627 - DNA, 4822 bp, Sorghum bicolor
atgcaggggactccggtgaacatcatcgtcggctcgcacgtgtggcttgaggaccccggcgaggcctgggtcgacggcgtcgtcaccgacatcaaaggcggcaacgccaccatcgccaccaccaatggcaaaacggtcgtggcgagccttggcagcatataccccaaggacacggaggcgccgccgtcaggagtggacgacatgaccaagctggcgtacctccacgagccgggcgtcctgcacaacctctcctgccgatacggccttaacgagatatacacgtacaccgggaacatcttgatcgcggtgaaccctttccagcggctgcctcacctctacgacgtgcacatgatggagcagtacaagggtgccagctttggggagctcagcccacatctcttcgcgatcgcggacgcctgctacagggcgttgatcaatgatcaggggagtcaggcaatcttggtgagtggcgagagtggtgccggcaagacggagacgaccaagatgctcatgaggtatcttgcattcatgggaggaaggtccggtaccgagggacggactgttgagcagcaggttctagagtctaatccagtacttgaagcatttggtaacgcaaagacagtgaagaacaataactcgagtcgattcggtaagtttgttgaaatccagttcgacaagtatgggaagatatcaggggctgctgtacgcacatacctccttgagcgatcacgagtatgtcaggtctctgatcctgagaggaactaccattgcttttacatgctttgttccgcaccccctgaggatgtaaagaggtttaaggtgggagaccctagacaattccattacttgaaccaaacaaactgctatgaagtagctaatgtggatgatgcaagagaatacttagaaacaagaaatgctatggatattgttggcatcgatcaagaggaacaggatgcaatcttcagagtagtagcagcaatccttcacctaggaaacattaacttctccaaagggcaggaaattgactcatccaagttgagagatgataaatcagtctatcacctgaaaacagttgcagaactgctaatgtgtgatgagaaggcccttgaagactccctttgccagcgtgttattgtgacacctgatgggaatatcacgaaaccccttgatccagattctgcagcattaagtcgtgatgccttagcaaagacagtatattcacgactgtttgactggattgtcgacaagatcaataactcaattggccaggatccagatgcgaccaatataataggtgtgcttgatatctatggatttgagagcttcaagattaacagtttcgagcaactatgcatcaacttgacaaacgagaagttgcagcagcatttcaatcagcatgtatttaagatggagcaagaagaatacacaagggaggaaatagactggagctatgttgaatttgtagacaatcaggatgtgctggacctgattgaaaagaaacctggaggaataattgcactcctggatgaggcatgcatgtttccaaagtctacacatgaaacatttgctcaaaagatgtaccaaacatataaggcacataagcgcttcagcaagcccaaacttgctcggacagcctttacaatcaaccactacgcaggagatgtgacatatcaagcggatcacttccttgataagaacaaagactatgtggtagctgaacaccaagctctactaaattcttcaaggtgcccttttgttgcaaacctctttcctccattacctgaggaaacttctaaacagtccaaattctcttcaatcggtactcgctttaagcaacaactgcaatccctcatggaaacactgaatacaacagaacctcactacatcagatgtgtcaagcctaatgctgtactgaaacctggcattttcgagaaccacaatgtcttgaatcagttgagatgtgggggtgtcctggaagcaattcggattagctgtgctggttatccaacgaagaggacattcgatgagttcattgatcggtttggaatgcttgcaccggagcttgttgacagtgatgagaaggccgcttgtgcagcgatatgtgatagaatgggtttgaaaggatatcagatagggaaaactaaggtattcctaagagctggccagatggcagagctggatgctcgaagagcagaaattttggccaatgctgcgcgactaatccagaggcatataaaggcacatcttatgcgaaaggaattcattaacttacgaaaagcctcagttcaatctcagaagttctggagagcacgactagctagaaagctttttgagtatatgaggagagacgctgcttcaattaggatacaaaagcacgtgcgtacccattctgccaggaaagcgtacctacaagtatatgaatcagctatagtaatacagacaggattacgagcaatggcagctcgcaatgaacacagattccgaagagagaccaaggcatccataattatccaggaagcaagagagactggcgcactcaaagaagcaaaagacaagctagaaaagagagtagaagaactcacatggcggttagatgtcgagaagcgtttgaggactgaccttgaagaagccaagggccacgaaattgaaaagctacaatctgcactgcaaaaattgcaagaaaatctcgaggaagcccatgcagcaatagtaaaggagaaagaagctgcgaagttagcgattgaacaggcaccaccaaagatagtagaagtgccagttgtcgacaatgcaaaacttgaggagttgacaactcaaaataaagaacttgaggatgaactaactacgtttaaacagaaggctgaggatcttgaaaataagcttcttgagttgcagaaacagtctgatgaactgtcacaggagacacaagaacaagcgtccaaagttactcaacttcaagagctgatcgaaaggcttgaagcaagtttatccaatatggaatctgaaaaccaggttctacgacaacaatcactggttgttacatcagctgatgaagataaatccaaacagatagagagattcgaaagcaagatttccaccttggagtcagagatcgagttgctccgctgtaattctgcactagctgttcaggcagtggtcactcctgaaatgaatcagacaacagtaatcgaggaacttgacaagggacatcagcttgaagaagttaaaacggtcaatgagcaggtggttattcctcctgtaaagaatctaagcaaacaaaaatcactgacagatcgacagcaagaaaaccacgatgccctgattaaaagtctggtagaagacaggagatttgatgacaaaaaatctgctgcagcatgcattgcctacaaatcactcctacactggcattcatttgaagcagagaagactaacatatttgatcgtatcatccaaacaattaggtcatcagttgagggagcagaaagttctggagagcttgcctattggttgtcgacaacatcaactctcctctacttattacaaaacactctcaaagctagtagttcattaagtaaaggaacaaatcgcagccggaccacaacaggcagtctgttcagtagaatggtgcagagtgctcgggcatcatcaggattaggcatacctagtggatacagtggaatggtgagaaggcctgacactgcatcaatggtagaggcaaaatatccagcacttcggttcaagcaacagttgacagcatatgtcgagaagatatatgggataatcagagataacctgaagaaggaaatcagtccattcttgactatgtgcatacaggctccaagggctaaccgtgtgagaccatctcggggatcactaaaaagcattcactctaatgggctagctaggcaagcatcaagtctacattggcaaaacattgttaagtgcctggatcatacactggaaacgatgaaaaataattatgtacctccggtgataatcaggaaaacatttagccaagtatttgcatatttgaatgtgcaactcctcaacagtttgctacttcgtcgggaatgctgctcttttagcaatggggagttcttaaaggctggtttacaagacctggagcagtggtgctctacaataactgaagagtatgtagggacatcatgggatgaactgcaacacattaggcaggcagtcgggttcctggttttgcatcagaagtcacacaaaaccctggaggaaatcacaaatgatctttgccctgtttttgagcataactcaaatatatcgcatagcaacgatgttctgggacgacaagtatggtgcacaaggtatatctcaagaggtgattggaaagatgagaacgatgacaacagacgactcaataactactccaaatagttctttcttgctagatgacgactcaagcataccaatatcattggatgatatagctcgactgatgggtgacattgatccgtccgatgtggaaccgcccccactactaaggcagaattctcagtttcattttcttctgcagcagcacacagactgactgatatctacagatataaagagtaaaacggtacagttacttgtgaagttacagagaactgaagattttttataggagtgcacagattgagttgtggttttttcttccatttttttataactttgggtgggaaaatgcctacaaagaaagagaaatataggatatatcctgatatcattcttttgattgattgattgattgaaacagagaaaattgtaattatttgaagatgtatataatgatagtatatatatttgcacccaacca

SEQ ID NO: 1628 - DNA, 667 bp, Oryza sativa
tcatcaaacatagcaccaatcaccaatcacctatcagtagtacttcactgctcgctactagtcccctgaattcagcgatcagtataacagcgggaagctcaagaagagatcgtcgatcgatggcgggtgcagcgaaggcgtcgtggatggtggcgatgagcgtgggcgcggtggaggcgctcaaggaccaggcggggctctgccgctggaactacgcgctgcggtccatccaccgcgccgccaaggccaacgcgcgcgccggcgtctcgcggggcaagaagctgcctgcctccgcggcggcggtggcggagaggaggagagcggagaaggccgaggaagggttgaggacggtcatgtacatcagctgctggagtaccaattagtatagctgtgccttctactcttctactactagctttgctataggagtcaggttggaacttggaagtggcaaccatggctgagacttgccggttgcttgttaatttcctccgggttgtatataccacgatgatgatgatgaaaacttctgttacttgagtatacttgatgtctcgatgtctcatgggttatcaatgcttttgccttgagagattttgacaggcatttttcatggttgtacatgatttggattttgacggggaagaaccactagtattatcttgac

SEQ ID NO: 1629 - DNA, 745 bp, Oryza sativa
cctcaacaacaacaacaaagcatcgttcaattcagttcacaaatcacaacaacaacagcgcgagaaatttaaagaggagatcatcggatcaatctcatcaatggcgggtgcagcgaaggcgtcgtggatggtggcgatgagcgtgggcgccgtggaggcgctcaaggaccagggcggactctgccgctggaactacgcgctgcggtccatccacaaggcagccaaggccaacgccgccggcgtctcgcagggcaagaagctgcctgcctccgcggcggcggtggcggagaggaggagagcggagaaggccgaggaggggttgaggacggtcatatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactggcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctgcagcaactgtggctgcaagagctaaaaatggctgcagcggcagcagctgaaaaacagccacagccatag

SEQ ID NO: 1630 - DNA, 544 bp, Festuca arundinacea
ggcacgagggctttcagcccaattccaccacttagtacgaagttcaaactccacaacagagaaatcacagagctcgtagatcagtcaacaatctcgtccaacacaacaacgagaagagaagatggccggtgcagctaaggcgtcgtggatggtggcgatgagcgtgggcgcggtggaggcgctcaaggaccaggccggcctctgccgctggaactacgcgctcaggtccatccaccgggccgccaaggccaaggccagcatccgcggcgccgtctcgcagggcaagaagcagcttccggcatccgccgcggcggtggcggagaggcggcgagcggagaaagcagaagaagggttgaggacggtgatgtatctcagctgctggggacccaattagtagctgcaagcttgcaattggcaattattagctagatgtgtttgctgcaacaacaagtcaacaaccatggcctgagacctggttgtttccccattgtaatataccacgatgatgatgatgatgaaactttcagtgacctgagtttatatt

SEQ ID NO: 1631 - DNA, 540 bp, Triticum aestivum
ttcggcacgagggaagaaccatccccccatcagttcagttgtttcaccactgaaagtccagtactacacacaagcaatcaatcacaaatcagcctcagttcgaccactttccaccagaccagcaagaggcgatggccggtgcagcgaaggcgtcttggatggtggccatgagcgtgggcgcggtggaggcgctcaaggaccaggcgggactctgccggtggaactacgctctgcggtccatccaccgggcagccaaggccaaatccaacatccacgccggcgtctcgcagggcaagaagcagcttccggcctcggcggcggccgtgccggagaggcggcgagcggagaaggccgaggaggggctgaggacggtaatgtacctcagctgctggggaccaaactagtagtactagctagctgctagcggtgtgtttgttgcagcaagcaaccatggcctgggatctggctggttgcatctgatttgtacatacgtgtccccaggatgatgatgaaaatttcaagtttataccaaaaaaaaaa

SEQ ID NO: 1632 - DNA, 520 bp, Triticum aestivum
ccaggaagaaccatccccccatcagttcagttgtttcaccactgaaagtccagtactacacacaagcaatcaatcacaaatcagcctcagttcgaccactttccaccagaccagcaagaggcgatggccggtgcagcgaaggcgtcttggatggtggccatgagcgtgggcgcggtggaggcgctcaaggaccaggcgggactctgccggtggaactacgctctgcggtccatccaccgggcagccaaggccaaatccaacatccacgccggcgtctcgcagggcaagaagcagcttccggcctcggcggcggccgtgccggagaggcggcgagcggagaaggccgaggaggggctgaggacggtaatgtacctcagctgctggggaccaaactagtagtactagctagctgctagcggtgtgtttgttgcagcaagcaaccatggcctgggatctggctggttgcatctgatttgtacatacgtgtccccaggatgatgatgaaaatttcaagtttata

SEQ ID NO: 1633 - DNA, 426 bp, Triticum aestivum
aggaagaagcatccccccatcagttcagttgtttcaccactgaaactccagtactacacacaagcaatcaatcacaaatcagcctcagttcgaccactttccaccagaccagcaatcagaaggagagccgtgatggctggtgcggcgaaggcgtcgtggatggtggccatgagcgtgggcgcggtggaggcgctcaaggaccaggcgggactctgccgctggaactatgctctgcgatccatccaccgggcagccaaggccaaagccaacatccgcgccggcgtctcgcagggcaagatgcagcttccggcctcggcggcggccgtggcggagaggcggcgagcggagaagtccgatgaggggctgcggacggtgatgtacctcagctgctggggaccaaactagtagtactagctagctgctagc

SEQ ID NO: 1634 - DNA, 404 bp, Triticum aestivum
ggctggtccggcgaaggcatcgtggatggtggccatgagcgtgggcgcggtggaagcgctcaaggaccaggccgggctttgccgctggaactatgccctcaggtccatccaccgggcagccaaggccaacgtccgcggcggcgtctcgcagggcagcaagcagcttccggcctccgcgtcggcggtggcggagaggcggcgagcggagaaggccgaggaggggctaagaacggtgatgtacctcagctgctggggcccaaattaggagtactagttggttaggggtgttgtgttcgttgcagcttgtgcttatacttatgcgacaaccccatgaccgtttgtaaatacagcacgatgatgatgatgatgaaaatttcggctatgaatttatattaaaaaaaaaa

SEQ ID NO: 1635 - DNA, 526 bp, Triticum aestivum
caactcactgagacagttcaacaaaatcaaactagctctgttcaacttcgcaagtccactagtagtactacacacaaggatcacaagtcagtctccactctccagcagtgcagcaagaacaagaagcgcaggagaagcaatggctggtccggcgaaggcgtcgtggatggtggccatgagcgtgggcgccgtggaggcgctcaaggatcaggccgggctctgccgctggaactatgccctcaggtccatccaccgggctgccaaggccaacgtccgtgggggcgcctcgcagggcaccaagcagcttccggcctccgcggtggctgtggcggagaggcggcgagcggagaaggccgaggaggggctgaggaccgtcatgtacctcagctgctggggcccaaattaggagtactagtagcttagggatgttgtgttcgttgcaggttgtgcttatgcacaaccccatgatcgatttgtaaatacagcaagatgatgatgatgataatttcggctatgaatttatctc

SEQ ID NO: 1636 - DNA, 565 bp, Triticum aestivum
  misc_feature (319)..(319): n is a, c, g, or t
  misc_feature (466)..(466): n is a, c, g, or t
  misc_feature (498)..(498): n is a, c, g, or t
ccacgcgtccgcaaacaggcatcaactcactgagacagttcaacaaaatcaaactagctctgttcaacttcgcaagtccactagtagtactacacacaaggatcacaagtcagtctccactctccagcagtgcagcaagaacaagaagcgcaggagaagcaatggctggtccggcgaaggcgtcgtggatggtggccatgagcgtgggcgccgtggaggcgctcaaggatcaggccgggctctgccgctggaactatgccctcaggtccatccaccgggctgccaaggccaacgtccgtgggggcgcctcgcagggcancaagcagcttccggcctccgcgtcggcggtggcggagaggcggcgagcggagaaggccgaggaggggctaagaacggtgatgtacctcagctgctggggcccaaattaggagtactagttggttaggggtgttgtgttcgttgcagnttgtgcttatacttatgcgacaaccccatgancgatttgtaaatacagcaagatgatgatgatgataatttcggctatgaatttatattaaaaaaaaaa

SEQ ID NO: 1637 - DNA, 551 bp, Triticum aestivum
gaagaagcagccctgcatcagctcagctcttttatcactgaaagtccactactagacacaagcaatcacaaatcagtctcagttcaaccattttccaccagcccagcaagcagaaggagagcagtgatggctggtgcggcgaaggcgtcatggatggtggccatgagcgtgggcgcggtggaggcgctcaaagaccaggccgggctctgccgctggaactatgctctgcgatccatccaccgggcagccaacatccgcgccggcgtctcgcagggcaagaagcagcttccggcctcggcggcggccgtggcagagaggcggcgagcggagaaggccgaggaggggctgaggacggtgatgtgcctcagctgctggggggtgcagaatacatgttgtgctatgaattggttgcaagtgcaagtgcttcctgtggggtgagatcgttcgtgaaggttctgtctgaatttcttcgctctacaatttgctgaaccgacacgctcaactgaacgtgattcaggtccaggttataccacattactgagttaactaaa

SEQ ID NO: 1638 - DNA, 556 bp, Triticum aestivum
gaagaagcagccctgcatcagctcagctcttttatcactgaaagtccactactagacacaagcaatcacaaatcagtctcagttcaaccattttccaccagcccagcaagcagaaggagagcagtgatggctggtgcggcgaaggcgtcatggatggtggccatgagcgtgggcgcggtggaggcgctcaaagaccaggccgggctctgccgctggaactatgctctgcgatccatccaccgggcagccaacatccgcgccggcgtctcgcagggcaagaagcagcttccggcctcggcggcggccgtggcagagaggcggcgagcggagaaggccgaggaggggctgaggacggtgatgtgcctcagctgctggggggtgcagaatacatgttgtgctatgaattggttgcaagtgcaagtgcttcctgtggggtgagatcgttcgtgaaggttctgtctgaatttcttcgctctacaatttgctgaaccgacacgctcaactgaacgtgattcaggtccaggttataccacattactgagttaactaaacgtga

SEQ ID NO: 1639 - DNA, 500 bp, Brachypodium distachyon
aacacaaacacaagcatcaattaatcagctctgtcagttcttccgatacagatcagtgtccccgaacccaaggagccaacgcatcttgaggagaatctatggctggtgcagcgaaggcgtcgtggatggtggcgatgagcgtgggggccgtggaggcgctcaaggaccaggccgggctctgccgctggaactacgctctgaggtccatccaccgggcagccaaggcaaacgggcggcctctcgcagggcaagaagctgtcccctgccgcggcgatggcagagagggggagagctgagaaggcagaggaggggttgaggacggtcatgtacctcagctgctggggtcccaactaagctagtagtgttattagcagcaaaattagccatggcctgctatgctacttggctggttaattgcctcctgattgtaaatatggaccacgatgatgatgatgaaaatttctgcccacttgagtttacattgtttgcccccttgcttt

SEQ ID NO: 1640 - DNA, 670 bp, Triticum aestivum
  misc_feature (101)..(101): n is a, c, g, or t
  misc_feature (107)..(107): n is a, c, g, or t
  misc_feature (115)..(115): n is a, c, g, or t
  misc_feature (436)..(436): n is a, c, g, or t
  misc_feature (507)..(507): n is a, c, g, or t
ggcacgaggcatcaatcagccttcagctcaaaattcattccatactccacactcagacttcagctaccaatctccaggcatcacatagttcagacacatcnatcacngtgctgtntccaccaacgcaagagagatcatggcgggagcggcgaaggcgtcatggatggtggcgatgagcgtcggcgccgtggaggcgctcaaggaccaggctgggctctgccgatggaactacgccctcaggtccatcatccaccgggccgccaaggccagggccaacgtccgcggcggcgtctcgcagggcgccaagcagcttccagcctccgcggcggcggcggccgagaggcggcgagcggagaaggccgaggaggggctgaggacggtgatgtacctcagctgctggggtcccaattagcagctgcaacttgctgctagctgnggaggggctgaggacggtgacgtacctcaactgctaggcgtgtctctgtttgctgcaacaaccatggcctnaaacctgtgtggcttcccgttgaatcgcccattgtaaaataccaccatgatgatgatgacaacatatttctgttacttcagttcatattactctccttatctatttgccttttgttatcttgatgagaaatatgaattgatgctttaaaaggaaaaaaaaaaa

SEQ ID NO: 1641 - DNA, 514 bp, Triticum aestivum
aaaacaagcatcagcacactttcttcaccaccgcagctccgcaagttcagtagctctatagacacggagatcacaattcagtatcttctctccagcaacttaggaggagatggctggtccggcgaaggcttcgtggatggtggcgatgagcgtcggcgccgtggaggcgctcaaggaccaggcggggctctgccgctggaactatgcgctcagctccatccatcgggccgccaaggcaaaggccaacgtccgcggcggcgtctcgcaaggcaagaagcagcttccggcctttgcggcggccgtggcggagaggcggcgagcagagaaggccgaggaggggctgaggacggtcatgtacctcagctgctggggcccaaactaggagtactagtagctagaggtgttgtgttcgtcggagcaaagtaagcaaccatggctgattgccctttccccacgattgtaagataccataatgattatgatgatgatgaaaattttggcctcaaaaaaaaaa

SEQ ID NO: 1642 - DNA, 531 bp, Triticum aestivum
catcagttgaggcagtcgagcaagaaaaacaagcatcagcacactttcttcaccaccgcagctccgcaagttcagtagctctatagacacggagatcacaattcagtatcttctctccagcaacttaggaggagatggctggtccggcgaaggcttcgtggatggtggcgatgagcgtcggcgccgtggaggcgctcaaggaccaggcggggctctgccgctggaactatgcgctcagctccatccatcgggccgccaaggcaaaggccaacgtccgcggcggcgtctcgcaaggcaagaagcagcttccggcctttgcggcggccgtggcggagaggcggcgagcagagaaggccgaggaggggctgaggacggtcatgtacctcagctgctggggcccaaactaggagtactagtagctagaggtgttgtgttcgtcggagcaaagtaagcaaccatggctgattgccctttccccacgattgtaagataccataatgattatgatgatgatgaaaattttggcctcaa

SEQ ID NO: 1643 - DNA, 629 bp, Triticum aestivum
  misc_feature (613)..(613): n is a, c, g, or t
ccacgcgtccggagtatcgattcagtgagatagtttaagaaaatctactctgttctttcagtaccgcaacttcgcaaacccactactacacaaggatcacaagtcagtctccactcttcagcagcgcagcaagaacaaggaggaggaggagagacgatggctggtccggcgaaggcgtcgtggatggtggccatgagcgtgggcgcagtcgaggcactcaaggaccaggtcgggctctgccgctggaactacgccctaaggtccatccactgtgcagccaaggccaacgtccgcagcggcgtctcgtagggtaacaagcagctgcctgcctcagtggccgccgtggcagagaggcggcgagcggagaaggctgaggaggggctgaggactgtcatgtaccttagctgctggggcctaaattaagagtggtagtagctaggagggctgtgtttgttgcagcaagcaacttagtattagtaagcatccatggcctgagacttggctctggttgacccctgatcggtttgtaaagatacacgacgatgatgatgatgctgaaaattttggctatgagtgcataatttatatcaccctacttgatccatgtgcttcngtggctaaaaaaaaaa

SEQ ID NO: 1644 - DNA, 611 bp, Triticum aestivum
aattcagtgagatagtttaagaaaatctactctgttctttcagtaccgcaacttcgcaaacccactactacacaaggatcacaagtcagtctccactcttcagcagcgcagcaagaacaaggaggaggaggagagacgatggctggtccggcgaaggcgtcgtggatggtggccatgagcgtgggcgcagtcgaggcactcaaggaccaggtcgggctctgccgctggaactacgccctaaggtccatccactgtgcagccaaggccaacgtccgcagcggcgtctcgtagggtaacaagcagctgcctgcctcagtggccgccgtggcagagaggcggcgagcggagaaggctgaggaggggctgaggactgtcatgtaccttagctgctggggcctaaattaagagtggtagtagctaggagggctgtgtttgttgcagcaagcaacttagtattagtaagcatccatggcctgagacttggctctggttgacccctgatcggtttgtaaagatacacgacgatgatgatgatgctgaaaattttggctatgagtgcataatttatatcaccctacttgatccatgtgcttcagtggctaaaaaaaaaa

SEQ ID NO: 1645 - DNA, 640 bp, Avena sativa
cacaaacgattcagcagtcagctcaatcccttcacttagtacaaagtccacactccaccacatcgtaatcttcagacatcgtgtcaacagtctccaccaacacagtaaggagtagaaaagaaatcaatggcgggtgcggcgaagacatcgtggatggtggccatgagcgtgggcgcggtggaggccctcaaggaccaggcaggcctttgccgctggaactacgcactcaggtccatccaccgggcagccaaggccaaggctagcgtccgcggcaccgtctcgcagcagggcaagaagcagcttccggcctccgccgcggcagtggcggagcggaggcgagcggagaaggccgagaaggggctgaggatggtgatgtacctcagctgctggggacctaattagctgctgcgagcatgaaattagcaatcacctgttaggaataataattccgataggacacggaacgatgtcgtgtgggtgtgggtgttccgtatactgaccgagtaggatttgtagtccaacacctattcgtattgacgctgcgtcgtcttgccgggtatatatacacccataaagtagccttgtaagaaaaccgtgagattcaatacaacagcacgaccgagagggccctgtagccatc

SEQ ID NO: 1646 - DNA, 467 bp, Triticum aestivum
gagtttcataccgccaacacacagagagatcatggcgggtgcggctaaggcgtcttggatggtggcgatgagcgtcggcgccgtggaggcgctcaaggatcaggccggcctctgccgctggaactacgccctcagatccatccaccgggcagccaaggcccgggccaacgtccgtggcggcgtctcgcagggcgccaagcagcttccggcctctgctgcgtcggtggtggagaggcggcgttgggagaaggccgaggaggggctgaggacggtgatgtacctcagctgttggggaccaaattagcagctgcaacttagtgctagctaggtgtgtgtgtgtgtgtgtgcttgctgcaacaaccatggcctgaaaccacggtgtaaaagcttggtactagctggcttcccgtggaatcccccattgtaaaaaccaccatgatgatgatgacaaatttcagttacttcag

SEQ ID NO: 1647 - DNA, 547 bp, Triticum aestivum
cacaactacacaagcatcaatcatccaacagttcagttcattcataaatagcacaaggtccacaccctgctagccatcaatcttcaggcaccacagagttctagacggatcagtcagcagtaccatcttcaccaacgcagagagagatatcatggcgggtgcggcgaaggcgtcatggatggtggcgatgagcgtgggcgccgtggaggcgctcaaggaccaggccggcctctgccgctggaactacgcgctcaggtccatccaccgggcagccaaggccagggccaacgtccgcggcaccgtctcgctgggcacgaagcagcttcctgcatccacggcggcggtggccgagaggcggcgagcggagaaggccgaggaggggctgaggaccgtcatgtacctcagctgctggggaaccaattagtatccgcgattactagctaggcgtgtgagtttgtgtttgctgcagtaaccagggcctggaaatcagctggttgctctgcgattgtaatataccacgacgatgatgatgatgaaaatttctgtc

SEQ ID NO: 1648 - DNA, 573 bp, Triticum aestivum
  misc_feature (559)..(559): n is a, c, g, or t
  misc_feature (561)..(563): n is a, c, g, or t
cacaactacacaagcatcaatcatccaacagttcagttcattcataaatagcacaaggtccacaccctgctagccatcaatcttcaggcaccacagagttctagacggatcagtcagcagtaccatcttcaccaacgcagagagagatatcatggcgggtgcggcgaaggcgtcatggatggtggcgatgagcgtgggcgccgtggaggcgctcaaggaccaggccggcctctgccgctggaactacgcgctcaggtccatccaccgggcagccaaggccagggccaacgtccgcggcaccgtctcgctgggcacgaagcagcttcctgcatccacggcggcggtggccgagaggcggcgagcggagaaggccgaggaggggctgaggaccgtcatgtacctcagctgctggggaaccaattagtatccgcgattactagctaggcgtgtgagtttgtgtttgctgcagtaaccagggcctggaaatcagctggttgctctgcgattgtaatataccacgacgatgatgatgatgaaaatttctgtcacatgtgtttanannnaaaaaaaaaa

SEQ ID NO: 1649 - DNA, 804 bp, Triticum aestivum
ttatctctgtcggcttgtgccaatcccagactctctcccaatggccaaaaccaccgcttccacagggaataaacaaaacggcacgacagcgatagttgcggcgtgaagaagcagagtagtagcagagtgatgactccggaggcacccgggttcgttgaaaaaccaacgtccgcgtccactgttttgctccggacctcccagccctcctcgtgtatataatctcatcccagccccgctctccctctcatcaacacaagcatcaatcagccttcatctcagttcattcacaatcacaaagtccacactctacactcgacaactactcttcagtcatcacctacttcggagtttcagaccagcagcacagagagagatcatggcgggcgcagctaaggcgtcttggatggtggcgatgagcgtgggcgcggtggaggcgctcaaggaccaggtcggcctctgccgctggaactacgccctcaaatccatccatcgggcagccaaggccagggccaacgtctgcggcggcgtctcgcagggcgccaagcagcttccagcctctgctgcggcggtggcggagaggcggcaaggggagaaggccgaggaagggctgaggacggtgatgtacctcagctgctggggtcccaattagaagctgcctacttggtagtactagctaggcgtctctgtgtttggtactatggcctgaaaccacgatgcagaaacttggtactagctggcttcccttgtaaaaactaggatgatgatgatgacaaatttctgttacttcagttcataaaaaaaaaa

SEQ ID NO: 1650 - DNA, 559 bp, Pseudoroegneria spicata
gttcaggcagtgcagcaaaaaagaacaagcatcagcacactttcttcactaccgcagctccgcaagttcagactgttcagtagttctatagacacagagatcacaagtcagtatcctctccagcaacgcaggaacaagaaggggaggagatggctgctccggcgaaggcttcgtggatggtggcgatgagcgtgggcgccgtggaggcgctcaaggaccaggcggggctctgccgctggaactacgcgctcgggtccatccatcgggccgccaaggccagggccaacgtccgcggcggcgtctcgcaaggcaagaagcagcttccggcctctgcggcggccgtggcggagaggtggcgagcggagaaggccgaggaggggctgaggacggtcatgtacctcagctgctggggcccaaactaggagtgctagtagctagaggtgttgtgttcgtcggagcaaagtatgcaaccatggcctgagacctggctgattgccctttccccacgattgtaagataccacgatgatgatgatgatgaaaatttcggcctttgttta

SEQ ID NO: 1651 - DNA, 567 bp, Triticum aestivum
  misc_feature (12)..(12): n is a, c, g, or t
  misc_feature (14)..(14): n is a, c, g, or t
  misc_feature (17)..(17): n is a, c, g, or t
  misc_feature (20)..(20): n is a, c, g, or t
gaattcggcacnangcntcnatcagccttcatctcagttcattcacagtcagccttcatcttcatctcagtcatcacctacttcagagtttcataccgccaacacacagagagatcatggcgggtgcggctaaggcgtcttggatggtggcgatgagcgtcggcgccgtggaggcgctcaaggatcaggccggcctctgccgctggaactacgccctcagatccatccaccgggcagccaaggcccgggccaacgtccgtggcggcgtctcgcagggcgccaagcagcttccggcctctgctgcgtcggtggtggagaggcggcgttgggagaaggccgaggaggggctgaggacggtgatgtacctcagctgttggggaccaaattagcagctgcaacttagtgctagctaggtgtgtgtgtgtgtgtgtgcttgctgcaacaaccatggcctgaaaccacggtgtaaaagcttggtactagctggcttcccgtggaatcccccattgtaaaaaccaccatgatgatgatgacaaatttcagttacttcagttcaaaaaaaaaaaa

SEQ ID NO: 1652 - DNA, 726 bp, Triticum aestivum
attcagtgagatagttcagaaaatcagctctgttcttttagcatacacaaggatcgcaagtcagtctccactctccagcagcgcagcaagaacaaggaggaggaggagagatggctggtccggcgaaggcgtcatggatggcggcgatgagcgtcggcgcggtggaggcgctcaaggaccaggccgggctctgccgctggaactatgccctcaggtccatccaccgtgcagccaaggccaacgtccgcggcggcgtctcgcagggcacgaagcagcttccggcagctgtggcggagaggcggcgagcggagaaggccgaggaggggctgaggacggtgatgtacctcagctgctggggcccaaattagaagtaccagtagctcaggcctcaggggtgtagtgttcgttacagcaagtattagtaagcatgcaaccatggcctgagatttggctggctactccctgatcggttgtaaatataccaccacgatgatgatgatgaaaatttcggctatgagcttatagccatggccttctgtggctattttttgagaggccaaagacatatcaagagagggaggaaattcagagttacaccgtgagagtaactcactcagaaaagcgaccccttgtgcagaaaacagagcagcttcagctgcctgtacaaaacagagaaggaattcgatctcaacgatacactcagccgccctccaagatctcagacct

SEQ ID NO: 1653 - DNA, 576 bp, Triticum aestivum
gctccgttccttcaccaccacataatccacactccactgctatcagagagttcaggcaggccattcagcggcatcatcctccaacgcgtcgagaagaaatatatggcaggtgcggccaagacgtcgtggatggtggcgatgagcgtgggcgctgtggaggcgctcaaggaccaggccggcctctgccgctggaactacgcgctcaggaccatccaccggacagccaaggccaacgtcggtggcggcgtctcccaaggcgcaaagcagctgccggcttccgcggcggtggccgagaagcgacgagcggagaaggccgaggaggggctgaggaccgtcatgtacctcagctgttggggtccaaatggccgtatgcatttttctaatgcagaggccggagaattccctcttttcaaaaaaaaaaaaagctgttggggtccaaattagcagctgcaacttagtgctagctaggcgtgtgtgtgtttactgcaacaaccatggcctgagaccacgatttaaaaagttggtactagctggcttcccgtggaatcccccattgtaaaaaccacgatgatgatg

SEQ ID NO: 1654 - DNA, 582 bp, Triticum aestivum
  misc_feature (255)..(255): n is a, c, g, or t
  misc_feature (270)..(270): n is a, c, g, or t
  misc_feature (558)..(558): n is a, c, g, or t
  misc_feature (577)..(577): n is a, c, g, or t
gctccgttccttcaccaccacataatccacactccactgctatcagagagttcaggcaggccattcagcggcatcatcctccaacgcgtcgagaagaaatatatggcaggtgcggccaagacgtcgtggatggtggcgatgagcgtgggcgctgtggaggcgctcaaggaccaggccggcctctgccgctggaactacgcgctcaggaccatccaccggacagccaaggccaacgtcggtggcggcgtctcccanggcgcaaagcagctnccggcttccgcggcggtggccgagaagcgacgagcggagaaggccgaggaggggctgaggaccgtcatgtacctcagctgttggggtccaaatggccgtatgcatttttctaatgcagaggccggagaattccctcttttcaaaaaaaaaaaaagctgttggggtccaaattagcagctgcaacttagtgctagctaggcgtgtgtgtgtttactgcaacaaccatggcctgagaccacgatttaaaaagttggtactagctggcttcccgtggaatcccccattgtnaaaaccacgatgatgatgntgaca

SEQ ID NO: 1655 - DNA, 741 bp, Triticum aestivum
  misc_feature (641)..(641): n is a, c, g, or t
  misc_feature (644)..(644): n is a, c, g, or t
  misc_feature (675)..(675): n is a, c, g, or t
ccacgcgtccgtcaattcagtgagatagttcagaaaatcagctctgttcttttagcatacacaaggatcgcaagtcagtctccactctccagcagcgcagcaagaacaaggaggaggaggagagatggctggtccggcgaaggcgtcatggatggcggcgatgagcgtcggcgcggtggaggcgctcaaggaccaggccgggctcttgccgctggaactatgccctcaggtccatccaccgtgcagccaaggccaacgtccgcggcggcgtctcgcagggcacgaagcagcttccggcagctgtggcggagaggcggcgagcggagaaggccgaggaggggctgaggacggtgatgtacctcagctgctggggcccaaattagaagtaccagtagctcaggcctcaggggtgtagtgttcgttacagcaagtattagtaagcatgcaaccatggcctgagatttggctggctactccctgatcggttgtaaatataccaccacgatgatgatgatgaaaatttcggctatgagcttatagccatggccttctgtggctattttttgagaggccaaagacatatcaagagagggaggaaattcagagttacaccgtgagagtaactcactcagaaaagcganccnttgtgcagaaaacagagcagcttcagctgcntgtacaaaacagagaaggaattcgatctcaacgatacactcagccgccctccaagatctcagacct

SEQ ID NO: 1656 - DNA, 639 bp, Triticum aestivum
catcaatcagccttcatctcagttcattcacaatcagccttcaccttcatctcagtcctcacctacttcagagtttcataccgccaacacatagagatcatggcggctgcagctaaggcgtcttggatggtggcgatgagcgtcggcgccgtggaggcgctcaaggaccaggttgggctctgccgatggaactacgccctcaggtccatccaccgggcagccaaggccagggccaacgtccgcggcggcgtatcgcagggcgctaagcagcttccagcctctgctgtggcggtggcggagaggcggcgtgaggagaaggccgaggaggggctgaggacggtgatgtacctcagctgctggggtctcaattagaagctgcctacttggtatttcctccgtttggaattacctgtctcggaaatggacgtatttagaactaaaatacatctagatatatctattttcgcgacaattaattccgaacggagggagtactagctaggcgtgtctgtggttagtactatggcctgaaaccacgatgtagaaacttggtactagccggcttcgagtggaatcccccattgtaaaaaccacgatgatgatgatgatgataaatttctgttacgtcagttcatatta

SEQ ID NO: 1657 - DNA, 467 bp, Triticum aestivum
  misc_feature (437)..(437): n is a, c, g, or t
ctgactgctagctaccaatttccaggcatcacatagttcagacacatcaatcaacaatgctgtctccaccaacgcaagagagatcatggcgggagcggcgaaggcgtcatggatggtggcgatgagcgttggcgcaggggaggccctcaaggaccaggtcggcctctgtcgctggaactacgtcatcaggtccatccaccgggcagccaaggccagggccaacatccatggaggcgtctcacagggcgccaagcagcttccagcctctgcgggggcggtggcggagaggaggcgagcggagaaggccgaggaggggctgaggacggtgatgtacctcagctgctggggtcccaattagcagctgcaacttggtactagctaggcgtgtccgtgtttgctgcaacaaacaaggcctgaaactgtctggttcccgtggnatcccccgttttaaatacatgatatatgat

SEQ ID NO: 1658 - DNA, 1053 bp, Triticum aestivum
atcagccttcagctcaaaattcattccatactccacactcgactgctagctaccaatctccaggcatcacatagttcggacggatcaagcagttgtactgcctccaccaacgcagagaaagatcatggcgggtgcggcgaaggcgtcttggatggtggcgatgagcgtgggcgccgtggaggccctcaaggatcaggctggactctgccgctggaactacgcgctcaggtccatccaccggactgccaaggccagggccaacgtccacggcgccgtctctcaaggctccaagcagcttccggcctccgccgcagccgtggcggagaagcagcgagccgagaaggccgaggaagggctgaggacggtgatgtacctcagctgctgggggccaaattagcagctgcagcttggtacagcagctgcagcttggtactagctaggcgtgttagtgtttgctgcaacaaccatggcctgaaatctgtctggcttcccgtggaatcccccgttgcaaaataccaccacaatgatgatgatgaaaaatgatgttacttgagcccatgtctatttgcttatttatgatcttggtgaggaatatgcatacatgctctgatttggtgtctgcttacaacccagcaaattgtgacggtcaacgggtcaaggacctagtggcaggacactgagtagggtcagatcaaattttcagtgtccaacaagaggatttggggatacagggacagcaagaagaggagagcaagtgagttctatctcagttctgaataccaatcttcagttacatacagtaggcatcagcctccaacctggacacggccacctcacgcacacgcaacacaatgatttgctaagcaggctgggttgtctccgtttcccttcgatctttagttaatacagtggcccggcccacgggcgcgacacaaacatgctgaatttcttccatctgcggcactttgttaaagtgacacacgcgatgaatcctcgtatctgtgctcaaggtgtcatcaatcaaccaatctatttactgtacttataactata

SEQ ID NO: 1659 - DNA, 1062 bp, Triticum aestivum
caagcatcaatcagccttcagctcaaaattcattccatactccacactcgactgctagctaccaatctccaggcatcacatagttcggacggatcaagcagttgtactgcctccaccaacgcagagaaagatcatggcgggtgcggcgaaggcgtcttggatggtggcgatgagcgtgggcgccgtggaggccctcaaggatcaggctggactctgccgctggaactacgcgctcaggtccatccaccggactgccaaggccagggccaacgtccacggcgccgtctctcaaggctccaagcagcttccggcctccgccgcagccgtggcggagaagcagcgagccgagaaggccgaggaagggctgaggacggtgatgtacctcagctgctgggggccaaattagcagctgcagcttggtacagcagctgcagcttggtactagctaggcgtgttagtgtttgctgcaacaaccatggcctgaaatctgtctggcttcccgtggaatcccccgttgcaaaataccaccacaatgatgatgatgaaaaatgatgttacttgagcccatgtctatttgcttatttatgatcttggtgaggaatatgcatacatgctctgatttggtgtctgcttacaacccagcaaattgtgacggtcaacgggtcaaggacctagtggcaggacactgagtagggtcagatcaaattttcagtgtccaacaagaggatttggggatacagggacagcaagaagaggagagcaagtgagttctatctcagttctgaataccaatcttcagttacatacagtaggcatcagcctccaacctggacacggccacctcacgcacacgcaacacaatgatttgctaagcaggctgggttgtctccgtttcccttcgatctttagttaatacagtggcccggcccacgggcgcgacacaaacatgctgaatttcttccatctgcggcactttgttaaagtgacacacgcgatgaatcctcgtatctgtgctcaaggtgtcatcaatcaaccaatctatttactgtacttataactata

SEQ ID NO: 1660 - DNA, 638 bp, Zea mays
tcaacgcaagcatcaatcagccttcatctcagttcattcacaatcagccttcaccttcatctcagtcctcacctacttcagagtttcataccgccaacacatagagatcatggcggctgcagctaaggcgtcttggatggtggcgatgagcgtcggcgccgtggaggcgctcaaggaccaggttgggctctgccgatggaactacgccctcaggtccatccaccgggcagccaaggccagggccaacgtccgcggcggcgtatcgcagggcgctaagcagcttccagcctctgctgtggcggtggcggagaggcggcgtgaggagaaggccgaggaggggctgaggacggtgatgtacctcagctgctggggtctcaattagaagctgcctacttggtatttcctccgtttggaattacctgtctcggaaatggacgtatttagaactaaaatacatctagatatatctattttcgcgacaattaattccgaacggagggggtactagctaggcgtgtctgtggttagtactatggcctgaaaccacgatgtagaaacttggtactagccggcttcgagtggaatcccccattgtaaaaaccacgatgatgatgatgatgataaatttctgttaaatg

SEQ ID NO: 1661 - DNA, 519 bp, Hordeum vulgare
ggccgccatcaattcagtgagatagttcaagaaaaccagctctgttctttcagtagcgcaacttcgcaagtccactagaacaaggggaagagatggcttctccggccaaggcatcgtggatggtggcgatgagtgtcggcgccgtggaggcgctcaaggaccaggccggcctctgccgctggaactatgctctcaagtccatccaccgggcagccaaggccagggccaacgtccgtggcggcgtctcacagggtgccaagcagcttccggcctctgctgcggcggtggcggagaagcggcgagcggagaaggccgaggaggggctgaggacggtgatgtacctcagctgctggggtccaaattagcactagctgtgattactagttaggcgtttgctgcaacaaccatggcctgaaaccggttggcttccccgtggaatcttccgttgtaaaaaaacacgatgatgatgatgaaaaatttcttttccttcaaaaaaagaattcaatttgaaataaaact

SEQ ID NO: 1662 - DNA, 792 bp, Triticum aestivum
tctgcttctgacactggattgcggaagactagcgggtagactggtgttgacataaaggatcgccttcccagatgattgcgaggtagatgtgaagctggtcgtttaccagaagatgcccctcgtgccgaattcggcacgaggcatctcagttcattcacaatcagccttcaccttcatctcagtcctcacctacttcagagtttcataccgccaacacatagagatcatggcggctgcagctaaggcgtcttggatggtggcgatgagcgtcggcgccgtggaggcgctcaaggaccaggttgggctctgccgatggaactacgccctcaggtccatccaccgggcagccaaggccagggccaacgtccgcggcggcgtatcgcagggcgctaagcagcttccagcctctgctgtggcggtggcggagaggcggcgtgaggagaaggccgaggaggggctgaggacggtgatgtacctcagctgctggggtctcaattagaagctgcctacttggtatttcctccgtttggaattacctgtctcggaaatggacgtatttagaactaaaatacatctagatatatctattttcgcgacaattaattccgaacggagggagtactagctaggcgtgtctgtggttagtactatggcctgaaaccacgatgtagaaacttggtactagccggcttcgagtggaatcccccattgtaaaaaccacgatgatgatgatgatgataaatttctgttacgtcagttcatattactccccttgtctgtctgtttttttgt

SEQ ID NO: 1663 - DNA, 681 bp, Triticum aestivum
gttccttcaccaccacaaaatccacactccactgctatcaaacttcaagcatcacagagttcaggcaggccattcagcggcgtcatctcctccaacgcggcgagaagaacagagttgcagagagatcatggcaggtgcggcgaaggcgtcgtggatggtggcgatgagcgtgggcggcgtggaggcgctcaaagaccaggccgggctctgccgctggaactacgcgctcaggtccatccaccgggcagccaaggccagggccaacgttcgcggtggcgtcttgcagggcgcaaagcagcttccggcttcggcagcggtggcggaaaggcggcgaggggagaaggccgaggaagggctgaggacggtgatgtacctcagctgctggggtcccaattagtactagctacaaagaggtgttttctcctagctccaggctccagcctctgtttagcaacaacttggctggttaattccctgccgattgtaaatacgtactccctctgttccgaattacttgtcttgaatttgtctagatacggatgtatctagacttattttagtgctagatacctccgtatctagacaaatctaagacaagtaatttggaacggagggagtatcacgatgatgatgatgatgaaacctttccccacttcgagttcacattatcctgcttcagaa

SEQ ID NO: 1664 - DNA, 575 bp, Triticum aestivum
attcagcgagatagttcaagagaatcagctctgttctttcagtaccgcaactttgcaagtccactactaccatacagaaggatcacaagtcagtgtccactctccagcagcgcagcaagaacaaggaggaggaggaggaggagagatggctgctccggcgaaggcgtcgtggatggtggccatgagcgtgggcgctgtggaggccctcaaggaccaggctggactctgccgctggaactacgcactcaggtccgtccaccggacagccaaggccaacgttcgaggcggcgcctcgcagggcaagaagcagctgcctgcctccgcggcagccgtggcagagaggcggcgagcggagaattccgaggaggggctgaggacggtcatgtacctcagctgttggggcccaaattaggagtactagtagctagggcataggggcgcttgtgttcgttgcagcaagagtaaccttgtacgaagacatggcctgagagacttcctggttgtcccatgatcggttgtaaagataccatgatgatgatgaaaatttcgcctacgagtttatatcacaaaaaaaa

SEQ ID NO: 1665 - DNA, 550 bp, Triticum aestivum
gcacgaggattcagcgagatagttcaagagaatcagctctgttctttcagtaccgcaactttgcaagtccactactaccatacagaaggatcacaagtcagtgtccactctccagcagcgcagcaagaacaaggaggaggaggaggaggagagatggctgctccggcgaaggcgtcgtggatggtggccatgagcgtgggcgctgtggaggccctcaaggaccaggctggactctgccgctggaactacgcactcaggtccgtccaccggacagccaaggccaacgttcgaggcggcgcctcgcagggcaagaagcagctgcctgcctccgcggcagccgtggcagagaggcggcgagcggagaattccgaggaggggctgaggacggtcatgtacctcagctgttggggcccaaattaggagtactagtagctagggcataggggcgcttgtgttcgttgcagcaagagtaaccttgtacgaagacatggcctgagagacttcctggttgtccccatgatcggttgtaaagataccatgatgatgatga

SEQ ID NO: 1666 - DNA, 565 bp, Triticum aestivum
gatcgacacaaaccagcctcaattcagcgaatcagctctgtgctttcagtaccacaacttcgcaagtccactactactatacacttggatcacaattcagtatcctcgccagcagcgaagcaagaacaaggaggaggagagatggctgctccggcgaaggcatcgtggatggtggccatgagcgtgggcgccgtggaggccctcaaggaccaagccgggctctgccgctggaactatgccctcaagtccatccaccgggcagccaaggccaacgtctgcggcggcatctcgcagggcaccaagcagcttctggcctccgcgtcggccgtggcggagcggcggcgagcggagaaggccgaggaggggctgaggaccgtgatgtacctcagctgctggggcccaaattaggagtactagtagcttaggggtgctgtgtccgttgcagtttgtgcttacgtgacaacgccatgatcgattgtaaatacagcacgatgataatgatgaaaatttcggctatgagtttatatatcaccctccctgtccatgtgcttctgtaactattttg

SEQ ID NO: 1667 - DNA, 511 bp, Triticum aestivum
  misc_feature (471)..(471): n is a, c, g, or t
  misc_feature (473)..(473): n is a, c, g, or t
caacttcgcaagtccactactactatacacttggatcacaattcagtatcctcgccagcagcgaagcaagaacaaggaggaggagagatggctgctccggcgaaggcatcgtggatggtggccatgagcgtgggcgccgtggaggccctcaaggaccaagccgggctctgccgctggaactatgccctcaagtccatccaccgggcagccaaggccaacgtctgcggcggcatctcgcagggcaccaagcagcttctggcctccgcgtcggccgtggcggagcggcggcgagcggagaaggccgaggaggggctgaggaccgtgatgtacctcagctgctggggcccaaattaggagtactagtagcttaggggtgctgtgtccgttgcagtttgtgcttacgtgacaacgccatgatcgattgtaaatacagcacgatgataatgatgaaaatttcggctatgagtttananatcaccctccctgtccatgtgcttctgtaactattttg

SEQ ID NO: 1668 - DNA, 562 bp, Hordeum vulgare
caacaactcaccaacacaagcttccatcacctcagctcacttcttccactaccactgaccaatcatctactgggatcacacgattcacggaccagcccccacccacgcagtccacagatcagctcatggcggctgcagcgaaggcgtcgtggatggcggcgatgagcgtcggcgcggtggaggcgctcaaggaccaggccggcctctgccgctggaactacgctctcaggtccgttcacggcgcagccaaggccaaggccaccatccgcggtggtgtggtctcgcagggcacgaagcggcttccggcctctgcggcggccgtggccgagaggcggcgagcggagaaggccgaggagggcctgcggaccgtcatgtacctcagctgctggggtaccaactaggcaaggccggcggttccgcttgcttcacgtacggcttgctacttgcctcgctgcgggctgcgtctgggttgtaaatagtactatcacgatgatgatgaaaacttctgtgttctgtcgctagcttcagatcttacgaataattacaatgcccttgctttggg

SEQ ID NO: 1669 - DNA, 605 bp, Hordeum vulgare
caacaactcaccaacacaagcttccatcacctcagctcacttcttccactaccactgaccaatcatctactgggatcacacgattcacggaccagcccccacccacgcagtccacagatcagctcatggcggctgcagcgaaggcgtcgtggatggcggcgatgagcgtcggcgcggtggaggcgctcaaggaccaggccggcctctgccgctggaactacgctctcaggtccgttcacggcgcagccaaggccaaggccaccatccgcggtggtgtggtctcgcagggcacgaagcggcttccggcctctgcggcggccgtggccgagaggcggcgagcggagaaggccgaggagggcctgcggaccgtcatgtacctcagctgctggggtaccaactaggcaaggccggcggttccgcttgcttcacgtacggcttgctacttgcctcgctgcgggctgcgtctgggttgtaaatagtactatcacgatgatgatgaaaacttctgtgttctgtcgctagcttcagatcttacgaataattacaatgcccttgctttgggtacctctatttgcttcaaagtttacctatagttattttgagtt

SEQ ID NO: 1670 - DNA, 511 bp, Hordeum vulgare
cggcacgaggatcaattcagtgagatagttcaagaaaaccagctctgttctttcagtagcgcaacttcgcaagtccactagaacaaggggaagagatggcttctccggccaaggcatcgtggatggtggcgatgagtgtcggcgccgtggaggcgctcaaggaccaggccggcctctgccgctggaactatgctctcaagtccatccaccgggcagccaaggccagggccaacgtccgtggcggcgtctcacagggtgccaagcagcttccgccctctgctgcggcggtggcggagaagcggcgagcggagaaggccgaggaggggctgaggacggtgatgtacctcagctgctggggtccaaattagcactagctgtgattactagttaggtggaggtgttcgtgtttgctgcaacaaccatggcctgaaaccggctggcttccccgtggaatctttcattgtaaaaaaccacgatgatgatgatgaaaatttccttttacttcggtaca

SEQ ID NO: 1671 - DNA, 465 bp, Lolium multiflorum
gagaagatggcggctgcagcgaaggcgtcgtggacggtggcgatgagcgtgggcgccgtggaggcgctcaaggaccaggccggcctctgccgctggaactacgcgctcaggtccatccaccgggccgccaaggccaaggcaagcgcccgcggcgccgtctcgcagggcaagaagcagcttccggtctctgcggcggctgtggcagagcagcggcgagcgcagaaggccgaggaagggttgaggacggtgatgtacctcagctgctggggacccaattagtagatgcaagcttggagttagcaatcactagctaggtgtgtttgctgcaacagccatggcctcagacttggctggttggttgtttacttgtttccccattgtaatataccacgacgaaacgatgatgatgaaacttttcagtacgctcattcgcaaaaacaaaagagaatttgtacaaaaaaaaaa

SEQ ID NO: 1672 - DNA, 672 bp, Triticum aestivum
  misc_feature (618)..(618): n is a, c, g, or t
  misc_feature (624)..(624): n is a, c, g, or t
  misc_feature (626)..(626): n is a, c, g, or t
attcggcacgagggcttgcttcaccaccacaaaatccacactccactgctatcaagcttcaagcatcagagagttcaggcagaccattgagcggcatcatctcctccaacgcggcgagaagaacagagttgcagagagatcatggcgggtgcggcgaaggcgtcatggatggttgcgatgagcgtgggcgccgtggaggcgctcaaggatcaggccgggctctgccgctggaactacgcgctccggtccatccaccggactgccaaggccagggccaacgtccgtggcggcgtctcgcagggcgcaaggcagcttccggcttccgcagcggtggcggagaagcgacgagcagagaagaccgaagaggggctgaggaccgtgatgtacctcagctgctggggtcccaattagtactactagctaccaagaggtgttttctcctagctccagcatctgttagaaacttctagcaacaaccacgccgtgtgacttggctggttaattccctgccgattataaatacgtatcacgatgatgatgatgaaacctttccccacttcgagttcacattatccttcttcagaaaggtttgaatgcctttcaaactgatctgtttgnttcaantnctttgggaaatgttgtttccaatttggccaactttgcctgttgccc

SEQ ID NO: 1673 - DNA, 553 bp, Hordeum vulgare
gttcttcgcttactcaacaggttctgcactccacagcttcctaatcttaatcttcaggcatcacagagttcggcctttagacagtctctccatcaacttttgcgaaagaagaagggcaagagatcatggcgggtgcggcgaaggcgtcatggatggtggcgatgagcgtgggcgcggtggaggcccttaaggaccaggccggcctctgccgctggaactacgcgctcaagtccatccacaggaccgccaaggccagagcaaacgtccatggtggcgtctcgctgagcacgaagcagcttccagcgtcggccgcagcggtggcggagaggcggcgggcggagaaggccgaggatgggctgaggaccgtcatgtacctcagttgctggggtcccaactagtgctagcttagcgagaggtgtttctgcagttctgctagctccagccgccagcaacaaccgtggcgtacgtgtgacttggctggttaattccctcctgattgtaaatatgtctcaccatgatgatgatgatgatgatgatgatgaaatttcccccc

SEQ ID NO: 1674 - DNA, 571 bp, Hordeum vulgare
cggcacgagggtcagttcttcgcttactcaacaggttctgcactccacagcttcctaatcttaatcttcaggcatcacagagttcggcctttagacagtctctccatcaacttttgcgaaagaagaagggcaagagatcatggcgggtgcggcgaaggcgtcatggatggtggcgatgagcgtgggcgcggtggaggccctcaaggaccaggccggcctctgccgctggaactacgcgctcaagtccatccacaggaccgccaaggccagagcaaacgtccatggtggcgtctcgctgagcacgaagcagcttccagcgtcggccgcagcggtggcggagaggcggcgggcggagaaggccgaggatgggctgaggaccgtcatgtacctcagctgctggggtcccaactagtgctagcttagcgagaggtgtttctgcagttctgctagctccagccgccagcaacaaccgtggcgtacgtgtgacttggctggttaattccctcctgattgtaaatatgtctcaccatgatgatgatgatgatgatgatgatgaaatttccccccaaag

SEQ ID NO: 1675 - DNA, 541 bp, Hordeum vulgare
atcaattcagtgagatagttcaagaaaaccagctctgttctttcagtagcgcaacttcgcaagtccactagaacaaggggaagagatggcttctccggccaaggcatcgtggatggtggcgatgagtgtcggcgccgtggaggcgctcaaggaccaggccggcctctgccgctggaactatgctctcaagtccatccaccgggcagccaaggccagggccaacgtccgtggcggcgtctcacagggtgccaagcagcttccgccctctgctgcggcggtggcggagaagcggcgagcggagaaggccgaggaggggctgaggacggtgatgtacctcagctgctggggtccaaattagcactagctgtgattactagttaggtggaggtgttcgtgtttgctgcaacaaccatggcctgaaaccggctggcttccccgtggaatctttcattgtaaaaaaccacgatgatgatgatgaaaatttccttttacttcggttcatattactctctttgactgtttgttttttctattatgccat

SEQ ID NO: 1676 - DNA, 596 bp, Zea mays
tcaacacaaacgagcatcaattcagtgagatagttcagaaaatcagctctgttcttttagcatacacaaggatcgcaagtcagtctccactctccagcagcgcagcaagaacaaggaggaggaggagagatggctggtccggcgaaggcgtcatggatggcggcgatgagcgtcggcgcggtggaggcgctcaaggaccaggccgggctcttccgctggaactatgccctcaggtccatccgccgtgcagccaaggccaacgtccgcggcggcgtctcgcagggcacgaagcagcttccggcagctgtggcggagaggcggcgagcggagaaggccgaggaggggctgaggacggtgatgtacctcagctgctggggcccaaattagaagtaccagtagctcaggcctcaggggtgtagtgttcgttacagcaagtattagtaagcatgcaaccatggcctgagatttggctggctgctccctgatcggttgtaaatataccaccacgatgatgatgatgaaaatttcggctatgagcttatagccatggccttctgtggctattttttgagaggccaaagacatatcaagagagg

SEQ ID NO: 1677 - DNA, 1113 bp, Triticum aestivum
ccacgcgtcgaacagattctacactccactactgcccaatcttcaggaacctcaaagttttgcaaaagaaagaagagagagatcatggcgggtgcggcgaaggcgtcatggacggtggcgatgagtgtgggcgcggtggaggcgctcaaggaccaggcggggctctgccgctggaactatgcgctcaagtccatccaccgagctgccaaggccaccgtccgcggtggcgtctcgcagggcagcaagcagcttcaggcctccgcgtcggccgtggcggagaggcgtcgagcagagaaagcagaggaggggctgaggacggcgatgtacctcagttgctggggtcccagttagtggtagctagccagaggtgtttctgcagttctgctagctctatcccccagcaacaaccatgccatgtggcttggctggttgattccctcacgattgtaaatatgtctcaccatgatgatgatgatgatgatgatgaaatctttccccacttttgagttcaaattaccctgattcaggaaaaggtttgaattgcccttaaaacaggcctgtttgcttaggattcttttggaagactattgcttccagttggtcacaagctttgcctgttgctctgttctgttcgctgtttcgacaggcagagcaaaagcagagacccaaaaaattgatcccggtccttttcctatttcgtaggttcagtttcataaacatacaagggatatgtttctactaatcatgggtcgactttcttgtgttgcgtgattattaacaaacaagcgctgaaacgaagcgtgtggcactggaaaccatgtccggctcttctggttttccccttttcaactctcatacatgtggtctcactgtcgcctgtccacaacatcaacgtgaggtgatactgataagattctccaattaagttggtgcagaaacttaacatattttgataccgcactgaaaaggtgattgttcttaaataattttttggtacagttagcatttcttgtatttacatgtcacaagtggttacttttaaaatttgtagggccaaagatttttatttccgaaaggaactaaggtcatatatattaagtatcacaagtccta

SEQ ID NO: 1678 - DNA, 671 bp, Sorghum bicolor
atcaacaagaaatcaacaacgacacagcatcacgattcttgcacacagctcagtacaagtctacagcgatcagcgagcgatcctctgattctgaagccaaacaagctaatctccaagaaagaggaggacatggcgggcgcagcgaaggcgtcgtggatggtggcgatgagcgtgggcgccgtggaggcgctcaaggaccaggcggggctctgccgctggaactacgcgctgcggtccatccaccaggccgccaaggccaacgctcccagcttcgcgcaggccaagaagctggcgccggcgccggcggagaggaggcgggcggacaaggccgcggaggaggggttgaggacggtcatgtacctcagctgctggggccctaattagtcgtcataggtcttagcctcttaggtcctcttgctctgttccagctttgaggtttcagcagatgagcgagcttggcggccgattcgtcctcctgactgtaaatatagaagagcaaatgatgatggtgaaaagttctgtcagttcatccaagtatatggatgcttctgttgcctaatgcttgttgttgtgctttctacgaatcctctgcgctgacaagagttcgtggggattcgaattcgatgcttcggtgtgctaattaaagcagcgacaatcactcaaatgctatg

SEQ ID NO: 1679 - DNA, 580 bp, Triticum aestivum
gaagcatccaacacttcagctcagttcttccactactactgaccaatcatctactgggagggatcacacgcttcacagaccagcctctaccaaagcagttcacagatcagttcatggcggctgcggcgaaggcgtcgtggatggcggcgatgagcgtcggcgcggtggaggcgctcaaggatcaggccggcctctgccgctggaactacgctctcaggtccgttcacggcgcagccaaggccaaggccaacatgcgcggtggtggtgtgatctcgcaaggcacgaagcggcttcccgcctctgcggcggccgtggcagagaggcggcgagcggagaaggccgaggaggggatgaggacggtcatgtacctcagctgctggggtcccaactaggcaaggcggtagttctgcgtgtttaatgcctcgctgcatctgggttgtaaatagtatcacgatgatgatgaaaacttgtacccctctgttcttaaatatttgtagatttcaaatgatctaccacatacagatgtatatagacatattttagagtgtagattcactattttgcttcataagtagtcatt

SEQ ID NO: 1680 - DNA, 601 bp, Triticum aestivum
  misc_feature (571)..(571): n is a, c, g, or t
gaagcatccaacacttcagctcagttcttccactactactgaccaatcatctactgggagggatcacacgcttcacagaccagcctctaccaaagcagttcacagatcagttcatggcggctgcggcgaaggcgtcgtggatggcggcgatgagcgtcggcgcggtggaggcgctcaaggatcaggccggcctctgccgctggaactacgctctcaggtccgttcacggcgcagccaaggccaaggccaacatgcgcggtggtggtgtgatctcgcaaggcacgaagcggcttcccgcctctgcggcggccgtggcagagaggcggcgagcggagaaggccgaggaggggatgaggacggtcatgtacctcagctgctggggtcccaactaggcaaggcggtagttctgcgtgtttaatgcctcgctgcatctgggttgtaaatagtatcacgatgatgatgaaaacttgtacccctctgttcttaaatatttgtagatttcaaatgatctaccacatacagatgtatatagacatattttagagtgtagattcactattttgcttcatangtagtcattgttaaatctctaaaagacaaa

SEQ ID NO: 1681 - DNA, 489 bp, Triticum aestivum
ctcagttcattcacaaccatcaaccgccatctcagttcattcacaaccacaggcactcatacactctacactctacactcgacaactagctactctactactcttcagtcatcacctacttcagagtttcagaccaccaacacacagagagatcatggcgggtgcggctaaggcgtcttggatggtggcgatgagcgtcggcgtcgtggaggcgctcaaggaccaggtcggcctctgccgctggaactatgccctcaaatccatacatcgggcagccaaggccagggcacacgtccgcggcagcgtctcgcagggcgccaggcagcttccggcctctgcggcgggcggtggcccgagaagcagcgagcggagaaggccgaggaagggctgaggacggtgatgtacctcagctgctggggtcctaattaagcagctgcaacttggtaattgctactagctaggcgggctggggttggcggaaccaccatg

SEQ ID NO: 1682 - DNA, 561 bp, Triticum aestivum
tcggcacgaggcagccttcagctcagttcattcgtaaccacaaagtccgcactctacactcgacgacgagccactctacaactcttcagtcatcacctgcttcggagtttcagaccaccaacacacagagagatcatgacaggtgcgactaaggcgtcttggatggtggcgatgagcgtcggcgccgtggaggcgctcaaggaccaggccggcctctgccgctggaactacgcactcaggtccatccgccgggcagccaaggccagggccaacgtccgcagcgtcgtctcgcgggacgccaagcagcttccggcctctgctgcggcggtggcggagaggcggcgagcggagaaggccgaggaggggctgaggacggtgatgtacctcagctgttggggaccaaattagcagctgcaacttggtagtactagctaggcgtgtcggtgtttgctacaacagccatggcctgaaaccactatgtaaaaacttggtactagctggcttcccatggaatcccccattgtaaaaaccacaatgatgacaaatttctgttacttcagc

SEQ ID NO: 1683 - DNA, 620 bp, Triticum aestivum
  misc_feature (172)..(172): n is a, c, g, or t
ccagcgtccgcccacgcgtccgagcaccgatcagcttgcagctccgttccttcaccaccacaaaatccgcactccactgttgtcaatcttcaagcatcagagttcaggcaggccagtcagcgcatcgtctcctccaacgcggcgagaagaacagagttagagagatcatggnaggtgcggcgaaggcgtcgtggatggtggcgatgagcgtgggcggcgtggaggcgctcaaagaccaggccgggctctgccgctggaactacgcgctcaggtccatccaccgggcagccaaggccagggccaacgttcgcggcggcgtcttgcagggcgcaaagcagcttccggcttcggcagcggtggcggaaaggcggcgaggggataaggccgaggaagggctgaggacggtgatgtacctcagctgctggggtcccaattagtactagctacaaagaggtgttttctcctagctccaggctccagcctctgtttagcaacaacttggctggttaattccctgccgattgtaaatacgtatcacgatgatgatgatgatgaaacctttccccacttcgagttcacattatcctgcttcagaaaaagctttgaattgccaaaaaaaa

SEQ ID NO: 1684 - DNA, 490 bp, Triticum aestivum
ggaggatcagctctgccgcaacttcgcaagtccactactgccatacaaaaggatcacaattcagtatcctcgccagcagcgaagcaagaacaaggaggaggaggaggagagatggctgctccggtgaaggcgtcgtggatggtggccatgagcgtgggcgccgtggaggccctcaaggaccaagccaggctctgccgatggaactacgcgctcacgtccatccaccgggcagccaaggccaggaccaacgtccgcggcagcgtctcgcagggccccaagcagcttccggcctccgctgcggctgtggcggagaggcggcgagcagagaaggccgaggaggggctgaggacagtcatgtccctcagctgctgggggccaaattaggggtattagtagcttaggggtgttgtgttcgttgcaacttgtgcttttgcgacaaccccatgatcgtttgtaaatacagcacgattatgttgataaaaattcggct

SEQ ID NO: 1685 - DNA, 564 bp, Hordeum vulgare
cttaagaaaataacaccagctctgttctttcagtatcgcaacttcgcaagccactagtactgagtctccaacaatcaagtcatcagaaacgcaagaccaaaaccaagaagaagcagaagagatggctggtccggcaaaggcgtcgtggatggtggcgatgagcgtgggcgccgtggaggccctcaaggaccaggccggcctctgccgctggaactatgcgctgaagtccatccaccggccagccaaggccagggccaacgtctgtggcggcgtctcgcagggtgccaagcagcttccggcctctgctgcggtgttggcggagaggcggcgagccgagaaggccgaggaggggatcaggaccgtcatgtacctcagctgctggggtccaaattagtagaagctgctacttggtagtagtagtactaggtaggcgtgtctgtgtttggcctgaaaccaccatgtaactagaaacttggtactagctgacttcctgtggaatcactcgctgtaaaaaccacgatgatgataattttttattacttcagttcacaaaaaaaaaaaaaa

SEQ ID NO: 1686 - DNA, 567 bp, Hordeum vulgare
cggacgaggcttagtagaccttaagaaaataacaccagctctgttctttcagtatcgcaacttcgcaagccactagtactgagtctccaacaatcaagtcatcagaaacgcaagaccaaaaccaagaagaagcagaagagatggctggtccggcaaaggcgtcgtggatggtggcgatgagcgtgggcgccgtggaggccctcaaggaccaggccggcctctgccgctggaactatgcgctgaagtccatccaccggccagccaaggccagggccaacgtctgtggcggcgtctcgcagggtgccaagcagcttccggcctctgctgcggtgttggcggagaggcggcgagccgagaaggccgaggaggggatcaggaccgtcatgtacctcagctgctggggtccaaattagtagaagctgctacttggtagtagtagtactaggtaggcgtgtctgtgtttggcctgaaaccaccatgtaactagaaacttggtactagctgacttcctgtggaatcactcgctgtaaaaaccacgatgatgataattttttattacttcagttc

SEQ ID NO: 1687 - DNA, 502 bp, Triticum aestivum
cttcagttcagtgacacagttcaagaaaattccactactaccatacacagcaatcacaagccagtctccagtctccagcaaggcatcaagaccaaggagaaggagaaagagatggctggtccggcgaaggcgtcgtggatggtggccatgagcgtgggcgccgtggaggcgctcaaggaccaggctggcctctgccgctggaactatgccctcaagtccatccaccgggcagccaaggccaacgtccgcgccagcgtctcgcaaggcacgaagcagcttccggcctccgtggtggagaggcggcaagcggagaaggccgaagaggagctgaggacggtcatgtacctcagctgctggggcccaaattaggatcactagtagcttaggggtgttgcgttcgttgtagcttgtgcttatgtgacaatacccttatgatcgattgtaaatacagctcgatgatgatgatgaaaatttctgctatgagtttacaccaaaaaaaaaa

SEQ ID NO: 1688 - DNA, 1101 bp, Triticum aestivum
  misc_feature (226)..(226): n is a, c, g, or t
  misc_feature (349)..(349): n is a, c, g, or t
cagattctacactccactactgcccaatcttcaggaacctcaaagttttgcaaaagaaagaagagagagatcatggcgggtgcggcgaaggcgtcatggacggtggcgatgagtgtgggcgcggtggaggcgctcaaggaccaggcggggctctgccgctggaactatgcgctcaagtccatccaccgagctgccaaggccaccgtccgcggtggcgtctcgcagngcagcaagcagcttcaggcctccgcgtcggccgtggcggagaggcgtcgagcagagaaagcagaggaggggctgaggacggcgatgtacctcagttgctggggtcccagttagtggtagctanccagaggtgtttctgcagttctgctagctctatcccccagcaacaaccatgccatgtggcttggctggttgattccctcacgattgtaaatatgtctcaccatgatgatgatgatgatgatgatgaaatctttccccacttttgagttcaaattaccctgattcaggaaaaggtttgaattgcccttaaaacaggcctgtttgcttaggattcttttggaagactattgcttccagttggtcacaagctttgcctgttgctctgttctgttcgctgtttcgacaggcagagcaaaagcagagacccaaaaaattgatcccggtccttttcctatttcgtaggttcagtttcataaacatacaagggatatgtttctactaatcatgggtcgactttcttgtgttgcgtgattattaacaaacaagcgctgaaacgaagcgtgtggcactggaaaccatgtccggctcttctggttttccccttttcaactctcatacatgtggtctcactgtcgcctgtccacaacatcaacgtgaggtgatactgataagattctccaattaagttggtgcagaaacttaacatattttgataccgcactgaaaaggtgattgttcttaaataattttttggtacagttagcatttcttgtatttacatgtcacaagtggttacttttaaaatttgtagggccaaagatttttatttccgaaaggaactaaggtcatatatattaagtatcacaagtccta

SEQ ID NO: 1689 - DNA, 480 bp, Triticum aestivum
agcatcagttccttcggtaccgtagctgtaagcaacgcagcaagaagcatagaccatggcagctccagccaaggcatcgtggatggtggcgatgagcgtgggcactgtggaggcgctcaaggaccaggccgggctctgccgctggaactacacgctcaggtccatccaccgggcagccaaggccaacgtccgcagcggcgtctcgcagggtaacaagcagctgcctgcctcagtgtccgccgtggccgagaggcgcccagcggagaaggccgaggaggggctgaggactgtcatgtaccttagctgctggggcctaaattaggagtggtagtagctaggagtgttgtgtttgttgcagcaagcaacttagtattactaagcatccatgggctgagacttggctctggttgacccctgatcggtttgtaaagataccaggacgatgatgatgatgaaaattttggctatgagttcataatt

SEQ ID NO: 1690 - DNA, 464 bp, Triticum aestivum
aagcaacgcagcaagaagcatagaccatggcagctccagccaaggcatcgtggatggtggcgatgagcgtgggcactgtggaggcgctcaaggaccaggccgggctctgccgctggaactacacgctcaggtccatccaccgggcagccaaggccaacgtccgcagcggcgtctcgcagggtaacaagcagctgcctgcctcagtgtccgccgtggccgagaggcgcccagcggagaaggccgaggaggggctgaggactgtcatgtaccttagctgctggggcctaaattaggagtggtagtagctaggagtgttgtgtttgttgcagcaagcaacttagtattactaagcatccatgggctgagacttggctctggttgacccctgatcggtttgtaaagataccaggacgatgatgatgatgaaaattttggctatgagttcataatttctaaaaaaaaaa

SEQ ID NO: 1691 - DNA, 577 bp, Triticum aestivum
tgcaggcaattcggcacgaggagcagtccagcaagcaaagacaagcatcagcttagttccttcggtaccgtagctgtaactccgtgagtccactacacaaatcgctctccactctccagcaagcaacgcggcaagaagcatagaccacggcagctgcagccaaggcgtcgtggatggtggcgatgagcgtgggcgcgctcgaggcgctcaaggaccaggccggcctctgccgctggaaatacgcgctcaggtccatccaccgtgcagccaaggccaacgtccgcagcggcgtctcgcagggtaacaagcagctgcctgccacagtggccgccgtggcggagaggtggcgagcggagaaggccgaggaggggctgaggactgtcatgtaccttagctgctggggcctaaattaggagtggtagtagctaggagtgttgtgtttattgcagcaagtaatttagtattagtataagcatgcagccatgtcctagactgagctggttgccccctgatcgattgtaaagatatcacgacgatgatgatgatgaaaattttggttatgagtttaaaaaaaaaa

SEQ ID NO: 1692 - DNA, 493 bp, Triticum aestivum
  misc_feature (7)..(7): n is a, c, g, or t
tgcaggnaattcggcacgaggagcagtccagcaagaaagacaagcatcagcttagttccttcggtaccgtagctgtaactccgtgagtccactacacaaatcgctctccactctccagcaagcaacgcggcaagaagcatagaccacggcagctgcagccaaggcgtcgtggatggtggcgatgagcgtgggcgcgctcgaggcgctcaaggaccaggccggcctctgccgctggaaatacgcgctcaggtccatccaccgtgcagccaaggccaacgtccgcagcggcgtctcgcagggtaacaagcagctgcctgccacagtggccgccgtggcggagaggtggcgagcggagaaggccgaggaggggctgaggactgtcatgtaccttagctgctggggcctaaattaggagtggtagtagctaggagtgttgtgtttattgcagcaagtaatttagtattagtataagcatgcagccatgtcctgagac

SEQ ID NO: 1693 - DNA, 593 bp, Setaria italica
aacctcacacacatcactacagcgatcaccaaccgagctctctactagacaagacctgcgaatcccggagaagaaggacatggcggctgcagcgaaggcatcgtggatggtggcgatgagcgtcggcgcggtggaggcgctcaaggatcaggcggggctctgccgctggaactacgccctgcggtcgatccaccggatggccaaggccaacgctcctagcttcgcacaggccaagaagctggccccggcgacggcggcggcggagaggcggcgagcggacaaggccgaggaggggatgagaaccgtcatgtacctcagttgctggggacctaactagtcttcgccgtctgtctgtttcagccttctgcaaccgagcttgagcttgaggccatgcatgccggttcagttggcctctctgattgtaatatagtatgatgatgatgaaaatttctggcacttcattcaaggaagtgaatctgctgaaattctatcgttgcgctccttacaactaggccatgttaatcaaccatgttctcccatcaaaagagatcaacgacaatctgaccatggtctcccatcaaaagagatcttac

SEQ ID NO: 1694 - DNA, 459 bp, Pennisetum glaucum
aagcagagctctctagcacacgcacacccgaacgaacaagaaggaaggaaggccaagcaggacgtactcgaggagatggccggagcagcgaaggcgtcgtggatggtggcgatgagcgtgggcgccgtggaggcgctcaaggaccaggcgggcctctgccgctggaactacgcgctgcgctccgcccaccgcgccgccaaggccaacgccccgagcttcgcgcaggccaagaagatggccacgcccgcggcggcggagaggaggcgagcggacaaggccgaggaggggatgaggaccgtcatgtacctcagctgctggggacctaactagttcttcaccgtcctctactgtttcggccttctgcaaccgagcataggcttcagaccatgcatctcggggagtcggcctctctgattgtaatatactatgatgatgatgatgatgatgaaaatttctggc

SEQ ID NO: 1695 - DNA, 548 bp, Triticum aestivum
tcagttcaggcagtccacaaaaaacgaacaagcatcagcacactttcttcactaccgcaagttcagtagctctacagacacagagatcacaattcagtatcttctctccagcaacttgggaacaagaaggggaggagatggctggtccagcgaaggcttcgtggatggtggcgatgggcgtgggcgccgtggaggcgctcaaggaccaggccgggctctgccgctggaactatgccctcaggtccatccatcggacagccaaggcaaaggccaacgtccgcggcggcggcggcgtctcgcaaggcaagaagcagcttccgacctctgcggcggcagtgacggagaggcggcgagcagacaaggccgaggaggggctgaggacggtcatgtacctcagctgctggggcccaaactaggagtactatagtagctagaggtgttgtgttcgtcggagcaaagtatgcagccatggcctgagacctggctgattgccctttccccaccgttgtaagataccacggtgatgatgatgaaagtttcggcctcaa

SEQ ID NO: 1696 - DNA, 582 bp, Triticum aestivum
gcacaaacaggcatcagttcaggcagtccacaaaaaacgaacaagcatcagcacactttcttcactaccgcaagttcagtagctctacagacacagagatcacaattcagtatcttctctccagcaacttgggaacaagaaggggaggagatggctggtccagcgaaggcttcgtggatggtggcgatgggcgtgggcgccgtggaggcgctcaaggaccaggccgggctctgccgctggaactatgccctcaggtccatccatcggacagccaaggcaaaggccaacgtccgcggcggcggcggcgtctcgcaaggcaagaagcagcttccgacctctgcggcggcagtgacggagaggcggcgagcagacaaggccgaggaggggctgaggacggtcatgtacctcagctgctggggcccaaactaggagtactatagtagctagaggtgttgtgttcgtcggagcaaagtatgcagccatggcctgagacctggctgattgccctttccccaccgttgtaagataccacggtgatgatgatgaaagtttcggcctcaatttacgactgtaaaaaaaaaa

SEQ ID NO: 1697 - DNA, 800 bp, Triticum aestivum
cttcagctcagttcttcgactgcgactcaccaatcatctactgggatcacacgcttcacagaccaacctccaccaacgcagttcacaggtcacttcatggcggctgcagccaaggcgtcttggatggcggcgatgagcgtcggcgccgtggaggcgctcaaggaccaggccggcctctgccgctggaactacgctctcagggccattcacggcgcagccaagggcaaggccagcatccgccgcggtgctgtggtctcgcaaggcacgaagcggcctccggcctctgcggcggccgtggcagagaggcggcgagcggagaaggccgaggaggggctgcggacggtcatgtacctcagctgctggggtcccaactaggcagggccggtagctgtgtgtgctctacggttttgctacttgcctcgttgcatgtgggttgtactgtaaatagtatcacgatgatgatgaaaacatcatgatgatgatgaaaactttgttctgtcaccagcttggcttcagaatttatgaagcacaagatcctagaccgattactcctggtactagttctctgatccaagtgacagaattgggtgataacaaagttctcttaggccttgttcggttgcgtgcgaatccgagtggattgaaagggtttaaaggggatttaaacctcttgtaagtcaaaatacaaaccaatccttaccaatccccttcaattctttgaaaagaggattaaccggacaagcccttagcagtttcgtgttcctagccttgattaaagttttttcgaaccaaaaaaaaaa

SEQ ID NO: 1698 - DNA, 804 bp, Triticum aestivum
tcggcacgaggctcagttcttcgactgcgactcaccaatcatctactgggatcacacgcttcacagaccaacctccaccaacgcagttcacaggtcacttcatggcggctgcagccaaggcgtcttggatggcggcgatgagcgtcggcgccgtggaggcgctcaaggaccaggccggcctctgccgctggaactacgctctcagggccattcacggcgcagccaagggcaaggccagcatccgccgcggtgctgtggtctcgcaaggcacgaagcggcctccggcctctgcggcggccgtggcagagaggcggcgagcggagaaggccgaggaggggctgcggacggtcatgtacctcagctgctggggtcccaactaggcagggccggtagctgtgtgtgctctacggttttgctacttgcctcgttgcatgtgggttgtactgtaaatagtatcacgatgatgatgaaaacatcatgatgatgatgaaaactttgttctgtcaccagcttggcttcagaatttatgaagcacaagatcctagaccgattactcctggtactagttctctgatccaagtgacagaattgggtgataacaaagttctcttaggccttgttcggttgcgtgcgaatccgagtggattgaaagggtttaaaggggatttaaacctcttgtaagtcaaaatacaaaccaatccttaccaatccccttcaattctttgaaaagaggattaaccggacaagccctagcagtttcgtgttcctagccttgattaaagttttttcgaaccaaaaaaaaaa

SEQ ID NO: 1699 - DNA, 560 bp, Zea mays
tcaacacaaacaggcatcagttcaggcagtccacaaaaaacgaacaagcatcagcacactttcttcactaccgcaagttcagtagctctacagacacagagatcacaattcagtatcttctctccagcaacttgggaacaagaaggggaggagatggctggtccagcgaaggcttcgtggatggtggcgatgggcgtgggcgccgtggaggcgctcaaggaccaggccgggctctgccgctggaactatgccctcaggtccatccatcggacagccaaggcaaaggccaacgtccgcggcggcggcggcgtctcgcaaggcaagaagcagcttccgacctctgcggcggcagtgacggagaggcggcgagcagacaaggccgaggaggggctgaggacggtcatgtacctcagctgctggggcccaaactaggagtactatagtagctagaggtgttgtgttcgtcggagcaaagtatgcagccatggcctgagacctggctgattgccctttccccaccgttgtaagataccccggtgaaaaggatggtgatgatgatg

SEQ ID NO: 1700 - DNA, 535 bp, Avena sativa
gatcaacccaaacgattcagcagtcagctcaatcccttcactttagtacaaagtccacattccaccacatagtaatctccagacatcgtgtcagcagtctccaccaacacaacacagcaaggagaagaagagaaatcaatggcgggtgcggcgaaggcatcgtggatggtggtgatgagcgtgggcgcggtggaggcgctcaaggatcaggcagggctctgccgctggaactacgctctcaggtccatccaccgtgcagccaaggccaaggccagcgtccgcggcgccgtctcgcagcagagcaagaagcagattccggcctccgcggtggcggtggcggagcggaggcgagcgaagaaggccgaggaggggctgaggacagtgatgtatctcagctgctggggacccaattagctgctgcgagcctgcaattagcaatcagtaggtagctaggtgtgtttgctaccatggcccgagacttggcttgttgccttgttggttcgccagtgtaatataccaccacgactatgatgat

SEQ ID NO: 1701 - DNA, 431 bp, Triticum aestivum
cacagagttttccaccagcgcgacaagaagaagagagagatcatggcgggtgcggcgaaggcgtcatggacggtggcgatgagcgtgggcgccgtggaggcgctcaaggaccaggccgggctctgccgctggaactacgcgctcaagtccatccacaggaccgccaaggccagagtaaatgtccacggtggcgcctcacagagcacgaagcagcttccggcgtctgctgcagcggtggcggagaggcggcgagcggagaaggccgaggaggggctgaggaccgtcatgtacctcggttgctggggtcccaattgttagatgtgtatagtctctttctggtttatccccattgtataaggggttttctgcactttaccatacatgtatatgtattggcctttggccctcagtaaagttagttgcccattcct

SEQ ID NO: 1702 - DNA, 459 bp, Triticum aestivum
  misc_feature (447)..(447): n is a, c, g, or t
ccacgccgtcccgcacagagttttccaccagcgcgacaagaagaagagagagatcatggcgggtgcggcgaaggcgtcatggacggtggcgatgagcgtgggcgccgtggaggcgctcaaggaccaggccgggctctgccgctggaactacgcgctcaagtccatccacaggaccgccaaggccagagtaaatgtccacggtggcgcctcacagagcacgaagcagcttccggcgtctgctgcagcggtggcggagaggcggcgagcggagaaggccgaggaggggctgaggaccgtcatgtacctcggttgctggggtcccaattgttagatgtgtatagtctctttctggtttatccccattgtataaggggttttctgcactttaccatacatgtatatgtattggcctttggccctcagtaaagttagttgcccattcctaanaaaaaaaaaaaa

SEQ ID NO: 1703 - DNA, 540 bp, Avena sativa
gaacacaagcaacgcaagcatcgatctagttctcacacaccaccgcaagtcactactagacacagcgatcagaaaatcattctccggttctccgccaacgcagcaagaagaagagatggcgggtgcagggaaggcgtcgtggatggtggcgatgagcgtgggcgccgtggaggcgctcaaggaccaggccggcctctgccgctggaactacgcgctcaggtccatccaccgggcagtcaatgccaaggccggcggccgcgcggctgcctcgcagagcaagaagcagcttcctccattcatagcggcggtggcagagaggcggcgagcggagaaggccgaggaggggctgaggacggtgatgtatctcagctgctggggacctaattagacaatttagtggccgcaacagccaggacggcatggcctgaaacttggctggttgcttggccccattgtaatataccaccaccatgctgatgatgatgaaaatttcagttactctttactatcgatgatttacaataatattttctcttaatg

SEQ ID NO: 1704 - DNA, 556 bp, Triticum aestivum
tcaacacaaaccagcgtcaattcagcgagatagtccaagagaatcagctctgttctttcagtaccgcaacttcccaagtcctctactgccatacagaaggatcacaagtcagtgtccactctccagcagcgcagcaagaagaacaaggacaaggagggatggctgccccggcgaaggcgtcgtggctggtggccatgagcgtgggcgctgtggaggccctcaaggaccaggcggggctttgccgctggaactatgcgctcagctccatccaccgggcagacaaggccagggccaacgtccgcggcggcgtctcgcagggccccaagcagcttgcggcctctgctgcggcggtggccgagaggcgacgggcagagaaggccgaggaggggctgaggaccatgatgtacctcagctgttggggcccaaattaggagtactagtagcttagtggtgttgtgttcgtcgcagcttgtgcttaggcgacaaccccatgatcgatgtaaatacaacaccatgatgatgatgaaaatctcggctatgatgatgttgaaaatct

SEQ ID NO: 1705 - DNA, 527 bp, Triticum aestivum
agatagtccaagagaatcagctctgttctttcagtaccgcaacttcccaagtcctctactgccatacagaaggatcacaagtcagtgtccactctccagcagcgcagcaagaagaacaaggacaaggagggatggctgccccggcgaaggcgtcgtggctggtggccatgagcgtgggcgctgtggaggccctcaaggaccaggcggggctttgccgctggaactatgcgctcagctccatccaccgggcagacaaggccagggccaacgtccgcggcggcgtctcgcagggccccaagcagcttgcggcctctgctgcggcggtggccgagaggcgacgggcagagaaggccgaggaggggctgaggaccatgatgtacctcagctgttggggcccaaattaggagtactagtagcttagtggtgttgtgttcgtcgcagcttgtgcttaggcgacaaccccatgatcgatgtaaatacaacaccatgatgatgatgaaaatctcggctatgatgatgttgaaaaa

SEQ ID NO: 1706 - DNA, 890 bp, Hordeum vulgare
gcgtccgcatcgatcggcttgcagctgagtacttcaccacaacaaatccacactcgactgctagtaatcttcaagcatcgcagagttcaggaagaccagtcaggggtatcgtctcctccaacgcccgcgagaagaacagaggtacagagagggatcatgacgagtgcggccaaggcgtcgtggatgatggcaatgagcctgggcgctgtggaggcgctcaaggaccaggccggcctctgccgctggaactacgccctcaggtccatccaccgtgcagccaaggccaaggccaacgtccgcggaggcgtctcgcagggcgccaagcagcttccggcctcttctgcggcggaggcggagaagcggcgagcggagaaggccgaggaggggctgaggacggtcatgtacctcagctgctggggtcccaattagtactagttaccaagaggtgttttagcctctggtacaaacctctagcaacaacgacgccctgtgacttggctggttgattccctgcggattgtaaatacgtatcacgatgatgacgacgaaaccttgccccgcttcgagttcacattatcgtgctttagaaaaaggtttgcgttgcctttcaaacaaatctgtttgctacggattctttacgaagattattgctcaagttggtcacaagctttgcatgttgctctcttctgttcaatgggcagagcaagatcgggacacacaaaattgatcatgtccatgagttttccgccagcttgaacagatgataatcaatacttatttttgtcgaattagtttcgtaggttcagttttataaccatatgaatatgataaacaatacttttttctggcgaattagtttcgtaggttcagttttataaacatataatagc

SEQ ID NO: 1707 - DNA, 508 bp, Hordeum vulgare
gaaaatcagctctgttcaacttcgcaagtccactactacttactacacacaaggagcacaagtcagtttccactctccagcagcgcagcaagaataagaagtataggagaagcgatggctggtccggcgaaggcatcgtggatggtggcgatgagcgtgggcgcggtggaggcgctcaaggaccaggccgggctctgccgctggaactacgccctcaggtccattcaccgggcagccaaggcgaacgtccgcggcggcgtcgtgcatggcccgaagcagcttccggcctccccggctgagaggcggcgagcggagacggacgaggaggggctgaggacggtcatgtaccttagctgctggggacctaattaggagtactagtagtacctaatagggctgatgtgttcgttgcagcaagtaacttagtattagtaaagcttgcagcaatggcgttagacttgatcggttgtaaagacaccacgacaacaatgatgatgaaaacttcggc

SEQ ID NO: 1708 - DNA, 540 bp, Hordeum vulgare
agttcaggaaaatcagctctgttcaacttcgcaagtccactactacttactacacacaaggagcacaagtcagtttccactctccagcagcgcagcaagaataagaagtataggagaagcgatggctggtccggcgaaggcatcgtggatggtggcgatgagcgtgggcgccgtggaggcgctcaaggaccaggccgggctctgccgctggaactacgccctcaggtccattcaccgggcagccaaggcgaacgtccgcggcggcgtcgtgcatggcccgaagcagcttccggcctccccggctgagaggcggcgagcggagacggacgaggaggggctgaggacggtcatgtaccttagctgctggggacctaattaggagtactagtagtatctaatagggctgatgtgttcgttgcagcaagtaacttagtattagtaaagcttgcagcaatggcgttagacttgatcggttgtaaagacaccacgacaacaatgatgatgaaaacttcggctatcagtttataatttatattaccc

SEQ ID NO: 1709 - DNA, 467 bp, Triticum aestivum
agctcactgagacagctcaaagaaatcaaatcagctctgttcaacttcgcaagtccactagtagtactacacacaagggatcacaagtcagtttccactccagcagcgcagcaagaacaagaagtataggagaagcgtatggctgctccggcgaaggcgtcgtggatggtggcaatgagcgtgggcgcagtggaggccctcaaggaccaagccgggctctgccgctggaactacgcgctcaggtccatccaccgggctgccaaggccagcgtccgcggcggcgtctcgcatggcaagaagcagcttccggccaccgcggtggtggagacgtggcgagcggagaaggctgaggaggggctgaggaccgtcatgtacctcagctgctggggcccaaattaggagtactagtacttagggttgctgtgtttgttgcagcttgtgcttatgcgacaaccccatgatcgatg

SEQ ID NO: 1710 - DNA, 566 bp, Panicum virgatum
gcgtgacagcttcgatcagtgatcacaacgatcaccaagcaaagcaagccctcgagtacaccaaggaggcaagagaaccaggcggcgagaccggagaagaagaacctagcagaaagcagatggccggtgcggctaaggcgtcgtggatggtggcgatgagcgtgggcgccgtggaggcgctcaaggaccaggccggcctctgccgctggaactacgcgctgcgctccgtccaccgggccgccaaggccaacgcccccagcttcgcgcaggccaagaaactggcggcggcggagagaaggcgggcggacaaggcggaggagggcatgaggaccgtcatgtacctcagctgctgggggccgaactgagctcgggtttcggcggtcggtctctgttttggctttcggcgactgagctcggatttagatctgggctggccggttgcctgattgtaacatatactatactacgatgatgatgatgaaaagttctctcactgggtttcagtatatgaatgcctaaatgctactgtactggaatgaaaataaaattgctcttcagttcataac

SEQ ID NO: 1711 - DNA, 401 bp, Pennisetum glaucum
gcacgaggagcatcttccactcacagatcacagcaccactgcacagacatcggtacatcgccaaccgagctctcaatctctagctaatcaccaggttgtgcaaaagctccgagaagaagaagagaaggagatggcggccgcagcgaaggcgtcgtggatggtggcgatgagcgtcggcgcggtggaggcgctcaaggaccaggtggggctctgccgctggaactacgcgctgcgatccatccaccgcgccgctaaggccaacgccccgagcttggcgcaggccaagaagctggcaccggcggcggagcggaggcgggcggacaaggccgaggagggcatgaggaccgtcatgtacctcagctgctggggacctaactaatcgccatggatcttgcttcgtc

SEQ ID NO: 1712 - DNA, 603 bp, Pennisetum glaucum
cgctcaccccctccgctatattaacccaccagctccgcctctcctcgtcatcttcaacgcagcaactctctctgatcacagcgatcaccaagcaaagaaatctctctagcacacctggccgagaaggaaggaagaccaaccaaggactcgaggagatggccggagcagcgaaggcgtcgtggatggtggcgatgagcgtgggcgcggtggaggcgctcaaggaccaggcgggcctctgccgctggaactacgcgctgcgatccatccaccgcgccgccaaggccaacgccccgagcttcgcgcaggccaagaagctggcaccggcggcggggaggcgggcggacaaggccgaggagggcatgaggaccgtcatgtacctcagctgctggggacctaactaatcgccatggatcttgcttcgtcagatttttagaaaccgggctcggcttgtcggcttgagacctggccggcccagttgctccccaggttgtaaatatatgatgatgaatcgatgatggatctgagggtttcgtgtggccggcccagttgctccccaggttgtaaatatatgacgatgaatcgatgatggatctgagggtttcg

SEQ ID NO: 1713 - DNA, 600 bp, Triticum aestivum
atcagctctgttctttcaacaccgcaactttgcaagtccactagtactagacacagcaatcacaaatcagtttccactctctcttttggttatatttccgttatgtcgcagtaatggaaaggggtaatgcccggttaaaaaaaaagtttccactctctagcaacgcggcaagaacaagaaggcggcgatggctggtccggcgaaggcgtcctagatggtggcgatgagcgtgggcgctgtggaagcgctcaaggaccaggcagggctctgccgctggaactatgcgctgaggtccattcaccggagcaccaaggccaaggccaatgtccccggcggtgcatcgcaagtcaagaagcagctgcctgcctccgcagcagccgtggcggagaggcggcgagcgcggaaggccgaggaggggctgaggacggtcgtgtacctcagttgctggggcctaaattaggagcactggtagctagggaagcatgcagccatggcccgcgacttggctggctgccccctgatcgattgtaaagataccatgacgacgacgacgacgatgatgatgatgaaaaaaatgggctagagtttataatttaaaaa

SEQ ID NO: 1714 - DNA, 600 bp, Triticum aestivum
  misc_feature (575)..(575): n is a, c, g, or t
atcagctctgttctttcaacaccgcaactttgcaagtccactagtactagacacagcaatcacaaatcagtttccactctctcttttggttatatttccgttatgtcgcagtaatggaaaggggtaatgcccggttaaaaaaaaagtttccactctctagcaacgcggcaagaacaagaaggcggcgatggctggtccggcgaaggcgtcctagatggtggcgatgagcgtgggcgctgtggaagcgctcaaggaccaggcagggctctgccgctggaactatgcgctgaggtccattcaccggagcaccaaggccaaggccaatgtccccggcggtgcatcgcaagtcaagaagcagctgcctgcctccgcagcagccgtggcggagaggcggcgagcgcggaaggccgaggaggggctgaggacggtcgtgtacctcagttgctggggcctaaattaggagcactggtagctagggaagcatgcagccatggcccgcgacttggctggctgccccctgatcgattgtaaagataccatgacgacgacgacgacgatgatgatgatgaaaaaantgggctagagtttataatttaaaaa

SEQ ID NO: 1715 - DNA, 879 bp, Hordeum vulgare
gatcggcttgcagctgagtacttcaccacaacaaatccacactcgactgctagtaatcttcaagcatcgcagagttcaggaagaccagtcaggggtatcgtctcctccaacgcccgcgagaagaacagaggtacagagagggatcatgacgagtgcggccaaggcgtcgtggatgatggcaatgagcctgggcgctgtggaggcgctcaaggaccaggccggcctctgccgctggaactacgccctcaggtccatccaccgtgcagccaaggccaaggccaacgtccgcggaggcgtctcgcagggcgccaagcagcttccggcctcttctgcggcggaggcggagaagcggcgagcgaagaaggccgaggaagggctgaggacggtcatgtacctcagctgctggggtcccaattagtactagttaccaagaggtgttttagcctctggtacaaacctctagcaacaacgacgccctgtgacttggctggttgattccctgcggattgtaaatacgtatcacgatgatgacgacgaaaccttgccccgcttcgagttcacattatcgtgctttagaaaaaggtttgcgttgcctttcaaacaaatctgtttgctacggattctttacgaagattattgctcaagttggtcacaagctttgcatgttgctctcttctgttcaatgggcagagcaagatcgggacacacaaaattgatcatgtccatgagttttccgccagcttgaacagatgataatcaatacttatttttgtcgaattagtttcgtaggttcagttttataaccatatgaatatgataaacaatacttttttctggcgaattagtttcgtaggttcagttttataaacatataatagc

SEQ ID NO: 1716 - DNA, 505 bp, Hordeum vulgare
ttccgcccagttcattcataatccacaaagtccgactagtcaacgaaaagagagatcatggcgggtgcggcgaaggcatcttggatggtggccatgagcgtgggcgctgtggaggccctcaaggaccaggccggcctctgccgctggaactacgcgctcaagtccatccagcgagctgccaaggccagggccaacgtgcgagccagcgtgtcgcagggcaagaagcagctacctgcctctgcctcggccatggcggagaaggccgaggaggggctgaggaccgtcatgtacctcagctgctggggtcccaattagtagtagctgatacctgagagccaggaggtgttttctcctagctccatccatgacgcctttgatgcatgaggagcttttgtgaaagcctgaaacaaccatgtcctcaaacctggctggcctccttgggaagaaccccccattgtaaaataccacgatgacgatgatgatgatgaaaaacgatgttacttga

SEQ ID NO: 1717 - DNA, 544 bp, Hordeum vulgare
cggcacgaggcaccaatcagccttccgcccagttcattcataatccacaaagtccgactagtcaacgaaaagagagatcatggcgggtgcggcgaaggcatcttggatggtggccatgagcgtgggcgctgtggaggccctcaaggaccaggccggcctctgccgctggaactacgcgctcaagtccatccagcgagctgccaaggccagggccaacgtgcgagccagcgtgtcgcagggcaagaagcagctacctgcctctgcctcggccatggcggagaaggccgaggaggggctgaggaccgtcatgtacctcagctgctggggtcccaattagtagtagctgatacctgagagccaggaggtgttttctcctagctccatccatgacgcctttgatgcatgaggagcttttgtgaaagcctgaaacaaccatgtcctcaaacctggctggcctccttgggaagaaccccccattgtaaaataccacgatgacgatgatgatgatgaaaaacgatgttacttgagttcaaaaaaaaaaaaa

SEQ ID NO: 1718 - DNA, 579 bp, Setaria italica
ctctctgatcacagcgatcaccaagcaagctctctagtacacccgagaaggaagaagaccaggactcgaggagatggccggagcggcgaaggcgtcgtggatggtagcgatgagcgtgggcgccgtggaggcgctcaaggaccaggcgggcctctgccgctggaactacgccctgcggtccgtccaccggaacgccaaggccaacgtgcgcagcctcgcgcaggccaagaagatggccccggcggcaacggcggcggagaggaggcgcgcggacaaggccgaggaggggatgaggaccgtcatgtacctcagctgctgggggccgaactgagctcggctttcagtttcagcggtcgtgtctctgattgggctttcggcaaccgagatcggtttaagatcgacttggccggttgccttggcgcctgatttgtaacatagttctatgatgatgatgaaaagttctgtcgctcggtttcagtatatgaatgtctgtgctactgtactggaacggaaataaaattgctcttgagttgatgacaagctctccgtgaatcattttggactaattaacatgttatg

SEQ ID NO: 1719 - DNA, 704 bp, Saccharum officinarum
catcacgattctttcacacaactcactacaagcacaagactacaagcctacaacaatcagcgagcgatccggtcaagccaatagccaaacaggaggacatggcgggcgcagcgaaggcatcgtggatggtggcgatgagcgtgggcgcggtggaggcgctcaaggaccaagcggggctctgccgctggaactacgcgctgcggtccctccaccggaccgccaaggccaacgctcccagcttcgcgcaggccaagaagctggcgccggcggaaaggaggcgagcggacaaggccgaggaggggatgaggacggtcatgtacctcagctgctggggccctaattagtcataggtcttaggtcctcttgctctggtccagctttgaggtttcagcaacagagctttggcttggaacatgaccggccggttcgtcctcctgattgtaaatatatgacgagcagatgatgatggttaaaagttcttgtccgtttattcaagttttggacgcttctgttggttgttgtctaaaaaaaaaaaataatgggctaatttggactattgtcttttgtcttccttctacttctttttttctatgaattcgtttcttacgtatgttagatctttagatgacataattttttgttttaatatttacggtaagtttgttgtatcatacttaacattttatttagataccttgttatgt

SEQ ID NO: 1720 - DNA, 556 bp, Panicum virgatum
gcatcacaattcacacaacctcactgcagcgaccggcgacagcgagctatctctcgagacaggcagctaataagctccgacctccgaggaagaaggacatgtcgggtgcggcgaaggcgtcgttgatggtggcgatgagcgtgggcgctgtggaggcgctcaaggaccaggcgggcctctgccgctggaactacgcgctgcgatccgtccaccgggccgccaaagccagcgctcccagcttcgcgcaggccaagaagctggccccggctgcggcggcggcggagaggcggcgggcggacaaggccgaggagggcatgaggacagtcatgttcctcagctgctggggtcctaattaggcgtgatttggttgtctagctctgtttcagcttagagcaagcgactaagcgagctttgccttcaggcctggccggttgctcctagcctcctgattgtaaatacacgacgacgatgatgatgatgaaaagttctgccacttctgctactgtatgatctctttgcgctcacacaacaaagactttcgtgtggttcgatgtgc

SEQ ID NO: 1721 - DNA, 576 bp, Sorghum bicolor
ccccgccggcccgcctcccagctcaccacaacacagcatcacacaacttgacatcctactgtgagtcatcggcgattcagcgagcagcacacctgaccaaccgaactctgtagccaccaagaaccgaggaggagcaggagaaggacggacatggcggcagcagcgaaggcgtcgtggatggtggcgatgagtgtgggcgccgtggaggcgctcaaggaccaggcggggctctgccgctggaactacgcgctgcggtccatccaccaggccgccaaggccaacgctcccagcttcgcacaggccaagaagaagctggcgccggcggagaggaggcgggcggacaaggccgaggaggggatgaggaccgtcatgtacctcagctgctggggccctaattagttattgggcatagttgcttaggtcctctagctcttttccagctttcagtaacccagatcggtcctctggttgtaaaaatatgaccacgatgatgatgatgaaaagttctgtttcttcattctgagtatatgaatgaatgcttctgccttctgtaattggagtactgtgctctcctcg

SEQ ID NO: 1722 - DNA, 491 bp, Saccharum officinarum
catcacacaacctcacagcactactgcgagtcatcagcgatcagcacaccaaccaaactctctagccgagagcccaagaaccgaggaggagtagaaggacatggcggctgcagcgaaggcgtcgtggatggtggcgatgagcgtgggcgcggtggaggcgctcaaggaccaggcgggcctctgccgctggaactacgcgctgcggtccatccaccgggccgccaaggccaacgctcccagcttcgcgcaggccaagaagctggcgccggcggagaagaggcgggcggacaaggccgaggaggggatgaggaccgtcatgtacctcagctgctggggtcctaattaattattaggcatatctgcataggtcctctagctctgttccagctttcagcaacagaaattggtcctctggttgtaaatatatgaccacgatgatgatgaaaagttctgttacttgattcgagtatatgaatgaatgcttctgcctt

SEQ ID NO: 1723 - DNA, 589 bp, Hordeum vulgare
gcttcaattcagtgagacagctcaagaaaatcaactcttcgcaagtccactagtactagacacagcgatcagaaatcaagtcttgagtcttcactccagcaacgcaagaccaaaaaccaattagaagcagaagagatggctgctccggcgaaggcgtcgtggatggtggcgatgagtgtcggcgccgtggaggccctcaaggaccaggccggcctctgccgctggaactatgctctcaagtccatccaccgggcagccaaggccaggaccaacgtctgtggcggcgcctcacggggtgccaagcagcgtccggcctctgctgcggcggtggcggagaagcggcgagccgagaagggcgaggaggggatgaggacggtgatgtacctcagctgctggggtccaaattagcactagctctgattactagttaggcagaggcgttcgtatttgctgcaacaaccatactgaattgtaaaaaaccacgatgatgatgttgatgaaaatttccttttacttcagtttatattactctctttgtttgttttttctattatcttgttgaggaatatgcattgatgctttaatttgg

SEQ ID NO: 1724 - DNA, 494 bp, Triticum aestivum
atcaatccagtgagacagttcaagaaaataagctctgttctttgcaccgcaacttcgcaagtccactactacgatacagaaggatcacaagtcagtctccactatccagcagcacagcaagaacaaggtggaggagaagagatggctgctccggcgaaggcatcgtggatggtggccacgagcgtgggcaccgtggaggccctcaaggaccaagctgggctctgccgctggaactatgcgctcagctccatccaccgggcagccaaggccaggaccaacgtctgcggaggcgcctcgcagggcaccaagcagctttcggcttccgcggcggccgtggcggagaggcggcgagtggagaaggccgatgaggggctgaggacagtcatgtacctcagctgttgggggccaaattaggagtactagtagctagctagggcctaaagatgcttgtgttcgttgcagcaagagtaacctagcaagcagacatggcttga

SEQ ID NO: 1725 - DNA, 397 bp, Triticum aestivum
gcagcagcacagcaaaaacaaaaagtataggagaagcgatggctattgcggcgaaggcatcgtggatggtagccatgagcgtgggcactgtggaggcgctcaaggaccaagcgaggctttgccgctggaactacgcgctcaggtccatccaccgagctgccaaggccaaggccaccgtccgtggtggcgtctcgctgggcaccgagcagcttctggcctccacggctgctgtggcggagagacggcgagcgacgaaggctgaggaagggctgaggactgtcatgtacctcagctgccgggggccaaattaggagtactagtagcttaggggtgttgagtttgttgatgatgatgatgatgatgatatatacacctccttgtcaaaaaaaaaaaaaaa

SEQ ID NO: 1726 - DNA, 1109 bp, Oryza sativa
gtcgtaaattaattatcatcttgtcttatttctttctacaaggcgatcgagtacttgcttgcttacagttacagacactagaaaagtactccatgggcgaaatgaagaggtaaaacagcagcgaatggaacagaaaggaagcatggtggtggtcgtcgtggcatggatggcgtctagtgttagtagcaactcttctcattattactgtactggccatcagcttttgctgctaacgctaatagcctctctcatctcagtatattcatcagtaaaaagcaatggactgctgcttgtgcaggtgagggagtgagcgagcactatactagtagtggtaagagaagagagaaatctaagagagagagagagagagagatggatcatcaccagcaccacgagcagcagcagcagcggatggtggagatgcggatggggatggcgatgggcgaggcgtacgtcgggggaggagaggtggtggcgcgggaggcggcggcgcaggcgctgggggcggtggtgcagctgcacttcgacaagacgctggagaagaagcgggcggcggacgcgcagaagcaggagctgtggcgcctcttcctcgccttcttcctcttcctcgccatcctcctctccgccgtcgcccagtccccgccgtcccgcctccagtgccgccacctctgggcccccgccggcctcctctccctcgcccacctcgccttctacgccgccgtcgcacaccacctccgatgcctcaacggattcaggtcgctctaattgcctcttgcttaatttgcttgctactacttaattacttgcttacttacttagcagcaattaatggcgcgcgaatgaatatactaggtaccagcggcgttgccacaagctgaccctggcgctggcggcggacaggctgcggatgctcaagtccggcggcgacgtggtggcggccgccgacgtggaggtgccgtaccaggagccgcccgagagctacctggccaagttcaagcgcagctgggccatccacttcgccttcctcatcaccaccttcgccttctccgtcgccgccgccgtcgccatcctctgcttctagctctcagatctcctctcaactggactac

SEQ ID NO: 1727 - DNA, 1300 bp, Oryza sativa
cacaacttaattaagcagcagcattagcagctcaattactgaaaacaccaaagttgatattctttacaaggaacttctaaaccaccatcttcttcaaggtttcagccatggtggttccggtgatcaacttctccaagctcgacggcaccgccgcggagagggccgagacgatggcgcagatcgacaatggctgcgaggagtggggattcttccagctggtgaaccatggcgtcccgaaggagcttcttgatcgggtgaagaagctaccgactccgggaggcggcgttcatggagtcgagccggtgaggacgctggaggggctcatggcggcggagcggcgcggcgaggcggcggcgccggtggacgacatggactgggaggacatcttctacctccacgacgacaaccagtggccgtcgaaaccgccggagttcaaggagacgatgcgggagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcaaccaggtggaggtgctcagcaacggccgctaacgcagcgcgtggcaccgcgtcctccccatgcgcgacggcaaccggcgctccgtcgcgtccttctacaacccggccttcgaggcgaccatctcgccgacggtggagggcggcgccggcgccggcggcgagtacccggagtacgtgttcggggagtacatggatgtgtacgccaagcaaaagttcgatgcgaaggagccacgcttcgaggcagtcaaggcgccaaaatctgcttaaattaattactataattaattaatgggcaatataatagagtaaaattgaattaaaaattttcaattatttatggattaagtggaactatgttaattttaatatattttctatgattatgaaataaagtaattgtaaattttaatcgggctgtaggtattttcaactaggactagaggttgtaagagtttgtcatgtgggattgttagccgtgccaatattattggaatgagaattgatcgatttgttaatagaaattacctggtttggtt

SEQ ID NO: 1728 - DNA, 1311 bp, Hordeum vulgare
tggctcatccagcacctgcagataacaaccatctcattgtagagagatcagatcagagcctacctagcttctcagttctcactcatcttcgcccaagaatttcaccatggttgtcccggtcatcgacttctcgaagctcgacggcgccgagagggcggagacgatggcgcagatcgccgacggctgcgagaactggggcttcttccagctggtgaaccacggcatccccttggagcttcttgatcgcgtcaagaaggtgtgctccgagagctaccgcctgcgggaggccgcgttccggtcgtcggagccggtgcagacactggagaggctcgtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctccacgcaccattcttcggcaccaaggtcagccactacccgccgtgcccgcgcccagacctcatcaccggactccgcgcgcacaccgacgccggcggcgtcatcctgctgttccaggacgacaaggtcggcggccttgaggtgctcaaggatggccagtggctggacgtgcagccgctccccgacgccatcgtggtcaacaccggcgaccaggtggaggtgctcagcaacggccgctaccgcagcgcttggcaccgcgtcctgcccatgcgcaacggcaaccgccgctccatcgcgtccttctacaacccggcgttcgaggcggccatctcgccggcggtgggcgaaggcggcgccgccgcgtacccggactacgtgttcggagattacatggacgtgtacaacaagcagaagttcgatgccaaggagccaagattcgaggccgtcaaggcgccgaagtcagcttaataagcttataatcaaggagattaaaagaaaattatttacctattagcttgctttgttttacaatgaagaaaactatgtttttttggagtttatttagacgcgtaacaatgtgatgtggggatacttatgattggttcggtgtgaaataattggaaaatgaaatactgtggatttttcattggaagtatctgtttactttacatgagccccgcttcgatacaaatgtatcactcatccctgataaatatataaagtataatatagatatttgacgagtt

SEQ ID NO: 1729 - DNA, 1267 bp, Triticum aestivum
cctgcagataacaaccatctcattgtagagagatcagaccagagcctacctagctactcactcatcttcgtcaagaacttcaccatggttgtcccggtcatcgacttctccaagctcgacggcgccgagagggccgagaccatggcgcagatcgccgacggctgcgagaactggggcttcttccagctggtgaaccacggcatcccgctggagcttcttgaccgcgtcaagaaggtgtgctccgagagctaccgcctccgggaggccgcgttccggtcgtccgagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcactggagacggcctccacgcgccattcttcggcaccaaggtcagccactacccgccgtgcccgcgcccggacctcatcaccgggctccgcgcgcacaccgacgccggcggcgtcatcctgctgttccaggacgacaaggtaggcggcctcgaggtactcaaggacggcgagtggctcgacgtgcagccgctccccgacgccatcgtcgtcaacaccggcgaccaagtggaggtgctcagcaacggccgctaccgcagcgcgtggcaccgcgtcctgcccatgcgcaacggcaaccgccgctccatcgcgtctttctacaacccggcgttcgaggcggccatctcgccggcggtgggcgaaggcgccgccgccgcgtacccggactacgtgttcggggattacatggacgtgtacaacaagcagaagttcgatgccaaggagccaaggttcgaggccgtcaaggcgccaaagtcagcttaaggcttaagctcaatcaaggagattaaaaaggaaattatttacctattagctggcttttgttttacaatgaagaaaaaaaatgtatttttgagtttgctcagacgcgtagcagtatgatgtggggatacttgtgattggttcggtgtcaaataattaggaaatgaaatatggatttttcgttggaagtatctgctttcgttacatttgtttgattgtgctttatcatttgatcagtacctcggccgcgaccacgcta

SEQ ID NO: 1730 - DNA, 1198 bp, Triticum aestivum
cctgcagataacaaccatctcattgtagagagatcagaccagagcctacctagctactcactcatcttcgtcaagaacttcaccatggttgtcccggtcatcgacttctccaagctcgacggcgccgagagggccgagaccatggcgcagatcgccgacggctgcgagaactggggcttcttccagctggtgaaccacggcatcccgctggagcttcttgaccgcgtcaagaaggtgtgctccgagagctaccgcctccgggaggccgcgttccggtcgtccgagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcactggagacggcctccacgcgccattcttcggcaccaaggtcagccactacccgccgtgcccgcgcccggacctcatcaccgggctccgcgcgcacaccgacgccggcggcgtcatcctgctgttccaggacgacaaggtaggcggcctcgaggtactcaaggacggcgagtggctcgacgtgcagccgctccccgacgccatcgtcgtcaacaccggcgaccaagtggaggtgctcagcaacggccgctaccgcagcgcgtggcaccgcgtcctgcccatgcgcaacggcaaccgccgctccatcgcgtctttctacaacccggcgttcgaggcggccatctcgccggcggtgggcgaaggcgccgccgccgcgtacccggactacgtgttcggggattacatggacgtgtacaacaagcagaagttcgatgccaaggagccaaggttcgaggccgtcaaggcgccaaagtcagcttaaggcttaagctcaatcaaggagattaaaaaggaaattatttacctattagctggcttttgttttacaatgaagaaaaaaaatgtatttttgagtttgctcagacgcgtagcagtatgatgtggggatacttgtgattggttcggtgtcaaataattaggaaatgaaatatggatttttcgttggaaaa

SEQ ID NO: 1731 - DNA, 1312 bp, Leymus cinereus x Leymus triticoides
  misc_feature (688)..(688): n is a, c, g, or t
  misc_feature (1039)..(1039): n is a, c, g, or t
  misc_feature (1087)..(1087): n is a, c, g, or t
  misc_feature (1260)..(1260): n is a, c, g, or t
  misc_feature (1278)..(1278): n is a, c, g, or t
tgaatttttcttgcatttattttttatgcagagaatgtctcgaggagcatagcgagccctataaaaaggccagtggctctcactcactccatctcaaacagcacctgcagataacaaccatctcattgtagagagatcagatcagagcctagctacctagctactcactcatcttctcaagaatttcaccatggttgttccggtgatcgacttctccaagctcgacggcgccgagagggccgagaccatggcgcagatcgccgacggctgcgagaactgggggttcttccagctggtgaaccatggcatcccgctggagcttcttgaccgcgtcaagaaggtgtgctccgagagctaccgcctccgggaggcggcgttccggtcgtccgagcccgtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggacgcatgaaggccgccttcaccggcgacggcctccacgcgccattcttcggcaccaaggtcagccactanccgccgtgcccgcgcccggacctcatcaccgggctccgcgcgcacaccgacgccggcggcgtcatcctgctgttccaggacgacaaggtcggcggccttgaggtgctcaaggacggcgagtggctcgacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcctccttctacaacccggcgttcgaggcggccatctcgccggcggtgggcgaaggcggcggggccgcgtacccggactacatgttcggggattanatggacgtgtacaacaagcagaagttcgatgccaaggagccaagattngaggctgtcaagacgccaaagtcagcttaagcttaatatcatggcgattaaagaaacatgtttatttattatttggatatgaattgatctaaatatggaccatcccactagaaaaattccaatgttacacatgtacatccattcttgggttcatcatattcataagtgataantagcgacaagatttgtantacgcactactttttgtgtctggtaaatgcaata

SEQ ID NO: 1732 - DNA, 1188 bp, Triticum aestivum
ccacgcgtccgcctgcacttgcatccacaagactgcacacaacaccacacccgagtctgaaactctgaaaaagctcaccgtcaccaattcaccatggttgttccggtgatcgacttctccaagctcgaccgcgtcgagagggcggagaccatggcgcagatcgccgacggctgcgagaactggggcttcttccagctggtgaaccacggcatcccgctggagctccttgaccgcgtcaagaaggtgtgctccgagagctaccgcctccgggaggcggcgttccggtcgtcggagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctccacgccccgttcttcggcaccaaggtcagccactacccgccgtgcccgcgcccggacctcatcaccgggctccgcgcgcacaccgacgccggcggcgtcatcctgctgttccaggacgacaaggtcggcggcctcgaggtgctcaaggacggcgagtggctggacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggcgaaggtggcgccaccgcgtacccggactacgtgttcggggattacatggacgtgtacaacaagcagaagttcgatgccaaggagccaagattcgaggccgtcaaggcgccaaaggcagcttaagcttaatcaaggagactaaaagaaaattatttacttattagctggcttttgttttacaatgaagaaaaaaaatgtatttttggagtttattcagacgcgtagcaaatatgatgtgtgggggtaattgtgattggttcggtgtcaaataattaggaaatgaagtatgga

SEQ ID NO: 1733 - DNA, 1192 bp, Triticum aestivum
cctgcacttgcatccacaagactgcacacaacaccacacccgagtctgaaactctgaaaaagctcaccgtcaccaattcaccatggttgttccggtgatcgacttctccaagctcgaccgcgtcgagagggcggagaccatggcgcagatcgccgacggctgcgagaactggggcttcttccagctggtgaaccacggcatcccgctggagctccttgaccgcgtcaagaaggtgtgctccgagagctaccgcctccgggaggcggcgttccggtcgtcggagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctccacgccccgttcttcggcaccaaggtcagccactacccgccgtgcccgcgcccggacctcatcaccgggctccgcgcgcacaccgacgccggcggcgtcatcctgctgttccaggacgacaaggtcggcggcctcgaggtgctcaaggacggcgagtggctggacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggcgaaggtggcgccaccgcgtacccggactacgtgttcggggattacatggacgtgtacaacaagcagaagttcgatgccaaggagccaagattcgaggccgtcaaggcgccaaaggcagcttaagcttaatcaaggagactaaaagaaaattatttacttattagctggcttttgttttacaatgaagaaaaaaaatgtatttttggagtttattcagacgcgtagcaaatatgatgtgtgggggtaattgtgattggttcggtgtcaaataattaggaaatgaagtatggatttttcattaaaaaa

SEQ ID NO: 1734 - DNA, 1246 bp, Triticum aestivum
tcaccatggttgttccggtgatcgacttctccaagcttgacggcgccgagagggccgagacgatggcgcagatcgccgacggctgcgagaactggggcttcttccagctggtgaaccacggcatccctctggagcttcttgaccgcgtcaagaaggtgtgctccgagagctaccgcctccgggaggcggcgttccggtcgtccgagccggtgcagacgctggagagactggtggacgcggagcggcgcggcgagccggtggcgccagtcgacgacatggactgggaggacatcttctacctccacgacgacaaccagtggccgtccgacccgccggccttcaaggagaccatgcgtgagtaccgcgccgagctcaagaagctcgcggagcgggtcatggaggccatggacgagaacctcggcctcgacaagggccgcatgaaggccgccttcaccggcgacggcctccacgcgccgttcttcggcaccaaggtcagccactacccgccgtgcccgcggccggacctcatcaccgggctccgggcgcacaccgacgctggcggcgtcatcctgctgttccaggacgacaaggtcggcggtcttgaggtgctcaaggacggcgagtggctcgacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcctccttctacaacccggcgtttgaggcggccatctcgccggcggtgggcgaaggccgcgctgccgcgtacccagactacgtgtttggggattacatggatgtgtacaacaagcagaagttcaatgccaaggagccaagattcgaggccgtcaaggcgccaaaggcagcttaagcttaatatcatggcgattacacgacaactatttacctattagctggcttttgttttacaatgaagaaaaaaaaagtgtttctgggcgatggtgctacagtgcctagtggcgatttgggcgatttgccggcgactggcgtctatgccgtgcttcccttcccggttccccctgatcccttctcccctcagctatcttctcttctgatctggttttcctctagattccccctctatctctttccctttctcatgtattggtctcccttcctctgttatctgtctcgtcttcgaatcctacttctaagtcaaaaaaa

SEQ ID NO: 1735 - DNA, 1235 bp, Triticum aestivum
tccgcctgcagataacaaccatctcattgcacagagatcagatcagagcctacctagctactcactcaccttcgtcgagaacttcaccatggttgtcccggtgatcgacttctccaagctcgacggcgccgagagggcggagaccatggcgcagatcgccgacggctgcgagaactggggcttcttccagctggtgaaccacggtatcccactggagcttcttgaccgcgtcaagaaggtgtgctccgagagctaccgcctccgagaggcggcgttccggtcgtccgagccggtgcagacgctggagaggctggtggagacggagcggcgcggcgaggcggtggcgccggtggacgacatggactgggaggacatcttctacctccacgacgacaaccagtggccgtccgacccgccggccttcaaggagaccatgcgggagtaccgcgccgagctcaagaagctcgcggagcgggtcatggaggccatggacgagaacctcggcctcgacaagggccgcatgaaggcggccttcaccggcgacggcctccacgcgccgttcttcggcaccaaggtcagccactacccgccgtgcccgcgcccggacctcatcaccggactccgggcgcacaccgacgctggcggcgtcatcctgctgttccaggacgacaaggtcggcggccttgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggcgaaggcgccgccgccgcgtacccggactacgtgtttggggattacatggatgtgtacaacaagcagaagttcgatgccaaggagccaagattcgaggccgtcaaggcgccaaaggcagcttgattttaatcaaggagattaaaaggaaattatttactctacctattagctggctttgttttacaatgaagaaaaaaattgtatttttggagtttattcagacgcgtagcaaatatgatgtgtggggataattgtaattggttcggtgtcaaatgattaggaaacgaagtatggatttttcattgaaaaagtatctgcttttttgaggggtaaaaaaaaaaaa

SEQ ID NO: 1736 - DNA, 1214 bp, Leymus cinereus x Leymus triticoides
ctgcagataacaaccatctcctattttccttctagagagatcagatcagagcctacctagctagctagtagccagctactcaccttcttcaagaacttcaccatggttgtcccggtgatcgacttctctaagcttgacggcgccgagagggccgagacgatggcccagatcgccgacggctgcgagaactgggggttcttccagctggtgaaccacggcatccccttggagcttcttgatcgcgtcaagaaggtgtgctccgagagctaccgcctccgggaggcggcgttccggtcgtcggagccggtgcagacgctggagaggctcgtggaggcggagcgccgcggcgaggcggtggcgccggtggacgacatggactgggaggacatcttctacctccacgacgacaaccagtggccgtccgacccgccggccttcaaggagaccatgcgggagtaccgcgccgagctcaagaagctcgcggagcgggtcatggaggccatggacgagaacctcggcctcgacaaggggcgcatgaaggcggccttcaccggcgacggcctccacgcgccattctttggcaccaaggtcagccactacccgccgtgcccgcgcccggacctcgtcaccggactccgcgcgcacaccgacgccggcggcgtcatcctgctgttccaggacgacaaggtcggcggccttgaggtgctcaaggacggcgagtggctggacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtcattctacaacccggcgttcgaggcggccatctcgccggcggtgggcgaaaacggcgccgccgcgtacccggactacgtgttcggagattacatggatgtgtacaacaagcagaagttcgaggccaaggagccaaggttcgaggccgtcaaggcgccaaaggcggcttaattttaatcaaggagatgaagaagaaaattatttacctattagctggggctttgttttgcaatgaagaaaaatattatttttggagtttattcagacgcgtagctatatgatgtggggatacttgtgattgatccggtgtcaaataattaggaaatgaaatatggatttttcattggaaaaaaaaa

SEQ ID NO: 1737 - DNA, 1296 bp, Hordeum vulgare
ggctcatccagcacctgcagataacaaccatctcattgtagagagatcagatcagagcctacctagcttctcagttctcactcatcttcgcccaagaatttcaccatggttgtcccggtcatcgacttctcgaagctcgacggcgccgagagggcggagacgatggcgcagatcgccgacggctgcgagaactggggcttcttccagctggtgaaccacggcatccccttggagcttcttgatcgcgtcaagaaggtgtgctccgagagctaccgcctgcgggaggccgcgttccggtcgtcggagccggtgcagacactggagaggctcgtggaggcggagcggcgcggcgaggcggtggcgccggtggacgacatggactgggaggacatcttctacctccacgacgacaaccagtggccctccgacccgccggccttcaaggagaccatgcgggagtaccgctccgagctcaagaagctcgcggagcgggtcatggaggccatggacgagaacctcgggctggacaagggacgcatgaaggcggccttcaccggcgacggcctccacgcgccattctttggcactaaggtcagccactacccgccgtgcccgcgcccggacctcatcaccgggctccgcgcccacaccgacgccggcggcgtcatcctgctgttccaggatgacaaggtcgggggccttgaggtgctcaaggatggccagtggctggacgtgcagccgctcgccgacgccatcgtggtcaacaccggcgaccaggtggaggtgctcagcaacggccgctaccgcagcgcttggcaccgcgtcctgcccatgcgcaacggcaaccgccgctccatcgcctccttctacaacccggcgttcgaggcagccatctcgccggcggtgggcgaagccggcgccgccgagtacccggactacgtgttcggggattacatggacgtgtacaacaagcagaagttcgaggccaaggagccaagattcgaggccgtcaaggcgccaaaggcagcttaataagcttataatcaaggagattaaaagaaaattatttacctattagcttgctttgttttacaatgaagaaaactatgtttttttggagtttatttagacgcgtaacaatgtgatgtggggatacttatgattggttcggtgtgaaataattggaaaatgaaatactgtggatttttcattggaagtatctgtttactttacatgagccccgcttcgatacaaatgtatcactcatccctgataaatatataaagtataatatag

SEQ ID NO: 1738 - DNA, 1205 bp, Triticum aestivum
cctgcagataacaaccatctcattgcacagagatcagatcagagcctacctagctactcactcaccttcgtcgagaacttcaccatggttgtcccggtgatcgacttctccaagctcgacggcgccgagagggcggagaccatggcgcagatcgccgacggctgcgagaactggggcttcttccagctggtgaaccacggtatcccactggagcttcttgaccgcgtcaagaaggtgtgctccgagagctaccgcctccgagaggcggcgttccggtcgtccgagccggtgcagacgctggagaggctggtggagacggagcggcgcggcgaggcggtggcgccggtggacgacatggactgggaggacatcttctacctccacgacgacaaccagtggccgtccgacccgccggccttcaaggagaccatgcgggagtaccgcgccgagctcaagaagctcgcggagcgggtcatggaggccatggacgagaacctcggcctcgacaagggccgcatgaaggcggccttcaccggcgacggcctccacgcgccgttcttcggcaccaaggtcagccactacccgccgtgcccgcgcccggacctcatcaccggactccgggcgcacaccgacgctggcggcgtcatcctgctgttccaggacgacaaggtcggcggccttgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggcgaaggcgccgccgccgcgtacccggactacgtgtttggggattacatggatgtgtacaacaagcagaagttcgatgccaaggagccaagattcgaggccgtcaaggcgccaaaggcagcttgattttaatcaaggagattaaaaggaaattatttactctacctattagctggctttgttttacaatgaagaaaaaaattgtatttttggagtttattcagacgcgtagcaaatatgatgtgtggggataattgtaattggttcggtgtcaaatgattaggaaacgaagtatggatttttcattgaaaaaaaaaaaa

SEQ ID NO: 1739 - DNA, 1056 bp, Triticum aestivum
gagatcagatccgagcctacctagctactcactcaccttcgtcaagaacttcaccatggttgtcccggtaatcgacttctccaagctcgacggcgccgagagggcggagaccatggcgcagatcgccgacggctgcgagaactggggcttcttccagctggtgaaccacggcatcccgctggagctacttgactgcgtcaagaaggtgtgctccgagagctaccgcctccgggaggcggcgttccggtcgtccgagcccgtgcagacgctggagaggctggtggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctcctcgcgccgttctttggcaccaaggtcagccactacccgccgtgcccgcgcccggacctcatcaccgggctccgcgcgcacaccgacgccggcggcgtcatcctgctgttccaggacgacaaggtgggcggcctcgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggggaaggcgccgccgccgcgtacccggactacgtgttcggggattacatggatgtgtacaacaagcagaagttcgatgccaaggagccaaggttcgaggccgtcaaggcgccaaaggcagcttaagattaatcaaggagattaaaagaaaaatatttacctattagctggcttttgttttacaatgaaaaaaaaaaaaa

SEQ ID NO: 1740 - DNA, 1174 bp, Triticum aestivum
gagatcagatccgagcctacctagctactcactcaccttcgtcaagaacttcaccatggttgtcccggtaatcgacttctccaagctcgacggcgccgagagggcggagaccatggcgcagatcgccgacggctgcgagaactggggcttcttccagctggtgaaccacggcatcccgctggagctacttgactgcgtcaagaaggtgtgctccgagagctaccgcctccgggaggcggcgttccggtcgtccgagcccgtgcagacgctggagaggctggtggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctcctcgcgccgttctttggcaccaaggtcagccactacccgccgtgcccgcgcccggacctcatcaccgggctccgcgcgcacaccgacgccggcggcgtcatcctgctgttccaggacgacaaggtgggcggcctcgaggtgctcaaggacggcgagtggctggacgtgcagccgctccccgacgccattgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggggaaggcgccgccgccgcgtacccggactacgtgttcggggattacatggatgtgtacaacaagcagaagttcgatgccaaggagccaaggttcgaggccgtcaaggcgccaaaggcagcttaagattaatcaaggagattaaaagaaaaatatttacctattagctggcttttgttttacaatgaagaaaaaaaaaaggtaattttggagtttattcagacgcgtagcaaatatgatgtgtggggataattgtgattggttcggtgtcaaataattaggaaatgaagtatggatttttcattgaaaaaaaaaaaa

SEQ ID NO: 1741 - DNA, 1110 bp, Pseudoroegneria spicata
cctgcagataacaaccatctcattgcagagagatcagatcagatcagagcctactcactcatcttcgtcaagaatttcaccatggttgtcccggtgatcgacttctccaagctcgacggctccgagagggcggagaccatggcgcagatcgccgacggctgcgagaactgggggttcttccagctggtgaaccacggcatccccttggagcttcttgaccgcgtcaagaaggtgtgctccgagagctaccgcctccgggaggcggcgttccggtcatccgagccggtgcagacgctggagaggctggtggaggaggagcgccgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctcgacaagggacgcatgaaggcggccttcaccggagacggcctccacgcgccattcttcggcaccaaggtcagccactacccgccgtgcccgcgcccggacctcatcaccggactccgcgcgcacaccgacgccggcggcgtcatcctgctgttccaggacgacaaggtcggcggcctcgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcctccttctacaacccggcgttcgaggcggccatctcgccggcggtgggcgaaggcgccgccgccgcgtacccggactacgtgttcggggattacatggatgtgtacaacaagcagaagttcgatgccaaggagccaagattcgaggccgtcaaggcgccaaaggcagcttgattttacttaaggagagtaaaagaaaattatttacctattagctggctttgttctacaacgaagaaaaaaaaagtatttttggagtttatgcatacgcgtaga

SEQ ID NO: 1742 - DNA, 1327 bp, Triticum aestivum
ccacgcgtccgcctgcacttacatccacaagactgcacacaacaccacacccgagtctgaaactctgagaagctcatcgtcaccaattcaccatggttgttccggtgatcgacttctcgaagctccacggcgccgagagggcggagaccatggcccagatcgccgacggctgcgagaactggggcttcttccagctggtgaaccacggcatcccgctggagctccttgaccgcgtcaagaaggtgtgctccgagagctaccgcctccgggaggcggcgttccggtcgtccgaacccgtgcagacgttggagaggctggcggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgcgtcatggaggccatggacgagaacctcggcctggacaagggacgcatgaaggccgccttcaccggcgacggcctccacgcgccgttcttcggcaccaaggtcagccactacccgccgtgcccgcgcccggacctcatcaccgggctccgcgcgcacaccgacgccggcggcgtcatcctgctgttccaggacgacaaggtcggcggccttgaggtgctcaaggacggcgagtggctcgacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggtggccatctcgccggcggtgggcgaaggcgccgccgccgcgtacccggactacgtgttcggggattatatggacgtgtacaacaagcagaagttcgaggccaaggagccaagattcgaggccgtcaaggcgccaaaggcagcttaagcttaatatcatggcgattacacgacaactatttacctattagctggcttttgttttacaatgaagaaaaaaaaagtgtttctgggcgatggtgctacagtgcctagtggcgatttgggcgatttgccggcgactggcgtctatgccgtgcttcccttcccggttccccctgatcccttctcccctcagctatcttctcttctgatctggttttcctctagattccccctctatctctttccctttctcatgtattggtctcccttcctctgttatctgtctcgtcttcgaatcctacttctaagtca

SEQ ID NO: 1743 - DNA, 1083 bp, Triticum aestivum
gtatacggcgacccacgcgtccgcctgcacttacatccacaagactgcacacaacaccacacccgagtctgaaactctgagaagctcatcgtcaccaattcaccatggttgttccggtgatcgacttctcgaagctccacggcgccgagagggcggagaccatggcccagatcgccgacggctgcgagaactggggcttcttccagctggtgaaccacggcatcccgctggagctccttgaccgcgtcaagaaggtgtgctccgagagctaccgcctccgggaggcggcgttccggtcgtccgaacccgtgcagacgttggagaggctggcggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgcgtcatggaggccatggacgagaacctcggcctggacaagggacgcatgaaggccgccttcaccggcgacggcctccacgcgccgttcttcggcaccaaggtcagccactacccgccgtgcccgcgcccggacctcatcaccgggctccgcgcgcacaccgacgccggcggcgtcatcctgctgttccaagacgacaaggtcggcggccttgaggtgctcaaggacggcgagtggctcgacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggtggccatctcgccggcggtgggcgaaggcgccgccgccgcgtacccggactacgtgttcggggattatatggacgtgtacaacaagcagaagttcgaggccaaggagccaagattcgaggccgtcaaggcgccaaaggcagcttaagcttaatatcatggcgattaaacgaaaattatttacctattaagctggcttt

SEQ ID NO: 1744 - DNA, 1281 bp, Hordeum vulgare
agctcatcccatcaccttacatccacaagtttgcacacaacaccacccgagtctgaaactctgagaaagctcatcgtcgccaattcaccatggttgttccggtgatcgacttctccaagctcgacggcgccgagagggcggagaccatggcgcagatcgccgacggctgcgagaactgggggttcttccagctggtgaaccacggcatcccgctggagcttcttgaccgcgtcaagaaggtgtgctccgagagctaccgcctccgcgaggcggcgttccggtcgtcgaagccggtgcagacgctggagaggctcgtggaggcggagcggcgcggcgaggcggtggcgccggtggacgacatggactgggaggacatcttctacctccacgacaacaaccagtggccttccgatcctccggccttcaaggagaccatgcgggagtaccgctccgagctcaagaagctcgcggagcgggtcatggaggccatggacgagaacctcgggctggacaagggacgcatgaaggcggccttcaccggcgacggcctccacgcgccattctttggcactaaggtcagccactacccgccgtgcccgcgcccggacctcatcaccgggctccgcgcccacaccgacgccggcggcgtcatcctgctgttccaggatgacaaggtcgggggccttgaggtgctcaaggatggccagtggctggacgtgcagccgctcgccgacgccatcgtggtcaacaccggcgaccaggtggaggtgctcagcaacggccgctaccgcagcgcttggcaccgcgtcctgcccatgcgcaacggcaaccgccgctccatcgcctccttctacaacccggcgttcgaggcagccatctcgccggcggtgggcgaagccggcgccgccgagtacccggactacgtgttcggggattacatggacgtgtacaacaagcagaagttcgaggccaaggagccaagattcgaggccgtcaaggcgccaaaggcagcttaagatgaatcaaggagattgaagagacgtatttatttattatctggatatatacaacccttgtacggagtatatttgatctaaatatatggaccatcccactagaaaaatttcagtgtttagtgagattgggactccgggagtacatgtgcatccattcttgggttcatcatattcatatataagtgcatttttgtgataaatagcgaaaagatttgtactactcactactttttgtgtatggtaaatgcaatcctttgtgcgtgag

SEQ ID NO: 1745 - DNA, 1238 bp, Avena sativa
cagctctgcaagcaagaaccagctcctctttcagagattcagagatcttcagagtgtatagccagtagccacccatcttcctctagaattccaccatggttgtgccggtgatcgatttctccaagctggacggcgccgagagggcggagacgatggcgcagatcgcggacgggtgcgagaactgggggttcttccagctggtgaaccacggcatcccgctggagctcctggaccgtgtcaagaaggtgtgctccgagagctaccggctccgtgaggcggcgttccgggtgtcggagccggtgcggacgctggaggcgctggtggaggcggagcggcgcggggaggcggtggcgcccgtggacgacatggactgggaggacatcttctacctccacgacgacaaccagtggccgtccgacccgccggcgttcaaggagacgatgcgggagtaccgcgcggagctgaagaagctggcggagcgggtgatggaggccatggacgagaacctggggctggacaagggccgcatgaaggcggccttcaccgccgacggccagcacgcgcccttcttcggcaccaaggtgagccactacccgccgtgcccgcgcccggacctcgtcactggcctccgcgcgcacaccgacgccggcggcgtgatcctgctgttccaggacgacaaggtgggcgggctggaagtgctcaaggatgggcagtggctcgacgtgcagccgctggcggacgccatcgtggtgaacacgggcgaccaggtggaggtgctgagcaacgggcggtaccgcagcgcgtggcaccgcgtcctgcccatgcgcaacggcaaccgccgctccatcgcgtccttctacaacccggcgttcgaggcgtccatctcccccgccgtgtccgaccagggcggcgccgcgtcggcgtacccggagttcgtgttcggggactacatggacgtgtacagcaagcacaagttcgaggccaaggagccgaggttcgaggccgtcaaggcgccaaagacagcttcagcttaaaatcaaagagatactattaaaggaacttatctactagtaataatccagtatattagcttaatctttgggcgagctttttttgtgttacaatgaagaagatatgtactgtagagtgtagtatatttctagagtttattctggagcgtagtagctatgcgatgtggggattgtatggtgtttaattaagaaagggatgttgatttt

SEQ ID NO: 1746 - DNA, 1259 bp, Avena sativa
cttgcacctagttacatcgacaagattgcatacagcgccagaatctgaaattctcgaattttcttgtgaatttcactagctcctcctcatcaccaccatggttgtgccggtgatcgacttctcgaagctcgacggcgccgagagggccgagaccatggcgcagatcgccgacgggtgcgagaactggggcttcttccagctggtgaaccacggcatcccgctggagctcctcgaccgcgtcaagaaggtgtgctccgagagctaccggctccgtgaggcggcgttccgggtctccgagccggtgcggacgctggaggcgctggtggaggcggagcggcgcggcgaggcggtggcgccggtggacgacatggactgggaggacatcttctacctccacgacgacaaccagtggccgtccgacccgccggcgttcaaggagaccatgcgggagtaccgcgcggagctcaagaagctggcggagcgggtcatggaggccatggacgagaacctcgggctggacaagggccgcatgaaggcggccttcaccgccgacggcctccacgccccgttcttcggcaccaaggtcagccactacccgccgtgcccgcgcccggacctcgtcacgggcctccgcgcgcacaccgacgccggcggcgtgatcctgctgttccaggacgacaaggtcggcgggctggaggtgctcaaggacggcgagtggctcgacgtgcagccgctggcggacgccatcgtggtgaacacgggcgaccaggtggaggtgctgagcaacgggcggtaccgcagcgcctggcaccgcgtcctgcccatgcgcaacgccaaccgccgctccatcgcgtccttctacaacccggccttcgaggcgaccatctcgccggccgtgcccgagggcggcgccgccgcgtcggcgtacccggagttcgtgttcggggactacatggacgtgtacaaccagcacaagtttgaggccaaggagcccaggttcgaggcagtcaaggcgccaaagacagctgaagcttaaacaaggagattaaaggaaaatatttatttattacttcgatatcactacccatcaagtttatacaaatatatgggccacctcataaaaaaagttccatattctgtgtgtgtgagagagagtacttgcacatttcatttcttgtgtttttgtatatatagatgcattttattatagatagtggccggaatggtttgtactaataaatgaccgaatgcaatctttt

SEQ ID NO: 1747 - DNA, 1441 bp, Avena sativa
atcagctctgcgaacaagaaccacagctcctttcagagattcagaggttttcagagcgtatagccagtagccagtcatcttcctttggaattccaccatggttgtgccggtgatcgacttctcgaagctggacggcgccgagagggcggagaccatggcgcagatcgccgacgggtgcgagaactgggggttcttccagctggtgaaccacggcatcccgctggagctcctggaccgcgtcaagaaggtgtgctccgagagctaccgtctccgggaggcggcgttccgggtgtcggagccggtgcggacgctggaggcgctggtggaggcggagcggcgcggcgaggcggtggcgcccgtggacgacatggactgggaggacatcttctacctccacgacgacaaccagtggccctccgacccgccggcgttcaaggagaccatgcgggagtaccgcgcggagctcaagaagctggcggagcgggtgatggaggccatggacgagaacctggggctcgacaagggcaggatgaaggcggccttcacctccgacggcctccacgcgcccttcttcggcaccaaagtcagccactacccgccctgcccgcgcccggacctggtgacgggcctccgcgcgcacaccgacgccggcggcgtgatcctgctcttccaggacgacaaggtgggcgggctggaggtgctcaaggacggggagtggctggacgtgcagccgctggtggacgccatcgtggtgaacacgggcgaccaggtggaggtgctgagcaacgggcggtaccgcagcgcgtggcaccgcgtcctgcccatgcgcaacggcaaccgccgctccatcgcctccttctacaacccagccttcgaggcgtccatctcgccggccgtggccgagggcgccgccgcgtcggcgtacccggagttcgtgttcggggactacatggacgtgtacagcaagcacaagttcgaggccaaggagccgaggttcgaggccgtcaaggcgccaaagacagcttcagcttaaaatcaaagagatattaaaggaactcatatctagtaataatccagtattagcttaatctttgggtgagctttttttgtgttacaatgaagaaaaatatgcactgtagactgtagtatatttttagagtttgttcaggagcgatgtggggattgtatggtgtttaattaagaaagtgatgttgatttttcattgagtacccaactccctgcttccatttaaatggagcacatgcacacggagtagctgcagctatctttgatgaatttctgaagattcattttcaatatgagccacgagagtttcagatcaggagacttggctgatgatccacctagcatgtttactttctctgctaatttcagatgtaactttgatccataatcaataaagaggtactagtaagttgtc

SEQ ID NO: 1748 - DNA, 1177 bp, Brachypodium distachyon
cagcatacagcacctgaaacaaagctcaaatttcattcatcgtctcatcgccatggtggttccggtgatcgacttctcgaagctggacggcgccgagagagccgaaaccatggcgcagatcgccgacggctgcgagaactggggcttcttccagctagtaaaccatggcatcccgacggagctcctggagcgcgtgaagaaggtatgctcggagagctaccggctccgagaagccgcgttccggtcgtcggagccggtgcggacgctggaggcgctggtggaagccgagcggcgcggcgaggcggcggcgcccgtggacgacatggactgggaggacatcttctacctccacgacgacacccagagctggccgtcctccccgccggggttcaaggagacgatgcacgagtaccgggccgagctcaagaagctggccgagagagtcatggaggccatggacgataacctgggcctcgagacgggccggatcaaggccgccttcacgggccacggccgccacgcgccgtgcttcggcaccaaggtgagccactacccgccgtgcccgcggcccgacctcgtcacgggcctcagggcccacacggacgccggcggcgtgatcctgctgttccaggacgataaggtcggcggcctcgaggtgctcaagggcggcgagtggctctccgtgcagccgctcgcggacgccatcgtcgtcaacaccggcgaccagatcgaggtgctcagcaatggccgctaccgcagcgcctggcaccgcgtcctccccatgcgcgacgccaaccgccgctccgtggcttcgttctataacccggccttcgaggcggccatctcgccggcggtggcgggcgccggcggcgagtacccggagtcgtatgtgtttggggactacatggatgtctacagcaagcacaagtttgaagccaaggagcccagattcgaggccgtcaaggcgccagcaaaggcaacagcttgaaattgagtattgatcgtggggattaaaggaaattttatattgtagtattacgttggatatatacatgctgccccttaatatttatttaaatatgggccatctcatggaaaaaaaatcaatatgtagcgagaaaagaaaatgtacatgtttacagaacaaatttgagtttgaacaaattttacatgttta

SEQ ID NO: 1749 - DNA, 1297 bp, Avena sativa
catcacttgcacttggttacatcgacaagatttgcatacaccaccagaatctgaaaatctcgaattttcttgtgaatttcactagctcctcatcatcatcaccatggttgtgccggtgatcgatttctcgaagctggacggcgccgagagggcggagaccatggcgcagatcgccgacgggtgcgagaactgggggttcttccagctggtgaaccacggcatcccgctggagctcctcgaccgcgtcaagaaggtgtgctccgagagctaccggctccgtgaggcggcgttccgggtgtcggagccggtgcggacgctggaggcgctggtggaggcggagcggcgcggcgaggcggtggcgcccgtggacgacatggactgggaggacatcttctacctccacgacgacaacaagtggccgtccgacccgccggcgttcaaggagaccatgcgggagtaccgcgcggagctcaagaagctggcggagcgggtcatggaggccatggacgagaacctcgggctggacaagggccgcatgaaggcggccttcaccgccgacggcctacacgccccgttcttcggcaccaaggtcagccactacccgccgtgcccgcgcccggacctcgtcacgggcctccgcgcgcacaccgacgccggcggcgtgatcctgctgttccaggacgacaaggtcggcgggctggaggtgctcaaggacggcgagtggctcgacgtgcagccgctggaggacgccatcgtggtgaacacgggcgaccaggtggaggtgctgagcaacgggcggtaccgcagcgcctggcaccgcgtcctgcccatgcgcaacgccaaccgccgctccatcgcgtccttctacaacccggccttcgaggcgaccatctcgccggccgtgcccgagggcggcgccgccgcgtcggcgtacccggagttcgtgttcggggactacatggacgtgtacaaccagcacaagtttgaagccaaggagcccaggttcgaggcagtcaaggcgccaaagacagctgaagcttaaacaaggagattaaaggaaaatatttatttattacttcgatatcactacacatcaagtttatacaaatatattggccacctcataaaaaaagttccatattctgtatgtgtgtgtgtgtgagagagagagagagagagagagagagagagagtacttgcacatttcatttcttgtctttttgtatatatagatgcattttgttataggtagtggccggaatggtttgtactaataaatgaccgaatgcaatctttt

SEQ ID NO: 1750 - DNA, 1285 bp, Brachypodium distachyon
agcaaagaacaccattctcttctcaattaccagagccagctgctagctagttaaggctcacaactcatcttccccaagaatagtttagccatggtggttccggtgatcgacttctcgaagctggacggcgccgagagagccgaaaccatggcgaagatcgccgacgggtgcgagaactggggcttcttccagctggtgaaccatggcatcccgacggagcttctggagcgcgtgaagaaggtttgctcggagagctaccggctccgagaagccgcgttccgggtttcggagccggtgcggacgctggaagcgctggtggaagccgagcggcgcggcgaggcggcggcgcccgtggacgacatggactgggaggacatcttctacctccacgacgacacccagagctggccgtcctccccgccggggttcaaggagacgatgcacgagtaccgggccgagctcaagaagctggccgagagagtcatggaggccatggacgataacctgggcctcgagacgggccggatcaaggccgccttcacgggccacggccgccacgcgcccttcttcggcaccaaggtgagccactacccgccgtgcccacggcccgacctcgtcaccggcctccgagcccacacggacgccggcggcgtgatcctgctgttccaggacgacaaggtcggcgggctcgaggtgctcaaggacggcgagtggctcgccgtgcagccgctcgcggacgccatcgtcgtcaacaccggcgaccagatcgaggtgctcagcaatggccgctaccgcagcgcctggcaccgcgtcctccccatgcgcgacgccaaccgccgctccgtggcttcgttctataacccggccttcgaggcggccatctcgccggcggtgggcggcgccggcggcgagtacccggagtcgtatgtgtttggggactacatggatgtctacagcaagcacaagtttgaagccaaggagcccagattcgaggccgtcaaggcgccagcaaaggcaacagcttgaaattgagtattgatcgtggggattaaagggggttgattatctgttagctgggttaattttggtgaccaggtaggttgcagtgagaatggaaagggggttgattatctgttagctggggtttattcaattactgcagttgttttatgatttatgacataggtggtgtaccaatgaaatattttgtgatcgtttcatgtttggcagttaagaaaggaatactataatattttctttattgaagatatacctgaattcctat

SEQ ID NO: 1751 - DNA, 1701 bp, Sorghum bicolor
gcaaagaacaagcatccagcggctctgccaatgcccaagaagcttcatcacaccttattagctagagctagccatggcatgcactatgcaggacagctccagtccaggtccatacatacctgcactgcaatgcttgtcttgaccgaagcttcctcctcatccatggcagtaggttgagctgcttgctcactatatatacagcaccatccatgccgagctctccatctcaattcatcagctgcaagctagctagccttcactcaagcatcacaaaaccctactactgccaccttcagcacctgcatagatacatatatacaaacacttcacaacaatctatctgctcgatcgtcttcatcaattcccaagccaataatcaacaatggtggttcccgtgatcgacttctccaagctggagctggacggcgccgagagggcggagacactggcgcagatcgccaatggctgcgaggagtggggcttcttccagctcgtgaaccacggcatcccgctggagcttctcgagcgcgtcaagaaggtgtgctccgactgctaccgcctccgtgaggccggcttcaaggcgtcggagccggtgcgcacgctggaggcgctcctcgacgcggagcggcgcggcgaggaggtggcgcccgtggacgacctggactgggaggacatcttctacatccacgacgggagccagtggccgtccgacccgccggcgttcaaggagaccatgcgcgagtaccgcgccgagctgaggaagctcgccgagcgcgtcatggaggccatggacgagaacctcggcctggaccggggcaccatcaaggccgccttctccggcgacggccggcacgagcctttcttcggcaccaaggtcagccactacccgccgtgcccgcgcccggacctcatcactggcctgcgcgcgcacaccgacgccggcggcgtcatcctgctgttccaggacgacaaggtcggcggcctcgaggtgctcaaggacggccagtggaccgacgtgcagccgctcgcgggcgccatcgtcgtcaacaccggcgaccagatcgaggtgctcagcaacggccggtaccgcagcgcctggcaccgcgtgctgcccatgcgcgacggcaaccgccgctccatcgcttccttctacaacccggccagcgaggccaccatctcgccggcggcggtggccaccagcggcggcgaggcgtaccccaagtacatgttcggcgactacatggacgtgtacgtcaagcagaagttccaggccaaggagccaaggttcgaagccgtcaaggcggcggcgccaaagtcatctccagcggcataaataaatgggggtggaaatcgaaaattttaatatattataaataattattaatttatttgttggatataacagctgaataaataataatataagtataataaatacgggttagcacttgtggtgtttcactgtgtttaactttagtggcatggcatgatatattgttgtagcaataagtttgttgagttttaatcctatagatatagaaaagaaaaaggtgtgtctagtctttggtgtatagagtttattgagcacatgcatatccaagtattgggttttttcatgtacttaatgtgatagtggttgtatgtaagagttgtaccatcatttttcgaatgcaataaagagtgtgtttggcatgactccgt

SEQ ID NO: 1752 - DNA, 1260 bp, Zea mays
ggattcatgccttctccatcctcaagtcatcagctagctagccttccctacagcaactgcatacatacaacacttccatctgcccgctcgtcttcgatcaattcccaagtcaaataataatataacagcaatggtggttcccgtgatcgacttctccaagctggacggcgctgagagggctgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggagcggcgcggtgaggtggtggcgccggtggacgacctggactgggaggacatcttctacatccacgacggatgccagtggccgtccgacccgccggcgttcaaggagaccatgcgcgagtaccgcgccgagctgaggaagctcgccgagcgagtcatggaggccatggacgagaacctcggcctcgccaggggcaccatcaaggacgccttctccggcggcggccggcacgatcccttcttcggcaccaaggtcagccactacccgccgtgcccacgcccggacctcatcacgggcctgcgcgcgcacaccgacgccggcggcgtcatcctcctgttccaggacgacaaggtcggtggcctggaggtgctcaaggacggcgagtggaccgacgtacagccgctcgagggcgccatcgtcgtcaacaccggcgaccagatcgaggtgctcagcaacgggctgtaccgcagcgcttggcaccgcgtgctgcccatgcgcgacggcaatcgccgctccatcgcatccttctacaacccagccaacgaagccaccatctcgccggcggcggtgcaggccagcggcggtgacgcgtatcccaagtacttgttcggcgattacatggacgtgtacgtcaagcagaagttccaggccaaggagcctaggttcgaagccgtcaagacgggggcgccaaagtcatctccagcggcataaataaacagggaaaacaattattgaatgcattattaaaaggtagtaataagtttgttaagtattaactagctagttgccctctttgctatatatatatatatatatatatatatatatatatatataaaataggtgagtgtccgtgcgttgcaacagaaatatataataccacgacaagttatata

SEQ ID NO: 1753 - DNA, 1226 bp, Zea mays
atcctcaagtcatcagctagctagccttccctacagcaactgcatacatacaacacttccatctgcccgctcgtcttcgatcaattcccaagtcaaataatatataacagcaatggtggttcccgtgatcgacttctccaagctggacggcgctgagagggctgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggagcggcgcggtgaggtggtggcgccggtggacgacctggactgggaggacatcttctacatccacgacggatgccagtggccgtccgacccgccggcgttcaaggagaccatgcgcgagtaccgcgccgagctgaggaagctcgccgagcgagtcatggaggccatggacgagaacctcggcctcgccaggggcaccatcaaggacgccttctccggcggcggccggcacgatcccttcttcggcaccaaggtcagccactacccgccgtgcccacgcccggacctcatcacgggcctgcgcgcgcacaccgacgccggcggcgtcatcctcctgttccaggacgacaaggtcggtggcctggaggtgctcaaggacggcgagtggaccgacgtacagccgctcgagggcgccatcgtcgtcaacaccggcgaccagatcgaggtgctcagcaacgggctgtaccgcagcgcttggcaccgcgtgctgcccatgcgcgacggcaatcgccgctccatcgcatccttctacaacccagccaacgaagccaccatctcgccggcggcggtgcaggccagcggcggtgacgcgtatcccaagtacttgttcggcgattacatggacgtgtacgtcaagcagaagttccaggccaaggagcctaggttcgaagccgtcaagacgggggcgccaaagtcatctccagcggcataaataaacagggaaaacaattattgaatgcattattaaaaggtagtaataagtttgttaagtattaactagctagttgccctctttgctatatatatatatatatatatataaaataggtgagtgtccgtgcgttgcaacagaaatatataataccacgacaagttatata

SEQ ID NO: 1754 - DNA, 1033 bp, Sorghum bicolor
atggtggttcccgtgatcgacttctccaagctggagctggacggcgccgagagggcggagacactggagcagatcgccaatggctgcgaggcgtggggcttcttccagctcgtgaaccacggcatcccgctggagctcctcgagcgcgtcaagaaagtgtgctccgactgctaccgcctccgtgaggccggcttcaaggcgtcggagccggtgcgcacgctggaggcgctcgtcgccgcagagcaacgcggcgaggaggtggcgcccgtggacgacctggactgggaggacatcttctacatccacgacggctgccagtggccgtccgacccgccggcgttcaaggagaccatgcgcgagtaccgcgccgagctgaggaagctcgccgagcgcgtcatggaggccatggacgagaacctcggcctggaccggggcaccatcaaggccgccttctccggcgacggccggcgcgagcctttcttcggcaccaaggtcagccactacccgccgtgcccgcgcccggacctcatcacgggcctgcgcgcgcacaccgacgccggcggcgtcatcctgctgttccaggacgacagggtcggcggcctcgaggtgctcaaggacggccagtggaccgacgtgcagccgctcgcgggtgccatcgtcgtcaacactggcgaccagatcgaggtgctcagcaacggccggtaccgcagcgcctggcaccgcgtgctgcccatgcgcgacggcaaccgccgctccattgcttccttctacaacccggccaacgaggccaccatttcgccggcggcggtggccaccagcggcggcgcggcgtaccccaagtacatgttcggcgactacatggacgtgtacgtcaagcagaagttccaggccaaggagccaaggttcgaagccgtcaaggcggcggcgccaaagtcatctccggcggcttaaaataacttgatagtacggagtaataccttgaagagtcaaatgattttttatttgggttgctatattttttgagttgtttcaa

SEQ ID NO: 1755 - DNA, 1698 bp, Zea mays
aaaaaaaggtccagtccaggtccgtaccagctgcgacgacgcttgtcagtaggtaggttgagctagctgcttgttgatcactgctatatatacgggtgccatggatccatgccttctccatcctcaagtcatcagctagctagccttccctacagcaactgcttacatacaacacttccatcttcccgagctcgtcttcgatcaattcccaagtcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagcttcttgagcgcgtcaagaaggtgagctccgactgctaccgcctccgggaggccgggttcaaggcgtcggagccggtgcgcacgctggaggcgctcgtcgacgcggagcggcgcggcgaggttgtggcgccggtggatgacctggactgggaggacatcttctacatccacgacggatgccagtggccgtccgagccgccggcgttcaaggagaccatgcgcgagtaccgcgccgagctgaggaagctcgccgagcgcgtcatggaggccatggacgagaacctcggcctcgccaggggcaccatcaaggacgccttctccagcggcggccggcacgagcccttcttcggcaccaaggtcagccactacccgccgtgcccgcgcccggacctcatcacgggcctgcgcgcgcacaccgacgccggcggcgtcatcctgctgttccaggacgacagggtcggcggcctggaggtgctcaaggacggccagtggaccgacgtgcagccgctcgcgggcgccatcgtcgtcaacactggcgaccagattgaggtgctcagcaacgggcgctaccgcagcgcctggcaccgcgtgctgcccatgcgcgacggcaaccgccgctccatcgcttccttctacaacccggccaacgaggccaccatctcgccggcggcggtgcaggccagcggcggcgacgcataccccaagtacgtgttcggcgactacatggacgtgtacgccaagcacaagttccaggccaaggagcccaggttcgaagccgtcaaggttgcagcgcccaagtcatctccagcggcataaataaatggaggggaccaattattaaatgcattataatttatttgttgaataaaacagccggagaaataatgataatgtaaagtatatatgataaacaccggttaggatttaaggtgtttaactttagttgcatggtataatatgatatattgttgtagcaataagtttattaagtattcataagtgttctaaatagtgggctaaggcacttatccatcgcctttctcaaacagaaaatagtgatttaattcgggctatagcgactaatagttgctatatatattaggcgtagtagcaaacaatttcaccctttggaaacagttatatctagaaataactatagccagagatttagaaccttgttaatcatgtagaaattaaaggttcgtcaagtcagagcggcaccgaacaagataaaaatgtgacctcccctatatgcaaatgtctgccaacttattacattggtgggtgccatcttactatgtacaaatatatcgcggaaaccatattatcagcgtc

SEQ ID NO: 1756 - DNA, 1581 bp, Zea mays
ccatcctcaagacatcagctagctagccttccctacagcaactgcttacatacaacacttccatcttcccgagctcgtattcgatcaattcccaattcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagcttcttgagcgcgtcaagaaggtgagctccgactgctaccgcctccgggaggccgggttcaaggcgtcggagccggtgcgcacgctggaggcgctcgtcgacgcggagcggcgcggcgaggttgtggcgccggtggatgacctggactgggaggacatcttctacatccacgacggatgccagtggccgtccgagccgccggcgttcaaggagaccatgcgcgagtaccgcgccgagctgaggaagctcgccgagcgcgtcatggaggccatggacgagaacctcggcctcgccaggggcaccatcaaggacgccttctccagcggcggccggcacgagcccttcttcggcaccaaggtcagccactacccgccgtgcccgcgcccggacctcatcacgggcctgcgcgcgcacaccgacgccggcggcgtcatcctgctgttccaggacgacagggtcggcggcctggaggtgctcaaggacggccagtggaccgacgtgcagccgctcgcgggcgccatcgtcgtcaacactggcgaccagattgaggtgctcagcaacgggcgctaccgcagcgcctggcaccgcgtgctgcccatgcgcgacggcaaccgccgctccatcgcttccttctacaacccggccaacgaggccaccatctcgccggcggcggtgcaggccagcggcggcgacgcataccccaagtacgtgttcggcgactacatggacgtgtacgccaagcacaagttccaggccaaggagcccaggttcgaagccgtcaaggttgcagcgcccaagtcatctccagcggcataaataaatggaggggaccaattattaaatgcattataatttatttgttgaataaaacagccggagaaataatgataatgtaaagtatatatgataaacaccggttaggatttaaggtgtttaactttagttgcatggtataatatgatatattgttgtagcaataagtttattaagtattcataagtgttctaaatagtgggctaaggcacttatccatcgcctttctcaaacagaaaatagtgatttaattcgggctatagcgactaatagttgctatatatattaggcgtagtagcaaacaatttcaccctttggaaacagttatatctagaaataactatagccagagatttagaaccttgttaatcatgtagaaattaaaggttcgtcaagtcagagcggcaccgaacaagataaaaatgtgacctcccctatatgcaaatgtctgccaacttattacattggtgggtgccatcttactatgtacaaatatatcgcggaaaccatattatcagcgtc

SEQ ID NO: 1757 - DNA, 1771 bp, Triticum aestivum
  misc_feature (375)..(375): n is a, c, g, or t
  misc_feature (390)..(390): n is a, c, g, or t
  misc_feature (425)..(425): n is a, c, g, or t
  misc_feature (429)..(429): n is a, c, g, or t
  misc_feature (516)..(516): n is a, c, g, or t
ccacctctgactacagtccacacccatacccaatccgccctccctccccccggaacactcgctttcctccaccagttttccacgcccgcccgcccgcccgcccgcagccaaaaccccaccaacacgcccagtccaactccaaattcgccgccggccgcccgcccgcagcgaccgcgagcctcccgccccgccggctccccctccgatctcatttctcccatcgcaggtgaaagtctagatggctcctttggtgctgggaatgtgaattgcagaaaagaacaactgtttacattttggtactgcatgatgaacggttcaacgggttccctaggggatcatgtgaacggaaagcaagtgcaaagtgttgaccctccnggtctttcaagtttnaacaatggaccaagacaccgtccgttgaatgcatngagncgctgccgtggtgtattgtgcttggtgattatgccggtgacagcatgcatgatgatggtttacctagcccctgtgacaaccttcgtngtacggttgttcagtgtgcattacagcagaaagtggacgtgctttctgtttgggatgtggttagccatgtttccctttttgtttgagaagatcaacaggacaaggtttgttttctctggtgaaaaggtgcccccaaaagagtgtgtcttgctgtttgctaaccacagaactgaggtagattggatgtacctgtgggatcttgcattgaggaaaggccgtttgcagtctatcaagtacatcctcaagaaaagtttgatgaagttgcctattttcaactgggcatttcacattattgagtttattccagtagagcggaattgggaggttgacgaaccactaatccgaagaaggctttctcaactgaagtaccccaaggatcccctttggcttgcagtttttccagaaggcactgattataccgagaagaaatgcatcaaaagtcaagagtatgcggcagagcatggtttgcctattctgaaaaatgtcctccttcccaagataaagggtttcaattgctgcctgcaagagctgaggagtaacttggatgctgtttacgacatcacgatcgcatacaagcatcggctcccgacgttcatggacaacgtgtacggcatcgacccctctgaggtccacgtccacaccaagatcatccaggtctgtgacataccaacagcagaggacgaagtatccagctggctcacggagaggttcagactgaaggacgagctcctgtctgattttttggcacaaggccacttccccaatgaaggaaccgaagaagacctgtccacgctcaagtgcgtcgcgaatttccttgcggtgatcggcatgacggccttcttcatctacctgaccctgttctcgtccgtgtggttcagggtcttcgcggcgtgcagcgcctctttcctcacgtttgccacggtgtactctatacacgcgcctcagatcgtgtgtttgccggaggccggcgcccacgccaagaaagcttgagcttggtgttgtaagctggagctggaagctgtgtatgtgtgtccgcatgcggtagaaacatgtttactgcgtatacgcagcctgtggtgtcattcttttgtatgtgtgtatggtgagtggcatctacagttgggggtagaacttctaactccactcttgactcttttttggagcaaaatacaaagactgcactaaaaaagtgggcggagccaaaattggtcgccacgtatcttcgtctatacttgaaagcagccatatctttgct

SEQ ID NO: 1758 - DNA, 3894 bp, Zea mays
ggttgcattcggaccgtccgtagcgcccagctgacctctaaacccttgtctccctcccccaagtgaatccgtgttgtacctctcgccgccgccgtaccatcgcccgaaatcctagccccattcaccgcctcgctcggaatccaagccccattcggcgccgccgcgaccgccggacaggaggtcatggacgacgtgtgcgaggggaaggacttctccttcccggagcaggaggagcgggtactcgagctgtgggcgaagctcgacgccttccacgagcagctccggcgcacggagggcggtgaggagttcgtcttctatgacggcccccccttcgccactggtctgccccactacggccacatactcgccggcaccatcaaggacgtggtcacccggcaccagtcgatgcggggccgccatgtctcgcgacggttcgggtgggactgtcacggcctccccgtcgagtttgagatcgacaagctgctcggcatcaccaaccggcagcaggtgttcgacctcggcatcggcaagtacaacgagacgtgccgcagcatcgtcaccaagtacgtctctgagtgggaggccatggtcacacgtacggggaggtggattgacttcaagaacgactacaagaccatggacctcaacttcatggagagcgtctggtgggtgtttgcgcagctctgggagaaggacctcgtctataagggcttcaaggtcatgccttacagcacaggatgcaaaactgcactgtcaaactttgaggcagcactggactataggactgttcctgacccagcggtgatggtatccttccctattgttggtgatatggacaatgcagcttttgttgcatggactacaacaccctggacacttccaagtaacctagcgctgtgtatcaatgccaatctcatgtatgcaaaggttagagacaagtcaaatggaaaagtatatgttattgcagaatctaggcttgggcagttaccagttaaggccaaagcttcaggaaagaagcaggcaccttcaaagggaagcaatgctgaagctgctcaggatggtttggataaggaatcatatgagctgctggtaaagattcctgggccatatttggttggcttaaaatatactcccctatttgattttttcattgaactacaagagactgcctttagagtgattgcggataactatgtcaccgatgatagtggaactggcgttgtccattgtgctcctgcatttggtgaagacgaccatcgtgtttgccttgctgctgggatatttgagactgctggacttgttgtcgctgttgatgatgatgggtgctttattgaaaaaatatctgattttaaagggcgatatgtcaaagaagctgacaaggatatcatcagtgctgataaaggaagacttgttagtaaagggagcattgaacactcttatccattttgttggcgatcgggtactcctcttatttatcgggctgttccaagctggtttgtcaaggttgagaagattaaagaccaattgctggaatgtaacaaggagacttactgggtgcctgactatgttaaggaaaaaagatttcacaactggcttgaaggtgcacgtgattgggccattagcagaagtagattctggggtactccacttccactgtggatgagtcaagatcgtaaagaaattgttgttatggattctatcgaaaagcttgaaaaattatctggagtcaaggtcactgatcttcaccgacactatgttgatgatattacaattccctctaagaggggacccaagtttgggacgctcaaacgtgttgatgatgtttttgactgctggtttgagagtggatcaatgccatatgcctacattcactatccatttgagaatcgagagctatttgaaaagaattttcctgggaattttgtggcagagggtttggatcaaacccgtggatggttttatactctgatggttctctcgacggcactgtttgggaagcctgcatttaagaatcttatatgcaatggccttgtcttggctgaggatggtaagaaaatgagtaagagtaaaaagaactatccttcaccaaaagatctcattgacgagtttggagcggattctctgcgtctatatttggtaaactctccagttgtacgtgcagagtctctacgattcaaacgtactggtgtctttgctgttgtgaaagatgtcttcctcccatggtataatgcgtacagattctttgtccaaaatgcaaagagactggaagtcgagggtcttgcctcattttctccgatggaacaagcggtacttctgaagtcatccaatgtgttggatcactggataaactcagcaactgaaagtctagttgtgccatatttggtaaaatacattgactatcttactaacatatatgtgcgcttgaaccgcaaacggttcaaaggacgtactggagaagaagactgcagaatttctctctcaacactctaccatgttctcgtaacaacttgcgtggtgatggctccatttacaccattctttactgaagttctttatcaaaatttgcggaaggtatcaagtaaatctgaggagagcattcacttctgcaagttcccttccacaactggtgagagagatgagcgtgttgagcaaagtgtaaataggatggtgaccatcattgatcttgcacgtaatattcgtgagcggcataacaaagctctcaaaacaccactcaaggagatggtggttgtgcatccagacaatgactttcttgaagacataactggtaaactaaaagagtatgtcatggaggaaatcaatgttaagactgtcactccatgcaatgaccccttgatgtatgcttctctgcgagctgaacctaatttcagtgtgctgggaaaaagacttggaaaggacatgggcaaagtatcaaatgtggtgaagaagatgactcaggaacagatcttagacttcgaaaaaagtggagagatttcattcttcggtcattgcttgaagctagatgatattaaggttgtccgacaattcaagcgtcctgaaaacgtgtcggagaaggagattgatgctgcaggagatggcgacgttttagtcattttagatctacgagctgaccagtcattgtttgaagctggagtggctcgagaggttgtgaacaggatccaaaaattacggaagactgctcagcttgaacctgctgatccagttgatgtgtattacgaatctgtgggcagtgacaaaaacacactggaagagattttgaagtcacaggatcagtatattagggacgcacttggttcaccaattatgccaaaagaaatggcaccaacagatgatgtaatacttggcgaggagtctcacaatgtacatgacatgtcatttgtcatatgcattgcaaggtccacccctattcttgcaccagatcttctttctcatgcctcaggcaaaagcaatcatgtggaggcgttgagagtatatcttctgtcaaggtctctttccagattgaagaaccagttccaagctggaaagggcatgattacagttgactgcatcgaaggttatccaccggtcagtttactgctaggaaagcacgttttcctaagtgcaggggatttttatctggctagtcgatcctagtttcgtttgctgcatcccaattttgagctgcttcacccattgttttgccgcaatcagcttaaaacagcttggttccatttatgcatctcaccaaagtcatgtattcagtaaaggtgaaagtctcaatgtatgctaatatgctatagcatgacatgtaagctaagattttcaaatacctggctatgggttcccataggtgatagcatgtttgtttgcaatctcttggttttcgacttttttttt

SEQ ID NO: 1759 - DNA, 3906 bp, Zea mays
atggacgacgtgtgcgaggggaaggacttctccttcccggagcaggaggagggggtgatcgagctgtgggcgaagctcgacgccttccacgagcagctccggcgcacggagggcggcgaggagttcgtattctacgacggtccccccttcgccacgggcctgccccattacggccacatactcgccggtaccatcaaggacgtggtcacccggcaccagtcgatgcgaggccgccacgtctcgcgacggttcggatgggactgtcacggactccccgtcgagttcgagatcgataaggcgctcggcatcaccaaccggcagcaggtgttcgacctcggcatcggcaagtacaacgagacgtgccgcagcatcgtcaccaagtacgtctccgagtgggaggccatggttacacgcacggggaggtggattgacttcaagaacgactacaaaaccatggacctcaacttcatggagagcgtctggtgggtgtttgcccagctatgggagaaggacctcgtctataggggtttcaaggtcgcatttctaacctccctcatagctaatttttgagtatgttggtcatgccttacagcacaggatgcaaaactgcactgtcaaactttgaggcagcactggactataggactgttcctgacccagcggtgatggtatccttccctattgttggcgatgcggacaatgcagctcttgttgcatggactacaacaccctggacacttccaagtaacctagcgctgtgtgtcaatgccaatcttacatatgcaaaggttaaagacaaatcaaatggagcagtatatgttattgcagaatccaggcttgggcagttaccagttaaggccaaagcttcaggaaagaagcaggcaccttcaaagggaagcaatattgaagctgttcaggatggtttggacaaggaatcatatgagctgttgtcaaagattcctggggtatccttggttggcttaaaatatactcctctatttgactttttcattgaacttcaagggactgcctttagagtgattgcggataactatgtcacggatgatagtggaacgggtgttgttcattgtgctcctgcttttggtgaagacgaccatcgtgtttgccttgctgctgggatatttgagactgctggacttgttgttgctgttgatgacgacggatgttttattgaaaaaatatctgattttaaagggcgatatgtcaaagaagccgacaaggatatcatcaatgctgataaaggaagactcattagtaaagggagtattgagcactcttatccattttgttggcgatcgggcactcctcttatttatcgggctgttccaagctggtttgtcaaggttgagaagattaaagaccagttgctggaatgtaacaaggagacttactgggtgcctgactatgttaaggaaaaaagatttcacaactggcttgaaggtgctcgtgattgggctgttagcagaagtagattctggggtactccacttccactgtggataagtcaagatggtgaagaaattgttgttatggattctatagagaagcttgaaaaattatctggagtcaaggtcactgatcttcaccgacactatgttgatgatattacaattccctctaagagaggacctgagtttggggtgctcaaacgtgttgatgatgttttcgactgctggttcgagagtgggtcaatgccatatgcctacattcactatccatttgagaatcgggaactatttgaaaagaactttcctggcaattttgtggcagagggtttagatcaaacccgtggatggttctatactctgatggttctctcaacagcactgtttgggaagcctgcatttaagaatcttatatgcaatgggcttgtcttggctgaggatggtaagaaaatgagcaagagtaaaaagaactatcctccacccaaggatctcattgatgagtttggagcggatgctctgcgactatatttggtaaactccccagttgtacgtgcagagtctctacgattcaaacgtactggtgtctttgctgttgtgaaagatgtcttcctcccatggtataacgcatatagattttttgtccaaaatgcaaagagactggaagttgagggtcttgcctcattttctccgatggaacaagtggtacttctgaagtcatccaatgtgttggatcactggataaactctgcaactgaaagtctagttgtgccgtatttggtaaaatacattgactatcttactaacatatatgtgcgtttgaaccgcaaacggttcaaagggcgtactggagaagaagactgcagaatttctctttcaacactctaccatgttcttgtaacaacttgcgtggtgatggctccatttacaccattctttactgaagttctttatcaaaatttgcggaaggtgtcaagtaattctgaggagagcatccacttttgcaagttcccttccacaactggcgagagagatgagcgtgttgagcaaagtgtaaagaggatggtgaccataattgatcttgcacgtaatattcgtgagcggcataacaaagctctcaaaacaccactcaaggaaatggtggttgtgcatccagacaatgacttccttgaagacatcactggcaaactaaaggagtatgtcatggaggaaatcaatgttaagaatgtcactccatgtaatgaccccttgatgtatgcttctctgcgagccgagcctaatttcagcgtgctaggaaaaagacttggaaaagacatgggaaaagtatcaaatgtggtgaagaagatgactcaggagcagatcttagcatttgaaaaaagtggagaggtttcattcttcggccattgcttgaagctagatgatatcaaggttgtccgacaattcaagcgtcctgaaaatgtgtcagagaaggagattgatgctgcaggagatggtgatgttttagtcattttggatctacgaaccgaccagtcattgtttgaagctggagtggctcgagaggttgtgaacaggatccagaaattacgaaagactgctcagcttgaacctgctgatccagttgatgtgtattacgaatctgtgggcaatgacaaaaacactctggaagagatattgaagtcacaggatcagtatattagagacgcacttggctcaccaatcgttccaaaggaaatggcaccaacagatgtcgtagtacttggcgaggaatcgcacaacgtacatgacatgtcatttgtcatatgcatcgcaaggtccaccccgattatttcaccagatcttctttctcatgcctcaggcaacagcaatcatgtcgaggcgttgagagtatatcttctgtcaaaatctctatccagattgaagaaccagttccaaagtggaaatggcgtgattacggtcgactgcatcgaaggttatccactaatcaggttacagctaggaaagcatgtttttctaagtgcaggggatttttatctggctagtcgatcctaatttttgtgtgcagcatcccaattttgactgattcacccatcattttgccgcaatcggcttaaacagcttggttccatttatgcattcagattcacttgttaaaggtgaaaaatcccaatttatgatataccatggtactctccgttctttttttatttgtcgtgttttagttcaaaaatgaactagccggtgacaaatatttttttttattttgtcgtgttttagttcaaaaataattagccggtgacaaatattcgagtaagctataggttcccatacccctagtgaattatgagtagataacatgtatgtttgtaatctcttgggtgtttggtttttgaggattgatgtggtccatcagattttgatgaatgaatgcatttcattttacaaa

SEQ ID NO: 1760 - DNA, 3642 bp, Sorghum bicolor
gctcatggacgacgtgtgcgaggggaaggacttctccttcccggagcaggaggagcgggtgctccagctgtgggcgaagctagacgccttccacgagcagctccgacgcacggagggcggtgaggagttcgtcttctacgacggacccccgttcgccacgggcctgccccactacggccacatactcgccggcaccatcaaggacgtggtcacccggcaccagtcgatgtggggccgccacgtctcgcgacggttcgggtgggactgtcacggcctccccgtcgagttcgagatcgacagttcgctcggcatcaccaaccggcagcaggtgctcgacctcggcatcggcaagtacaacgaggcctgccgcagcatcgtaacaaagtacgtctctgagtgggaagccgtcgtcacgcgctcggggaggtggattgatttcaaggacggctacaagaccatggatctcaacttcatggagagcgtctggtgggtgtttgcgcagctgtgggagaaggacctcatctataagggcttcaaggtcatgccttacagcacaggatgcaaaactgcactgtcaaactttgaggcaacaaaggaacataggactgttcatgacctggcggtgatggtatccttccctattgttggtgatgtggataattcagctcttgttgcatggactacaacaccctggacacttccgagtaacctagcgctgtgtgttaatgccaatctcacgtatgcaaaggttaaagacaagtcaaatggagcagtatatattattgcggaatctaggcttggacagttaccagttaaggccaaagcttcaggaaagaagcagacaccttcaaagggaagcaatactgaagctgttcaggatggtttggacaaggaatcatatgagctgttggcaaagattcctgggtcatccttggttggcttaaaatatactcctctatttgattttttcatcgaacttcaagagacggcttttagagtgattgcggataactatgtcatggatgatagtggaactggtgttgtccattgtgctcctgcttttggtgaagacgatcatcgtgtttgccttgcttctgggataattgagactgctggacttgttgttgctgttgatgacgatggatgctttattgaaaaaatatctgattttaaagggcgatatgtcaaggaagctgacaaggatatcatcagtgctgttaaggataaaggaagacttgttagtaaaggaagtattgagcactcttatccattttgttggcgatcgggtactcctcttatttatcgggctgttccaagctggtttgttaaggttgagaagattaaggaccagttgctggaatgtaacaaggagacctactgggtgcctgactttgttaaggaaaaaagatttcacaactggcttgaaggtgctcgtgattgggctgttagcagaactagattttggggtactccacttccactgtggatgagtcaagatggtgaagaaattgttgtgatggattctatcgagaagcttgaaaagttatctggagtcaaggtcactgatcttcaccgacactatgttgatgatattacaattccctctaatagaggacctgagtttggggtgctcaaacgtgttgatgatgttttcgactgctggtttgaaagtgggtcaatgccatatgcctacattcattatccatttgagaatcaggaactgtttgaaaagaattttcctggcaattttgtggcagagggtttggatcaaacccgtggatggttctatactctgatggttctctcaacagcactgtttgggaagcctgcatttaagaatcttatatgcaatggtcttgtcttggctgaggatggaaagaaaatgagcaagagtaaaaataactatccttcacccaaaggtctcattgacaagtatggagcggattctttgcggttatatttgataaactctccagttgtacgtgcagagtctctacgattcaaaagcagtggtgtctatgatgttgtaaaatatgtcttcctcccatggtataatgcatacagattctttgtccaaaatgcaaagagactggaattggagggtcttgcctcattttctccgatggaacaagcggttgtgccgtatttggtaaaatacattgactctcttactaacatatatgtgcgtttgaaccgcaaacggttcaaaggacgtactggagacgaagactgcagagtttctctttcaacactctaccatgttcttgtaacaacttgcgtggtgatggctccatttacaccattctttactgaagttctttatcaaaatctgcggaaggtgtcaagtaaatctgaggagagcattcacttttgcaagttcccttccacaactggcgagagagatgatcgtgttgagcaaagtgtaaataggatggtgaccatcattgatcttgcacgtaatattcgtgagcggcataacaaagctctcaaaacaccactcaaggaaatggtggttgtgcatccagacattcaattccttgaagacatcactggcaaactagaagagtatgtcatggaggaagtcaatgttaagactgtcactccatgtaatgaccccttgatgtatgcttctctgcgagccgaacccaatttcagtgcactaggaaaaaggcttggaaaagacatgggcaaagtagcaaatgtggtgaagaagatgactcaggaacagatcttagcctttgaaaaatgtggagagatttcattcttcggtcattgcttgaaggtagatgatattaaggtggtccgacagttcaagcgtcctgaaaatgtgtcagagaaggagattgacgctgcaggagatggtgatgttttagtcattttagatctacgaactgaccagtcattgtttgaagctggagtggctcgagaggttgtgaacaggatccaaaaattacggaagactgctcagctcaaacctactgatccagttgatgtgtattacgaatctgtgggcaatgacaaaaacacactggaagagattttgaagtcacaaggtcagtatgttagagacacacttggttcgccaatcattcccaaggaaatggcaccaagggatgtggtagtacttggcgaggagtcacacaatgtacatgacatgtcatttgtcatatgcattgcaaggtccacccctattctttcaccagatcttctcccaaatgcctcagcaatcatgtggaggcattgagcgtatatcttctgtcaaggtctctttccagattgaaggaccagttcgaagctagaaatggcatgattacagtcgactgcatcgaaggttatccaccaattaatttacagctaggaaagcatgtcttcctaagtgcgagggatttttatcttgctactagtctatcctagtttttgtttatggcatcccaattttcatctgccccagcttaagcagcttggttccatttaagcatgtcacctaatcatgtagtctcattcaccagctgttaaacgtgaaatctcaatgtatgctatagcatgatatgcgtctgcgcccctgggcacatgtgaactaaggttttcaaatatctggctatgtgttcccatacgcgtggtgaattatgagcaggtcatgcc

SEQ ID NO: 1761 - DNA, 1115 bp, Sorghum bicolor
cagaggagcttggatcttggaggtagcggcggcaatggagaagccccggcaggtggtgcggaagttcctggcccggccgcagcacgagggcgtcggcgccgtcgtccgccgcagcatcggcaggttcgagctgaggtacttcgatccgttccttgtcctcgacgagttctccgtttctgctccggccgggttccccgaccacccgcaccgaggcttcgagaccgtcacctacatgctcgagggcgccgtgacgcacgaggacttcgagggccaccgtggtaccatcaaggccggcgacgtgcagtggatgacggccggccgcggcatcgtgcactccgagatgcccgccggccccggcacgtccaagggcctgcagctctgggtcaacctctcctccggcaacaaaatggtggagcccgggtaccaggagatccagagcaaggacatcgcatgcacgtccgcggacggcgtcacggtgcgcgtgatcgccgggcacgccatgggcgtgcggtcgccggtgtgcacgcggacgccgaccatgtacctggacttcacggtgcggccccgcggcgtggtgcggcagcccgtgctcgcgtcgtggaacgccttcgcctacgtgctggagggcgagggcgtgttcggggccgagcggggcgcgcccgtcggcgcccaccacctgctgctgctcggccagggcgacggcgtcgaggtgtggaacaggtcggacgacaggccgctccgcttcctgctcatcgccggcgagcccatcggggagcccgtcgcgcagctgggcccgttcgtcatgaacaccgaggaggagatcgacatgaccgtcaacgacttcgagtgctacgccaatgggtttgagaaggccaggcactggaaatcgcaggcgatggtagcgcttggcgtagagtagggcgaaacacagaacacaggatgaagaaagaaaacgaatagactattttcggttcttttttttcctcacgttaattatcgttctattctagtttgttgcattcaattttaacccccaaacatgggtcgctttgtgtacatatctgcgataaattaattttatcaataaaaatgaattcgccaaatgttcaaaaaat

SEQ ID NO: 1762 - DNA, 1140 bp, Brachypodium distachyon
atcgtatatactcggagtagcacgcgtcggcagggggaagaatattttggattttggaggagacgatcgaggccaggcaatggagaagcccaggcaggtggtgaggaagttcctggcccggccgcagcacgagggcgccggcgccgtcgttcgccgcagcatcgggaggttcgagctgaggtacttcgaccctttcctggtcctggatgagttctcagtttctgctccggctgggttccccgaccatccacacagaggttttgagacggtcacgtacatgcttgagggagccgtgacgcacgaggacttcgagggccaccgcggcacgatcaaggccggcgacgtgcagtggatgacggccggccgcggcatcgtgcactccgagatgcccgccgcccccggcacctccaggggcctgcagctctgggtcaacctctcctcccaaaacaaaatgatcgagccgaggtaccaggagatgcagagcaaggacatcgcctccacgacgtcgtccgacggcgtgacggtgcgcgtggtggccgggcattccatgggcgcgcggtcgccggtgtgcacgcggacgccgaccatgtacctggacttcacggtgcgcccgcacgcggcggcgcggcagcccgtgccggcgtcgtggaacgcgttcgcgtacgtgctggagggcgagggcgtcttcgcagggggaggagccgccgaggccgccgacagcagcagcagcagcaaggcggggccgcaccacctgctgctgctggggctgcagggagacggcgtggaggtgtggaacaagtcggacaagccgctccggttcctgctcatcgccggcgagcccatcggcgagcccgtggtgcagctggggcccttcgtcatgaacaccgaggaggagatcgacgcggccgtgaatgacttcgagtactgcgtcaatgggttcgagaaggccaagcattggaagtcgcaggcgatggttgcgctcgaagtggagtagggcgaaacaatggcgcgaactacacgcacatttcttgttctttctttctttctttcttccgaacatcagtggtcgactttgtgtacatagccgccctaacggtttattaaattcaaatttttaatgaaaaagtgattttcacccaa

SEQ ID NO: 1763 - DNA, 1012 bp, Pennisetum glaucum
ctagtcctcgacgagttctccgcggcaggtggtgcgcaagttcctggcgcggccgcagcacgagggcgtcggcgccgtcgtccgccgcagcatcggcaggtttgagctgaggtacttcgatccgttcctagtcctcgacgagttctccgcttctgcaccggccgggttccccgaccacccgcacagaggattcgagaccgtcacctacatgctcgagggcgccgtgacgcacgaggacttcgagggccaccgcggcaccatcaaggccggcgacgtgcagtggatgacggccggccgcggcatcgtgcactcggagatgcccgccggccccggcacgtccaagggcctgcagctctgggtcaacctctcctccggcaacaaaatgatcgagcccgggtaccaggagatccagagcaaggacatcgcgtgcacgtccgccgacggcgtcacggtgcgcgtgatcgcgggccacgccatgggcgcgcggtcgccggtgcgcacgcggacgccgaccatgtacctcgacttcacggtgcgcccgcgcgccgccgccgtgcggcagcctgtgcccccgtcgtggaacgccttcgtgtacgtgctggagggagagggcgtgttcgggtccgagcggagcgcgcccgtcggcgcccaccacatcctcttcctcggccagggcgacggcctcgaggcgtggaacaagtcggcggacaggccgctccggttcctgctcatcgccggcgagcccatcggggagcccgtcgcgcagctggggcccttcgtcatgaacaccgaggaggagatcgacatgaccgtcgacgacttcgagcgctacgccaacgggttcgagaaggccaggcactggaaatcgcaggccatggtagcgctcggtgtagagtagggacaaatatgagcagagtacacgcacagcgtggcaaaaaaaaaatcaacagattatttttgttttttctctatcataatagtagtatgtatatgatactggttggtatcaaaa

SEQ ID NO: 1764 - DNA, 1303 bp, Zea mays
gagcagctgtcgcttttgacctatcggggggcgccgggcgggcgtaacggaaccaaggcggccaggtagctgctgtgctgctacgagtagtaagcactatatatataacgggcaacggcaaagccatcgtcgtcgtcgtggaactcgtacttgcgtgcgtgcgcacaagaacgcgggtcagagctgctggcggttggaggagcagaggagatcgctgtgcgggcggcgatggagaagccccggcaggtggcgcggaaattcctggcccggccgcagcacgagggcgccggcgccgtcgtccgccgcagcatcggcaggttcgagctgaggtacttcgacccgttccttgtcctcgacgagttcacagtttctgctccggccggcttccccgaccacccgcaccgaggcttcgagaccgtcacctacatgcttgagggcgccgtgacgcacgaggacttcgagggccaccgtggcaccatcaaggccggcgacgtgcagtggatgacggccggccgcggcatcgtgcactccgagatgcccgccggccccggcacgtccaggggcctgcagctctgggtcaacctctcctccgccaacaaaatggtcgagcccgggtaccaggagatccagagcaaggacatcgcgtgcacgtccgacggcgacggcggcgtcacggtgcgcgtgatcgccggccacgccatgggcgtgcgctcgccggtgcgcacgcgcacgccgaccatgtacctggacttcacggtgcgcccgcgcggcgcggtgcggcagcccgtgcgcgcgtcctggaacgccttcgcctacgtgctggagggcgagggcgtgttcggcgccgagcggtgcgcgcccgtcggcgcccaccacctgctgctgctcggccacggcgacggcctcgaggtctggaacaagttgcccgaccgcccgctccgcttcctgctcgtcgccggcgagcccatcggggagcccgtcgcgcagctcggccccttcgtcatgaacaccgaggaggagatcgacatgaccgtcaacgacttcgagtgctacgccaatgggttcgagaaggcccgccactggaagtcgcaggcgatgctggcgcttggcgtagagtagggcgagacatgagcacaggatcaccaaagaaaacgaatagatttttttttgcttcttttttccccattattatcgttccggtttgttgcgttcaattttaacccccaacattggatcgctttgtgtacatatctgccgtaaattatttttttatcaataacgaaattaccagctgttcataaaa

SEQ ID NO: 1765 - DNA, 1300 bp, Zea mays
gagcagctgtcgcttttgacctatcggggggcgccgggcgggcgtaacggaaccaaggcggccaggtagctgctgtgctgctacgagtagtaagcactatatatataacgggcaacggcaaagccatcgtcgtcgtcgtggaactcgtacttgcgtgcgtgcgcacaagaacgcgggtcagagctgctggcggttggaggagcagaggagatcgctgtgcgggcggcgatggagaagccccggcaggtggcgcggaaattcctggcccggccgcagcacgagggcgccggcgccgtcgtccgccgcagcatcggcaggttcgagctgaggtacttcgacccgttccttgtcctcgacgagttcacagtttctgctccggccggcttccccgaccacccgcaccgaggcttcgagaccgtcacctacatgcttgagggcgccgtgacgcacgaggacttcgagggccaccgtggcaccatcaaggccggcgacgtgcagtggatgacggccggccgcggcatcgtgcactccgagatgcccgccggccccggcacgtccaggggcctgcagctctgggtcaacctctcctccgccaacaaaatggtcgagcccgggtaccaggagatccagagcaaggacatcgcgtgcacgtccgacggcgacggcggcgtcacggtgcgcgtgatcgccggccacgccatgggcgtgcgctcgccggtgcgcacgcgcacgccgaccatgtacctggacttcacggtgcgcccgcgcggcgcggtgcggcagcccgtgcgcgcgtcctggaacgccttcgcctacgtgctggagggcgagggcgtgttcggcgccgagcggtgcgcgcccgtcggcgcccaccacctgctgctgctcggccacggcgacggcctcgaggtctggaacaagttgcccgaccgcccgctccgcttcctgctcgtcgccggcgagcccatcggggagcccgtcgcgcagctcggccccttcgtcatgaacaccgaggaggagatcgacatgaccgtcaacgacttcgagtgctacgccaatgggttcgagaaggcccgccactggaagtcgcaggcgatgctggcgcttggcgtagagtagggcgagacatgagcacaggatcaccaaagaaaacgaatagatttttttttgcttcttttttccccattattatcgttccggtttgttgcgttcaattttaacccccaacattggatcgctttgtgtacatatctgccgtaaattatttttttatcaataacgaaattaccagctgttcata

SEQ ID NO: 1766 - DNA, 1691 bp, Brachypodium distachyon
atactatctctactgctctcttccaccctctcgctcaagaacggcggccacgctcgcgtccttctccccgcgccgccaccgcccatggcgtcgctgctccgtctccaggccctctccctgacgctcaacactccccgctgccttcccttccatctccgcctcgccgcagccgcgggggcaccgctcgcacgccgcatatctgccgctgcatccaacggctcgccggagcagcgggcctcggaaacggatttggagtcagggttgtatctagtggcgacacccattgggaaccttgaagatatcaccttgagggcattgcgtgttcttaaatgtgctgatgtcatactctctgaagacacaaggcattctggaaagttgcttcaacattacaacatcaagacacctcttctcagcttccataagttcaacgagcgtgagagagagcctagtatcttaaagaggattcatgaaggggaagcagttgcggtgattagtgatgctggtactccgggcatcagtgaccctggcatggaactggccagactatgtgcaactgaaaaaattcctgttattcccattcctgggccttctgccgcaatggctgctctttctgcgtcgggtttgccaacagatgaattcacatttgtgggttttttacctaagcatggccgatcaagaaaagataggcttgagctatctgcccgtgaagctgctacacaaatattttatgtccctcctcatggaattcatcaatttcttgttgatgcggcttcgtcttttggtgattcgaggccatgtgttattgcaagggagataacaaaattacatgaagagttttggcgaggaactctaggtggagcaaatgaagcctttgcaactcgacagccaaagggggaaatcacagtactcatagaagggaactcaatttcagttgatgaaactccatccgaggatttccttgaacatgaactcaaagaattgatggcaaaagggcatgccctttcaacggcggtgaaattggtggctgatgctacgtcagcaaagaaaaaagatgtttatgcactcgcactgagggtgtttggaaaatgagtaaaatgcaaaaaatgcttgttccagtacatagactgttgggcatgtccatggtcagtaattgcatggacattggaatagcagggatatcaggtctttctgaacaaagcagctgattaacatttgaagggagtacggagaattcactgcaagattgctggaggactgcatcattcttcatcgttagtcattactgtttcgtgataagatggtttctcccaggaaagtagccatgctcagcattcaaatattttcacggcaatacatcatggccaggcggcgctgggccttcaaaatgccagatgttttgatgtaaaaccagctaaagatggatataaatttagaagtttggaacttttctttgctccattggtgaatgccacagttaggtgatggttgatccaacataacagggtcacaaatttgataaagcaaaattgcaggaccatattgaccagttggattcaaaaacaacctgatggccagaaagtgtctaaattagattgtcgtcaccactgttgatgttcggcttgttgtttacttctttatgtttcttgtgaatcacatgatatttggaaaataggtacccactttttttccct

SEQ ID NO: 1767 - DNA, 1642 bp, Panicum virgatum
  misc_feature (1043)..(1043): n is a, c, g, or t
ctgctccgcctccaggccttcgctccagccctaaacgttccccgcaaccgttgcttcctctccccgctcggcctagcctccgcggccactgctccgctggctcgccgcctctccaccgccgcctccaccagctcgccggtgccgccatcctcggaaccgaatctggagtcaggtctgtatcttgtcgcaacgccaattgggaacctggaagatatcaccttgcgggcactgcgtgtccttaaatgtgctaatgtgatattatctgaagacacaaggcattctggaaagctgctccagcactataacatcaaaacacctcttcttagcttccataagttcaatgagcgtgagagagagcccagtatcttaaggaggcttcaggaaggtgaagcagttgcattgataagtgatgccggaactccaggcattagtgaccctggcatggaattggctagactatgcgcagctgagaaaatttctgtcgttcccattcctgggccttcggctgcaattgctgctctttctgcatcgggtttgccatctaatgaattcacatttgttgggtttttaccaaagcatgctcggtcaagaagagataggcttgagatatctgcccgtgaagctgctacacaaatattctatgttcctccccatggtattcatcaatttcttgttgatgctgcttcatcttttggcgattcaaggtcatgtgttattgcaagggagataacaaaattacatgaagagttctggcgtggaactctaggtgaagcaaatgaagcctttgcaactcgacagcctaagggagaaatcacagtgctcatagaggggcagttaatttcagttgatgaaactccatcagaggatttccttgagcatgaactaagagaattgatggcaaagggacataccctttcagcggcggtgaaattggtcactgaagctacatcagcaaagaagaaagatgtttatgctcttgcattgaggttgtttggaaaatgagtaaaatgcaacttttgatcgcatctgaatgaggtggacancttccttctatcaaagccaaaggtggagcccatgtaactccatccttccagaagccatctttcatcctcaacgctgtaaaagagtgagagtgaccatgaactgtcagacaatgtgcaagtgcaaggaacgtacttagtctggcttgcatgtcatgtcttgtgcaaaccagccgcaggttcaccactgctggaacgccccaccaccactgttgtcaggcaacagaggccttgattcagttcgtcagtttcgtcagacaagtgaacaagtcgagctgcaaggtagtcggcgctattcaagacgtttcggcgacttcacccggatcgtttgatgctcatccgacggcttatgagaaggatgtaggaattagcagttcattctgtttaaactctgtttaattcagttaatctatgtttaagttaatgaccacgccacctgctatttaggctggtcgggactctgtaataagcaagcggaagtaaaccctaagatatttgataggctagcagtagctttagactagccaatctggctgttatcttgtatccagaccatatatccccatatcatgctgctgttggtcatcgggaacctctgattt

SEQ ID NO: 1768 - DNA, 1491 bp, Triticum aestivum
acaactatccccgcgtggccgccgccaatggcgtctctgctccgcctccaggccctcttctcccttacgctggccactccccgccgtctcccatcccatctccgctgtgccgcagcagttgcgtctccgctccctcgccgcctccctgctgccgcctcgaacggctcgccggagcagcgggcctcggaaacggatttggagtcggggttgtatctagtggcgacacccatagggaacctcgaggatatcaccttgagggcattgcgtgttctgaaatgtgctcatgtgatactctctgaagacacaaggcattctggaaagttacttcagcattacaacatcaaaacacctcttctcagcttccataagttcaacgaacgagagagagagcccattatcttaaagaggctccatgaaggggaagcaattgcagtgattagtgatgctggtactccaggcatcagtgaccctggcatggagctggctagactatgcgcgactgaaaaaatccctgttattcccattcctgggccttctgcagcaattgccgctctttctgcatcgggtttgccaacagaggaattcacatttgtgggtttcttaccaaagcatggtcgatcaagaaaagccaggcttgaggtatctgctcgtgaggctgtgacacaaatattctatgttcctcctcatggaattcatcagtttcttcttgatgctgcttcatcttttggcgattcaaggtcatgtgttattgcaagggagattaccaaattgcatgaagagttttggcgaggaaccctaggcgaagcaaatgaagcctttgcatctcgacagccaaagggagaaatcaccatcctcatagatgggaactcagtttcaattgatgaaacaccatctgatgattttcttgagcatgaactcagagaattgatggcaaaagggcatgctctttcaacggcggtgaaattggtggccgaagctacatcagcaaagaagaaagatgtttatgcactagcactgagggtgtttggaaaatgactaaaatgcaatccatttgctcacatctgggcatgctaacatcttcaccatggtactttctagaccatattccaattattatcattttgtttgaacatgttgggtagcatattgctcttgtgcatctacagtgcggagccatattaggaatgtccatggtcgatgtttgcttcaacatgggaatgtcagctatttcgtaagattgctggagaactatatcactttttgtcgttggttcttcccagtacggtgctcatatggaacagccatatttaccattcaaatattttctcggccatacagcatggccaagaggttgcggcccgtcaaagtagcccgtttcatcgattgagaatcagctagagatgtattggaaatttgtaatttttgaagttgtctttcctccttttctaattgctatagtttggtgtcaaagtatggttgatccgtaaataa

SEQ ID NO: 1769 - DNA, 1378 bp, Hordeum vulgare
ctcgatcagatccgatttcatttcctctttttgcaaaactatacgcttatctagacaactctcccccgtcgccaccgccaatggcgtctctgctccgcctccaggccctcttctcccttacgctggccactccccgctgtctcccatcccatctccgctgtgtcgcagcagttgcgtctccggtccctagccgccttcccgctgccgcctcgaacggctcgccggagcagcgggcctcggaaacgactttggaatcagggttgtatctagtggcgacacccattgggaacctcgaggatatcaccttgagggcattgcgtgttctgaaatgtgcttgtgtgatactctctgaagacacaaggcattctggaaagttacttcagcattacaacatcaagacacctcttctcagcttccataagttcaatgagcgcgagagagagcccattatcttaaagaggctccatgaaggggaagcaattgcagtgattagtgatgctggcactccaggcatcagtgaccctggcatggagctggctagactatgcatgactgaaaaaattcctgttattcccattcctgggccttctgccgcaattgccgctctttctgcatcgggtttgccaaccgaggaattcacatttgtgggttttttaccaaagcatggtcgatcaagaaaagctaggcttgaggtatctgctcgtgaggctgtgacacaaatattctatgttcctcctcatggaattcaacagtttcttgttgatgctgcttcgtcttttggtgattcaaggtcatgtgttattgcaagggagataaccaaattgcatgaagagttttggcgaggaactctaggagaagcaaatgaagcctttgcaactcgacagccaaagggagaaatcaccatcctcatagatgggaactcaatttcaattgttgaaaaaccatctgatgattttcttgagcatgaactcagagaattgatggcaaaagggcatgctctttcaacggcggtgaaattggtagccgaagctacatcagcaaagaagaaagatgtttatgcactagcactgagggtgtttggaaaatgagtaaaatgcaatccattcaatccaatcaaaatggcccgatacatcgatttagaatcagctagagatttattattcccctcaaaagaaatagctagagatgtattagaaatttataattttctaagttctgtttgcactttttctgattgctacagtttggtgtcaactgtatggttgatcccgcacaatgccatagatgaaattgtctcacctctatcagtagagtgcattgttgccttgctttgtgttttctgtgaatgacttgatatttggcaattagataaccaccc

SEQ ID NO: 1770 - DNA, 1379 bp, Hordeum vulgare
catttcctctttttgcaaaactatacgcttatctagacaactctcccccgtcgccaccgccaatggcgtctctgctccgcctccaggccctcttctcccttacgctggccactccccgctgtctcccatcccatctccgctgtgtcgcagcagttgcgtctccggtccctagccgccttcccgctgccgcctcgaacggctcgccggagcagcgggcctcggaaacgactttggaatcagggttgtatctagtggcgacacccattgggaacctcgaggatatcaccttgagggcattgcgtgttctgaaatgtgcttgtgtgatactctctgaagacacaaggcattctggaaagttacttcagcattacaacatcaagacacctcttctcagcttccataagttcaatgagcgcgagagagagcccattatcttaaagaggctccatgaaggggaagcaattgcagtgattagtgatgctggcactccaggcatcagtgaccctggcatggagctggctagactatgcatgactgaaaaaattcctgttattcccattcctgggccttctgccgcaattgccgctctttctgcatcgggtttgccaaccgaggaattcacatttgtgggttttttaccaaagcatggtcgatcaagaaaagctaggcttgaggtatctgctcgtgaggctgtgacacaaatattctatgttcctcctcatggaattcaacagtttcttgttgatgctgcttcgtcttttggtgattcaaggtcatgtgttattgcaagggagataaccaaattgcatgaagagttttggcgaggaactctaggagaagcaaatgaagcctttgcaactcgacagccaaagggagaaatcaccatcctcatagatgggaactcaatttcaattgttgaaaaaccatctgatgattttcttgagcatgaactcagagaattgatggcaaaagggcatgctctttcaacggcggtgaaattggtagccgaagctacatcagcaaagaagaaagatgtttatgcactagcactgagggtgtttggaaaatgagtaaaatgcaatccattcaatccaatcaaaatggcccgatacatcgatttagaatcagctagagatttattattcccctcaaaagaaatagctagagatgtattagaaatttataattttctaagttctgtttgcactttttctgattgctacagtttggtgtcaactgtatggttgatcccgcacaatgccatagatgaaattgtctcacctctatcagtagagtgcattgttgccttgctttgtgttttctgtgaatgacttgatatttggcaattagataaccacccaaatttgttgtgttctttc

SEQ ID NO: 1771 - DNA, 1924 bp, Sorghum bicolor
gggccatctcatcgaatcaacggtgcctagtgctcgtgtgccatctcttcgacttgggagtcccagcgccgccgcgccgcctcccatcccatggcgtcgctgctccgcctccaggccctcgctccagccatgacagttccccgccaccatttcctcatctcccctctccgcctcgcctctgcagccacggctccgctcgctcgacgcctctccaccgccgtctccagcaacaagccggagccacgcgtctcggaaccggatctggaatcaggtctgtatcttgtggcaacgccaattgggaaccttgaagatatcaccttaagggcactgcgtgtccttaaatgtgctaatgtgatactatctgaagacacaaggcattcaggaaagctacttcaacattacaacatcaaaacacctcttcttagcttccataagttcaacgagcgtgagagagagcccagtatcttaaggaggcttcatgaaggcgaagcagttgcactgataagtgatgctggcacgccaggtattagtgaccctggcatggaactggctagactatgtgcaactgagaaaatccctgtcattcccattcctgggccttcggctgcaattgctgctctttctgcatcgggtctgccatcaaatgaattcacatttgttgtaaggaactattggggtcagtcctgattttcaattttagttgggtttttaccaaagcatgctcggtcaagaagagataggcttgagatatctgctcatgaagctgctacacaaatattctatgttcctccccatggcattcatcagtttcttgttgatgctgcttcatcttttggtgattctaggcaatgcgttattgcaagggagataacaaaaatacatgaagagttttggcggggaactttaggtgaagcaaatgaagcctttgcaactcgacaaccaaagggagaaataacagtgctcatagaggggaagttaatttcagttgacgaatctccatcagaggatttccttgagcatgaactaagagaattgacggcaaagggttatactctttctgcggcggtgaaattggtcactgaagccacatcagcaaagaagaaagatgtttatgcactcgcattgaggttgtttggaaaataagtaaaatgcaacttttgatcacatctgaaacgaggacacgaggaatctgaagcacaactttggggaagatcacaagtaaaagctctgctggttagatagatggaggtgccaatgaactctacgcaatctggtgctcactttcctgtgcagcatcggtccttctcgttagacatcaagggaaacaaaacagatattgtcatcagtaaatatgaagatacctttctggtgattgtgacacaaatcggctgcatgggaactatactagctgccaagaaagatgaaagtgttttctcggacccaacctacaacgtttctgttctttttgggaagagagatgagccactcctagtagcttgtgcacgtcaacttattgagcacataagtggcagtggctcagcccggtcattggtgatttctctgggcctgaaagatcattctcagggaacactgaaggatatcattgtagctgtgattgagaatcgcctttggtgatgattgaatagctgagctgggcatgagattggcttattcagcccatggataaagatactgtttatcattgtgcgaggagccatggtttaccatatactgaattctggtagttttgtagttaggccttctatctgtttgaactaacaaaaggctggtttttagctgtgtcaaaatttgactgtcaactctcacgctaaacaaaagacatggaacgtcaactcaatccgagcaattggatgcttaaataatactgtaagtacccattctttttcgtagcacacggttggag

SEQ ID NO: 1772 - DNA, 2463 bp, Zea mays
ggtgcgtgcctacggcgcgtggcatcgtgtgacttgggcaactgacactcctccccgcgacgccgcgccgcctgcccggctgccatccgaatcccatgtcgtcgctgctcctcctccaggccctggctccagccatgaccgtcccccgccaccatttcctcatctcccctctccgcctcgcctctgcagccacagttccgttcgctcgacgcttctccaacgccgcttccagcaacaagccggagccactcctctcggaaccggatctggagtcaggtctgtatcttgtgtcaacgccaattgggaaccttgaagatatcaccttaagggcactgcgtgtcctaaaatgtgctaatgtgatactatctgaagacacaaggcattcaggaaagctacttcagcattacaacatcaagacacctcttcttagcttccataagttcaacgaacgggagagagagcccactatcttaaggaggcttcatgaaggtgaagcagttgcactgataagtgatgctgggacgccaggtattagtgaccctggcatggaactggctagactatgtgcaactgagaaaatccctgtcattcccattcctgggccatctgctgcaattgctgctctttctgcatcgggtttgccatcaaatgaattcacatttgttgtaaggaactattggggtcagttcatattttcaattttagttgggtttttaccaaagcatgctcggtcaagaagagataggcttgagatatctgctcgtgaagctgctacacaaatattctatgttcctccccatggcattcagcagtttcttgttgatgctgcttcatcttttggcgattccaggcattgtgtggtcgcaagggagataacaaaaatacatgaagagttttggcgtggaactttaggtgaagcaaatgaagcttttgcaactcgacaaccaaagggagaaataacagtgctcatagaggggaagttaatttcagatgacgaaattccatcagaggatttccttgagcatgaactaagagaattgacggcaaagggatatactctttctgcggcggtgaaattggtcactgaagccacatcagcaaagaagaaagatgtttatgcactcgcattgaggttgtttggaaaataagtaaaatggaatttttggtcgcatctgaaacgaggacacgaggaatctgaagcacaactttggggaagatcacaagtaaaaggacacgtggaccctgaactgtccctggaggaacctcgtgaactgcaccaccttctccgtgtccggcaggacgcgcttggctgcagggtgcgcggcgaagcgctggctccacccgtccagcagcggcgtcgcggacgcgtcgatgagtgagaggccgtggagccgttcgcaggccctgagcgccggcaggaagcatccgagggccaggtccaggaggcctggcgcggcgtcgccaccggagaagaaagccctgccgttgctgcggtccttgaacgccacctccaggaggctcagcgcggcgcgggtgtcttccacggcctgcgcgcgtgctcccggggtcggcgccagggagacggcatccagcgccggccaaaactgcagaaaggcacggcagtttgttgcacgttaccttgaagaaaagacacttgctgccgtgctctgctcggtgctcaccttgtcgtcgatgaaggcggtccagaagcggtgcatggcgcgctcgtaggggtcgtccggcagcagcaggctgctagcctcggcgccgccgcttccacgcgccacgtcctcgatgcactggatgatgactgcggactcgcatatggcgcggccgtcggggaggagcagcacggggatcttcccgtagacggggttggcagcgaggagtctgtcgcttttcttgggccccagcggctcgtcgaggagctcgtacgccacgccgcgcagatccagcgccagacgcgcccgcgccgtgaacgggctgacctccccgcctagcacacgcatggtcccggccgtcatcgacgacgacgagctgcagtccggccggctggctggtgtcgacgtgacttctgttggcatctctgcctcagccctcagcttgatgcggccggcaatttaaacgggagccggtagtggcgactggcgagtcgtgtcattgaccggtcggtgctcgtgcggcttggtgcgagctaaccggttctggtgcgtccaaaatcggctcgcgcgcggcgcgcgtgcttgtagctggaccttacacgagagcagaacagcacgtgttcgtaataacattgtttatgtacggctacgatgatgcgcccgttcttttagatactataggcattttctatcaaatcttgaaaagacattcttgggaatatctgcatcatgcagttgcacaatgtaagtgcttgcttggtgactccagcagactttgcctggccaagcataattatcacgc

SEQ ID NO: 1773 - DNA, 5049 bp, Zea mays
ggtgcgtgcctacggcgcgtggcatcgtgtgacttgggcaactgacactcctccccgcgacgccgcgccgcctgcccggctgccatccgaatcccatgtcgtcgctgctcctcctccaggccctggctccagccatgaccgtcccccgccaccatttcctcatctcccctctccgcctcgcctctgcagccacagttccgttcgctcgacgcttctccaacgccgcttccagcaacaagccggagccactcctctcggaaccggatctggagtcaggtctgtatcttgtgtcaacgccaattgggaaccttgaagatatcaccttaagggcactgcgtgtcctaaaatgtgctaatgtgatactatctgaagacacaaggcattcaggaaagctacttcagcattacaacatcaagacacctcttcttagcttccataagttcaacgaacgggagagagagcccactatcttaaggaggcttcatgaaggtgaagcagttgcactgataagtgatgctgggacgccaggtattagtgaccctggcatggaactggctagactatgtgcaactgagaaaatccctgtcattcccattcctgggccatctgctgcaattgctgctctttctgcatcgggtttgccatcaaatgaattcacatttgttgtaaggaactattggggtcagttcatattttcaattttagttgggtttttaccaaagcatgctcggtcaagaagagataggcttgagatatctgctcgtgaagctgctacacaaatattctatgttcctccccatggcattcagcagtttcttgttgatgctgcttcatcttttggcgattccaggcattgtgtggtcgcaagggagataacaaaaatacatgaagagttttggcgtggaactttaggtgaagcaaatgaagcttttgcaactcgacaaccaaagggagaaataacagtgctcatagaggggaagttaatttcagatgacgaaattccatcagaggatttccttgagcatgaactaagagaattgacggcaaagggatatactctttctgcggcggtgaaattggtcactgaagccacatcagcaaagaagaaagatgtttatgcactcgcattgaggttgtttggaaaataagtaaaatggaatttttggtcgcatctgaaacgaggacacgaggaatctgaagcacaactttggggaagatcacaagtaaaagctcttctggttagatagatggaggtgccaatgaactctacgcaatctggtcctcacttccctgtgcagcatcagtccctctcattagacatcaagggaaataaaacagatattgttatcagtaaatatgaagatacctttctgctgattgtggcacaaatcggctgcatgggaaccatactagctgccaagaaagacgaaagtgttttctcggacccaacctacaatgtgtctgttctttttgggaagagaaatgagccactcctacaagcttgcgcacgtcaacttattgagcacataagtggcagtggctcagctcggtcattggttatttctctgggtctgaaagatcattctcagtggcatctctcgtcaggcatctccaagtcaagatccaaatcccagttcatcatcccgatcccgtcgtagttatgtcggctagaatcgagggaggcaccttctcctccgactcaacgcagtctccaatctggacgtgctgccctgttactacaccaccatttattgatctatcaccaggggagacattgaagtcaggcgtggtggagaagcagatcgattccgccttgaccttggctcttgaatcccaaacccgagccctcctatcggagttggacaagaggctgcaaatcctcgacaacaaatgggaatctcgggtcagcactctggagtccaaggcgacggaggcggcgcaatccttgtccgaattctcgggcacccatcgtgctaatgtcgaggctcaccttaccgccgcggatgcatccacggacaccaaaatcgggcagatcgaggccgacctaggttaccgggtggcggcactcgaatctaccgtgggcgaagatctccactcctccatggattggcttcgatcggaagtgtcgaagatggagatccagtggtctcgtggcgcgcgcgccaacgacttccacatgtcgggcgtgctgggcgcgcatgggtcgacaccgggacgctcatcggtcgccggggatgtcgtcgacatctctcgttttgggcaccgtaatgacgcacatcaccgggatagtggaccttggcaccccaatgctgatgcccgctacccggtcacggtctgtcgaaccacaacttccatccatgtcatggcgacaattctgccagtcatgctaagtgtgctgacaattgccgccatgacatggatggaagttgtggttccgaatactgtatcttccgagtgtgctgacactatccagttacatgctgtccaagagttgtgggagatattttattcggaaccacatgaatcagagggcgagtttgaagattctgctaaaactttcatgatcctgctgtcgacagaggcaatgtctacaaagaaggctccatctcgatcctttcggcttcaaggccagcttcagggttatcaacccctagtccctgctagtacaatattagaagtgtggccggttcctgagttgcaggacacttctgcccagctgaactgtgttgaggacatgtccctacccaagcctatttcccacttgcttcatagctatgaggatctatttcagccactaactacacttccgcccagccggtcatgtgatcactctattccactcattgacggtgctcgacctgtcagtattcgaccgtatcgcttctcgccggctttgaaggatgagatcgagtctcagagggcgatgaaccataccctagctcccttattaaggaaatgtgcactagtattttttgatgacattctggtttacaacgcatcccttaatgagcacatcagtcacttggaacaggtgtttgaactgctctctgctgatgattggaaggaattgcgtagcttcttgggcctcgccgattattatcacaagtttatacgccactttggcattatctgccaacctctcactgcattgctgaagaaaggggttctgtacatttggaccagtgaccacacatgtgcatttcataccttgaagactgctcttactcaagctccagttctgtccttgctggattttgcttccccattctttatagaaaccgatgctagtgcagttggagtcagtgccgtgcttatgcagcattgtcacccccttgcctttcctagcaaggtgttgggtcccaaatctcatggcttgtcaacttatgaaaaggagtacctcactgttatcctgccagtccaacagtggcggtattaccacgagaatgcaatccgccgatccagaacgagcctttcgctgcttaggctagtgacttcagcgtgcaccttcgccatgttctggtttgctatctgcttcttccgaaggtccaccgaaggtggctcggcggcggcaaccgagtcgaagagacttctccggctcgctgggccactggtcctgagcttcatcctgcggaacgccgtccagatggtgtccgtcatgttcgtcggccacctcgggaagctccccctcgccggtgcctccctggcctcgtcgctcgccaacgtcacgggcttcagcctggtcgccggcatggccggcgccctcgacacgctgtgcgggcaggcgttcggggcgcggcggtacgcgctgctgggcgtctacaagcagcgctccatgctggtgctggcgctcgccagcctccccgtggtgctgacgtgggtgttcgtggagcagctcctcctggccatcggcgaggacccggacatcgccgcggaggccggcgcgtacgcgcggtggctgatcccgtccctcgccgcgttcgtgcccctcacctgccacatgaggttcctgcagacgcagagcgtcgtggtgcccgtcatggccagctccggcgtcacggcgctcgcccacgtcctgctgtgctacacgctggtgtacaaggtgggcatggggagcaagggcgccgcgctcggcgccgccgtctcctacagcgtcaacttggccgtgctcgctctttacgtcaggctgtccagcgcttgcaaggcaacatggacagggttctccaccgaggccttctctttctctggtctgcgggagtacgcgaagctcgccgtcccgtcggcgatgatggtttgcttggagtggtggtcgtttgagctgctcgttcttctctctgggtttttgccaaaccctaaactcgagacttccgtcctgtcaatatgcgtcaacaccgctattctgctgtacatggtaccgctgggccttggcacatctgcaaggtgttcgaccatcagggctgaacagaagattggatgtggcaaacagaagattggagcacgcgtaaacctcggcgccttttacatggttggcattccaacagggctgttgcttgcgtttgtgttcaacctaaatggaatgggtctttggcttggcattgtgtgcgggagcatcagcaaactggcgttgctcctgtggattgcactgcgcatagattgggagagcgaagctatcaaggccaaggacagggtcctccgttcgtcagggcaaacataatgatgagggtctcctacctttgtcgcataaacatatgtcatttgtcagggatatttagtggtaaggatccgtttggcattgctgaaccacccaatctcagtctcagctctacttcaaagccttcatcatgaagttagagaaggggaaaaaaggcgtgcaactttgacgttaactccagctactgccggtcctgcttttaagggcatgcgtgtatttttatactatgttccagcaagtgtgtgtattttttatataccatctaatttttattgtctcctattttacttttaaactacaacacgataaataaaaaagaattgagagagtatgtatgatct

SEQ ID NO: 1774 - DNA, 756 bp, Panicum virgatum
ccgcgtcggcggccggcgccgtcacgttcgacgcgacgaacacggcgtccagcacccccggcggccggcgcttcgaccaggccgtcggcctcggctacgccaagcgggtcctctccgacgcgtccaccttcatctggagcaccttcaaccagcgcagcgccgccgggcgcaagcccgtggacgcggtcaccctcgtcgtcgaggacatcgacggcgtcgcgttcacgagcgccaacggcatccacctcagcgcccggtacgtcggcggctactcgtccggcgacgtgcaggccgaggtgaccggcgtgctgtaccacgaggcgacgcacgtgtggcagtgggacgggcgggggagggcgaacggcggcctcatcgagggcatcgccgactacgtgcggctcaaggccgggtacgcgccggggcactgggtgaagccggggcagggcgaccggtgggaccagggctacgacgtcacggcgaggttcctggactactgcgactcgctgaagccggggttcgtggcgctgctcaacgccaagatgaaggacggctacagcgacgacttcttcgcgcagatcacggggaagagcgtgcagcagctgtggcaggactacaagaagaagtatgggggctgatgtggatagaggtggtccatggtcaacacgtacgtctagtatgacgtggcaaagttgaataaggtgtttgttgcccatctcagtgtactgttgcttactatgctgaatagtaataacgttg

SEQ ID NO: 1775 - DNA, 718 bp, Oryza sativa
tctttccttccttcctccctttcgaaacgcgcaaaaaccctctccgactctccccttctcccactcttctccggcggcggcggcggcggcggcgggagcgcatcggagatgatcatcccggtgcggtgcttcacctgcgggaaggtgattgggaacaagtgggatctgtacctggatctcctccaggctgactacacagagggggatgctctggatgcattgggtttggtccgttactgctgccggcgaatgctcatgacccatgttgacctcatcgagaagttactcaactacaacacgctggagaagaccgagacagcaggttaagttgacccagcatgctccagaactcttgttccttattgcctttgttcacgaatgttccaaggaatttgtgtgatgatccatgctgcatttcaactatgtaactgttaccgtgatgtcagacgatggaagtgatataactagtgggcagagtacctctggttgtgtgtgaacttgttttcaagacttttatatcaaggggggtatgttcctgcagtaattttcttattgtgatttgctaatttgctgtatggataatgggctgtgtttttgaaaaaaaagggtgggcttttgatttccatctgcgagtctaatcagcacaaccgctggaaaaaaacgatcaaattggcacaaactttaatgcctttaaatttgttcggcttgcttgcgtttt

SEQ ID NO: 1776 - DNA, 600 bp, Avena sativa
  misc_feature (47)..(47): n is a, c, g, or t
ttcggcacgaggaaacccttcttcccctttccttcttgtcagcggcngcgtagtcgcagcgtcgaagatgatcatccccgtgcgctgcttcacctgcggcaaggtgatcggtaacaagtgggaccactaccttgatcttctccaggccgattacacggaaggggatgctctggatgccttgggcttggttcgctactgctgccgtcgtatgctcatgacccatgttgaccttatcgagaagttgctcaactacaacacactggagaaaacggagacaacttaattgaacccatcctgctgtgaaacccttgttcatcttgtagtcatgggtggtgacttacaaggtgtgaggtcctaatgtgaagttggtccgttcctgaatgtccaaggactgttagtgtgacaatgtgtttctagtagatgtaattttcggtactattaacgaacgtatgtatgcactatccagtatgaaacttatcaagttctaagctttggaattataaatccgtgttttatatttcatcttgttggttctgggcacccatgtgcatctcattcttcaaccattatactgaatagaaatgcaatgtacttacattt

SEQ ID NO: 1777 - DNA, 615 bp, Avena sativa
gactcaccttttgccctcgcctccaaaacccttccccctttgcttcttgtccagcggcggcggcggcgcagtcgcactgtcgcagcatcgaagatgatcatccccgtgcgctgcttcacctgcggcaaggtgatcgggaacaagtgggaccactaccttgatcttctccaggccgattatacggagggggatgctctggacgccttgggcttggttcgctactgctgccggcgtatgctcatgacccatgttgacctcattgagaagttgctcaactacaacacactggagaaaacggagacaacttagttgaacccatcctgctgtgaaacccttgttcccctgtagtttttgacatgggtagtgagttatgaggtatgaggtcctgatgtgaagtttgttcggtcatgaatgtccaaggactgatagtgtgacaatgcgtttcgactatgtaatttgtggtactattaatgaacgtatgtatgcactttccagcagcaaacttattaagctctaagctttgggatcataaatctgtgttttctgtttgatcttgttggttgtgggcacccatgtgcaccttagcattcaacaattattctgaatagaaatgca

SEQ ID NO: 1778 - DNA, 571 bp, Avena sativa
ccttcttctcctttccttcttgtccagcggcggcgtagtcgcagcgtcgaagatgatcatccccgtgcgctgcttcacctgcggcaaggtgatcggtaacaagtgggaccactaccttgatcttctccaggccgattacacggaaggggatgctctggatgccttgggcttggttcgctactgctgccgtcgtatgctcatgacccatgttgaccttatcgagaagttgctcaactacaacacactggagaaaacggagacaacttaattgaacccatcctgctgtgaaacccttgttcatcttgtagtcatgggtggtgacttacaaggtgtgaggtcctaatgtgaagttggtccgttcctgaatgtccaaggactgttagtgtgacaatgtgtttctagtagatgtaattttcggtactattaacgaacgtatgtatgcactatccagtatgaaacttatcaagttctaagctttggaattataaatccgtgttttatatttcatcttgttggttctgggcacccatgtgcatctcattcttcaaccattatactgaatagaaatgca

SEQ ID NO: 1779 - DNA, 1160 bp, Gossypium hirsutum
  misc_feature (955)..(955): n is a, c, g, or t
  misc_feature (989)..(989): n is a, c, g, or t
aaagaggtaaggcaaaattcgaagtcgaggcgagaccaagaagtagcggagcaagatgataattccagttcgctgcttcacctgcggaaaggtcattggtaacaaatgggacacttatcttgatcttctccaggccgattataccgaaggagatgctcttgatgctttgggattggttcggtactgctgtaggagaatgcttatgactcatgttgacctcattgagaagcttctgaactacaacacattggagaagtcggagaccagttgagggaacatgtagaatctaagggtttgttgcagtttgtgtgagtgcctgtcaatgatggccgtgatctgaatccagaaaaagggaaggaaaggacttaaatagtactagtctagtttgttttctttagctctatgatggatccctgtatgtacgaaattagtgggatttgaaatgctgaaagtgattggaatgctttgctgtttgctgggataattgtgtgatcaaagacttaacttttgttagttgcattgctacagatgtgttagtaagtgtaggatgaaccgagcattttaaaattaataataatgacatgtccttctggtagcttacaagctaagtgagggaagtgggaatgaagcaaaacaccagctttcttatccatggcgtctacatttttggcactacccaaaaccttcacttcaaacaagcctaccttctcttctctttcaacccacaaacttcccgggactcgaagaaattcacttagaatcaatgctgtggccactaaatgggagcccaccaaggttgttcctcaagctgacagagttcttatccgtctccaagaattacccgagaaatcagctggtggagttttgttgcccaaatcagctgtcaagtttgagaggtacctcatgggggagatagtttcggtcggtgcggaagtaggaaacgtggaaactgganagaaggttcttttctcggatataatgcttatgangtggatttgggaacagatactaagcatgtgttttgtaaagagagtgacttgttagctgaagttgattgaagttttttctggtgttttgttctaagatgaggaatcaattgtattttagattttaccgggtttttatttgcaattataatggttctcccacctggctgctac

SEQ ID NO: 1780 - DNA, 529 bp, Ananas comosus
ccgaccaactcgcgaagagtgtcgattcgacattcacagcggcgctcggaggaggcgaagatgatcatccccgttcgctgcttcacctgcggaaaggtgatcggaaacaaatgggacacctaccttgatctcctccaagccgattacaccgagggggatgcccttgatgctttgggcttggtgcgctactgttgcaggcgaatgcttatgacccatgtggacctcattgagaagcttctcaactacaacactcttgagaagaccgagccaagctaacctggcaatggattgcatgaggatctttctgctagtagtctttttttcgtggaggctaggaatgctatagtggtagccaggtgcaaaactatgtttggagtcagtaacagacataacctgatgcaaggatacatttggttactgtatcgagtgtggttttgtgatgtgtcagcgcacgtgatttcagatagggctttatactgtttgttgtgatgatttacggacactaaactattaaattactgctttgctt

SEQ ID NO: 1781 - DNA, 787 bp, Triticum aestivum
acgtttcctttcgctgaccctcgccttcgcctcaaaacccttgttcccctttccttctccagcggcggcggcggcaaaggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaaacctttgttcctttgtactttccaagatgctgtttcttgcgtcagtgcttaggaggtgcaaagtgaggcactgaaatgaagttggtttgttcatgaatctccaaggactgttagtgtgaccatgcgtttctactatgtgatcttcaaggctatattaaccaacaagtctatgcattctccagtttcagacttattaagctccaagcgttgaacatgttattcctgtgctttctgttggatgttgttggttgtgggcacccatttaccattgaatcgtcactagtgatatgcattgaacttccacatgtaccttcatgcttgatatttgtttgttttctattcctctgatgatatcgatgtatctaaaatcaagatagataactattgcggttttgagcacatgcaaacaatgctcatcgatgatttgttcgtgactgctgttaaa

SEQ ID NO: 1782 - DNA, 747 bp, Triticum aestivum
  misc_feature (713)..(713): n is a, c, g, or t
ctccagcggcggcggcaaaggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaagcctttgttcctttgtacttttcaagatgcagtttcttatgtcagtgcttaggaggtgcaaaatgcgaggtcctgaaatgaagttggtttgttcatgaatctccaaggactgttagtgtgaccatgcgtttctactagtaatagagtattaaccaacaagtctatgcattctccagtttcaaacttattaagctccaagcgttgaacatgttattcctgtgctttctgttggatcttgttggttgtgggcacccatgggtatcttaacattgaatcgtcactagtgatatgcattgaacttccacatgtaccttcatgcttgatatttgtttgttttctattcctctgatgatatcgatgtatctaaaatcaagatagataactattgcggttttgagcacatgcaaacaatgctcatcgatgattgttngtgactgctgttaaattgaattatcatccattca

SEQ ID NO: 1783 - DNA, 606 bp, Triticum aestivum
ccatactttaactctcactgaccctcgccttcgccccaaaacccttgttcccctttccttctccagcggcggcggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaaacctttgttcctttgtactttccaagatgctgtttcttacgtcagtgcttaggaggtgaaaggactgttagtgtgaccatgcgtttctactatgtaatcttcagggctatattaaccaacaagtctatgcattctccagtttcaaacttattatgctccaagcgttgaacatgttattcgtgtgctttctgttggatcttgttggttgtgggcacccatgggtatcttaccattgaatcgtcactagtcatatgcattgaacttccaca

SEQ ID NO: 1784 - DNA, 584 bp, Triticum aestivum
cctcgccttcgccccaaaacccttgttcccctttccttctccagcggcggcggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaaacctttgttcctttgtactttccaagatgctgtttcttacgtcagtgcttaggaggtgaaaggactgttagtgtgaccatgcgtttctactatgtaatcttcagggctatattaaccaacaagtctatgcattctccagtttcaaacttattatgctccaagcgttgaacatgttattcgtgtgctttctgttggatcttgttggttgtgggcacccatgggtatcttaccattgaatcgtcactagtcatatgcattgaacttccaca

SEQ ID NO: 1785 - DNA, 613 bp, Leymus cinereus x Leymus triticoides
  misc_feature (8)..(8): n is a, c, g, or t
  misc_feature (509)..(509): n is a, c, g, or t
  misc_feature (582)..(582): n is a, c, g, or t
  misc_feature (584)..(584): n is a, c, g, or t
ctcatctntctcttacgtgggtggcggcggcgacgcatctagcagagaggccgacgagaggagatttgaaggccaccgcgagcacatctagcagcagaactccttcaatctgagcggcggcaaaggcggaggcggaggatcgaagatgatcatcccggttcgctgcttcacctgcggcaaggtgatcgggaacaagtgggaccactacctcgatcttctccaggccgattacaccgagggggatgctctggatgccttgggcttggttcgctactgctgccgccgtatgctcatgacccatgttgacctcatcgagaagttgctcaactacaacaccctggagaagacggagacaagttgaagttaattgaatccattctgcttcgaaaccctcgttcctttgtacttttcaagatggatggcatgctgtttcttatgtcagtgcttaggaggtgccaagtgtgaggtcctaataatgaacttggtttgttcatgaatctccaaggacngttagtgtgttagtgtgaccacgcgtttctactatgtaatcttcagggctattaaccaacaaatctatgcatntnccagtttcaaacttattaagctccaagca

SEQ ID NO: 1786 - DNA, 577 bp, Pseudoroegneria spicata
gcaagggcggaggcggaggatcgaagatgatcatcccagttcgctgcttcacctgcggcaaggtgatcgggaacaagtgggaccactacctcgatcttctccaggccgattacactgagggggatgctctggatgccttgggcttggttcgctactgctgccgccgtatgctcatgacccatgttgacctcattgagaagttgctcaactacaacaccctggagaagacggagacaagttgaaattaattgaacccattctgcctcgaaacctttgttcctttgtacttttcaagatgctgtttcttatttcagtgcttaggaggtgcaaagtgtgaggtcctgaaatgaagttggcttgttcatgaatctccaaggactgttagtgtgaccatgcgtttctactatgtaatcttcagggctattaacaacaagtctatgcactctccagtttcaaattagttatgctccaagcgttattcctgtgttttctgttggatcttgttggttgtgggcacccatgggtatcataccattgaattgttactaaagtgatatgcgttgaacttccacattca

SEQ ID NO: 1787 - DNA, 737 bp, Brachypodium distachyon
atagttatccaggggttcgtttgcaaaggaccttccccataagtgcagcctttcgtttccactctctcggtctctccctctccttcgcgtgtgcccccaaaaccctaccctccctaggccttcttctccagcggcggcggcggcggagacgcagcatcgaagatgatcatcccggttcgctgcttcacctgcggcaaggtgattggaaacaagtgggaccactacctggatcttctccaggccgattacaccgagggggatgctctggacgccctgggtttggtccgctactgctgtcggcgtatgctcatgacccatgttgacctcatcgagaagttgctcaactacaacactctggagaagactgaggcaacctagatgaacccagcatactccaaatacattgttccttggtacttttggacacttgtctcagtacttaggagtgatatgatgtgaggtcctaatgtgaggtcggtttgttcatgaatctccaaggattttcagtcgaccatgtgtttctactaagtaattctcagaactattaaccagcatatgtacgcatttcccagtttcaaactgattgagcttatcatcggtgtgtttaatgctagatttctttgattggatatctgtgtgcatctattcaactagcaggaaatagaaatgatttaaacacagacgtttactcgtgctggatgtgcatttcttctcctgtgatgatattagctttgttt

SEQ ID NO: 1788 - DNA, 560 bp, Pennisetum glaucum
gctcagctgtggccttctccacgccgaaacccaaccgaacccttctcccctcctcctccgggctccggcggcggcggcggcgctgcggcgaagatgatcatcccggtgcgctgcttcacctgcggcaaggtgattgggaacaagtgggaccaatacctggacctcctccaggccgactacacagagggggatgctttggatgctttggaattagtccgctactgctgcaggcgaatgctcatgacccatgtcgacctcattgaaaagttgctcaactacaacacattggagaagactgacacaacagccacttgaacacgccatgctccatgaacactactgtttcttggtatcttagagtgtctggtggtatgctgtttcttgtgtaccaggagcggctggttgtgacatgatgatgtgaacttggtttgctcgtgaacattcaaggacttgtcatgtgatggtgcatgttgcatgtatgctatgaacctgtgacgcagttggatattaatgtacaactgttgactaaagttacccgtatattggtgtgagttggatac

SEQ ID NO: 1789 - DNA, 1428 bp, Pennisetum glaucum
tacatatatacagtcgagcagttaattattcgattcagtccaacaacacatatacatgcacacacaaatatagtactccaactaatcgataaagcgcgatcgagctactactagggaatagctatagggatcgagatatcgatatatgatcgatgatccgcctcctttttcccctgagccggccagagaggtgatccagaggaaaaggtagtagtgtagctagggacgtagtatacgctacgcaccagctacgaacagtagtagtacgtatatagctagtagagaggacaggaggctggccggtcgtttagacagcgcacacacacgcacgcctaacacgccagtgcctcctcgacgcactccatgctagccttcacgaggcagttggtcgccaggttgaccgccacgcactcgatgtagttggtgccgaggttgaagatgccccgcttgatgccgccgccaacggcgcccaagagaagcttggccgcctccgcgccgcctcccgccaaaggcgctgcaggtccgggagccggcggtgcagccgcggcggcctgcaggctgcactccacgatggcgtcctctacgcacaccaccgtgggctgcgcaaagcacctggcaagccccatctcgagacagccgacgaagttgtcgccgaggtagccgtcggcgacgccgcgtgcccccacggtcgtcgtcccgccgtcgtcggccgcgctaaccagcagaactgcagctgcgacgagcaggaggaaaagggaaagcctgaggcgtggcgccatgggtgctaccttagctgcttctcgcgagcctgctgctcttcgcggtggctgtgctctcctctctgtctctcgatctctctctctctctgttcgctcagctgtggccttctccacgccgaaacccaaccgaacccttctcccctcctcctccgggctccggcggcggcggcggcgctgcggcgaagatgatcatcccggtgcgctgcttcacctgcggcaaggtgattgggaacaagtgggaccaatacctggacctcctccaggccgactacacagagggggatgctttggatgctttggaattagtccgctactgctgcaggcgaatgctcatgacccatgtcgacctcattgaaaagttgctcaactacaacacattggagaagactgacacaacagccacttgaacacgccatgctccatgaacactactgtttcttggtatcttagagtgtctggtggtatgctgtttcttgtgtaccaggagcggctggttgtgacatgatgatgtgaacttggtttgctcgtgaacattcaaggacttgtcatgtgatggtgcatgttgcatgtatgctatgaacctgtgacgcagttggatattaatgtacaactgttgactaaaagttacccgtatattggtgtgagttgg

SEQ ID NO: 1790 - DNA, 858 bp, Triticum aestivum
cattatcctctgtcctcggccactcgtcgctcgtcaaccctagccgccagcgacgaggccgtcccgacgccgccatctctcgtcgccggtgaacttcgtccggcgaccccctcaccaccccgactaccgtctggtcctcgagccgcccttccccgacaccgcgagtccgtccttcttcccaacctgccagcagccgacccctgccgccggcgacgctgctcttctcccccgccgtcgccacttcagaggctcaagcggcggcggcaaaggcggaggcagaggatccaagatgatcatcccggttcgctgcttcacctgcggcaaggtgatcgggaacaagtgggaccactacctcgatcttctccaggccgattacactgagggggatgctctggatgccttgggtttggtacgctactgctgccgccgtatgctcatgacccatgttgacctcatcgagaagttgctcaactacaacaccctggagaagacggagacaagttgagttaattgaacccattctgcctcgaaacccttgttcctttgtagttttcaagatggatggtatgctgtttcttatgtcagtgcttaggaggtgccaagtgtgaggtcctgaaatgaagttggtttgttcatgaatctccaaggactgttagtgtgaccatctgtttctactatctaatattcagggcttcttctcaaaaaaaaaatctaatattcagggctatattaaccaacagtctatgcattatccagtttcaaacttattaagctccaagcgttgaacatgttattcctgtgctttctgttggatcttgttggttgtgggcacccatgggtatcttaccattgaatcgt

SEQ ID NO: 1791 - DNA, 868 bp, Triticum aestivum
tcccgatccccattatcctctgtcctcggccactcgtcgctcgtcaaccctagccgccagcgacgaggccgtcccgacgccgccatctctcgtcgccggtgaacttcgtccggcgaccccctcaccaccccgactaccgtctggtcctcgagccgcccttccccgacaccgcgagtccgtccttcttcccaacctgccagcagccgacccctgccgccggcgacgctgctcttctcccccgccgtcgccacttcagaggctcaagcggcggcggcaaaggcggaggcagaggatccaagatgatcatcccggttcgctgcttcacctgcggcaaggtgatcgggaacaagtgggaccactacctcgatcttctccaggccgattacactgagggggatgctctggatgccttgggtttggtacgctactgctgccgccgtatgctcatgacccatgttgacctcatcgagaagttgctcaactacaacaccctggagaagacggagacaagttgagttaattgaacccattctgcctcgaaacccttgttcctttgtagttttcaagatggatggtatgctgtttcttatgtcagtgcttaggaggtgccaagtgtgaggtcctgaaatgaagttggtttgttcatgaatctccaaggactgttagtgtgaccatctgtttctactatctaatattcagggcttcttctcaaaaaaaaaatctaatattcagggctatattaaccaacagtctatgcattatccagtttcaaacttattaagctccaagcgttgaacatgttattcctgtgctttctgttggatcttgttggttgtgggcacccatgggtatcttaccattgaatcgt

SEQ ID NO: 1792 - DNA, 799 bp, Triticum aestivum
cattatcctctgtcctcggccactcgtcgttcgtcaaccctagccgccagcgacgaggccgtcccgacgccgccatctctcgtcgccggtgagcttcgtccggcgaccccgacaaccgtctggtcctcgagccgcccttccccggcaccgcgagtccgtccttctcccccgccgccccaacctgccagcagccgacccctgccgccggcgacgctgctattctcccccgccgtcgccactccagaaggtcaagcggcggcggcaaacgcggaggcggaggatccaagatgatcatcccggtccgctgcttcacctgcggcaaggtgatcgggaacaagtgggaccactacctcgatcttctccaggccgattacactgagggggatgctctggatgccttgggcttggttcgctactgctgccgccgtatgctcatgacccatgttgatctcatcgagaagttgctcaactacaacaccctggagaagacggagacaaattgaacccattctgcctcgaaacccttgttcctttgtcttttcaagatggatgatatgctgtttcttatgtcagtgcttaggaggtgcaaagtgtgaggtcctgaaatgaagttggtttgttcatgaatctccaaggactgttagtgtgaccatccgtttctagtatgtaatcttcagggctatattaaccaacaagtctatgcattatccagtttaaaacttattaagctccaagccttgaacatgttattcgtgtgctttctgttggatcttgttggttgcgggcacccataggtatc

SEQ ID NO: 1793 - DNA, 782 bp, Triticum aestivum
gttcgatggacaagcacgaaataatcccgatccccattatcctctgtcctcggccactcgtcgttcgtcaaccctagccgccagcgacgaggccgtcccgacgccgccatctctcgtcgccggtgagcttcgtccggcgaccccgacaaccgtctggtcctcgagccgcccttccccggcaccgcgagtccgtccttctcccccgccgccccaacctgccagcagccgacccctgccgccggcgacgctgctattctcccccgccgtcgccactccagaaggtcaagcggcggcggcaaacgcggaggcggaggatccaagatgatcatcccggtccgctgcttcacctgcggcaaggtgatcgggaacaagtgggaccactacctcgatcttctccaggccgattacactgagggggatgctctggatgccttgggcttggttcgctactgctgccgccgtatgctcatgacccatgttgatctcatcgagaagttgctcaactacaacaccctggagaagacggagacaaattgaacccattctgcctcgaaacccttgttcctttgtcttttcaagatggatgatatgctgtttcttatgtcagtgcttaggaggtgcaaagtgtgaggtcctgaaatgaagttggtttgttcatgaatctccaaggactgttagtgtgaccatccgtttctagtatgtaatcttcagggctatattaaccaacaagtctatgcattatccagtttaaaacttattaagctccaagccttgaacatgtt

SEQ ID NO: 1794 - DNA, 500 bp, Lolium multiflorum
aaaacccttcccctttcctcccttgtccagcggcggcggcggcggcggcgaactcgcagcatcgaagatgatcatccccgtgcgctgcttcacctgcggcaaggtgatcgggaacaagtgggaccactacctggatctcctccaggccgattacacggagggggatgctctggacgcattgggcttggttcgctactgctgtcggcgtatgctcatgacccatgttgaccttatcgagaagttgctcaactacaacacactggagaaaacggagacagcttagttgaacccatcctgctgtgaaacccttgttcctcgtctggacatgggtggttacaaggtgtgagcaggggcgtaatgtgaagctggttcgttcatgaatgtgcaagaactgttagtgtgacaatccgtttgtactatgtaatttgtggtactattaacaaacatatgtatgcactttccattatcaaacttatttagttctaagcttaaaaaaaaaa

SEQ ID NO: 1795 - DNA, 655 bp, Lolium multiflorum
gtccagcggcggcggcggcggcggcgaactcgcagcatcgaagatgatcatccccgtgcgctgcttcacctgcggcaaggtgatcgggaacaagtgggaccactacctcgatcttctccaggccgattacacggagggggatgctctggacgcattgggcttggttcgctactgctgtcggcgtatgctcatgacccatgttgaccttatcgagaagttgctcaactacaacacactggagaaaacggagacagcttagttgaacccatcctgctgtgaaacccttgttcctcgtctggacatgggtggctacaaggtgtgagcaggggcctaatgtgaagctggttcgttcatgaatgtgcaagaactgttattgtgacaatccgtttgtactatgtaatttgtggtactattaacaaacatatgtatgcactttccattatcaaacttatttagttctaaacattggattataaatccgtgttttctgcttgatcttattggctgtgggcacccgtgttcatcttagtgtcaaccattatgacattattattatactaaataggaatgcactgacattccacatttacctacgacccagatgtttgtgctctattccctacatgatatcgatgtatctaaaattagattaaat

SEQ ID NO: 1796 - DNA, 595 bp, Hordeum vulgare
gacccttcttcttccccagcggcggcggcggcggatcgaagatgatcatcccggttcgctgcttcacctgcggcaaggtgatcgggaacaagtgggaccactacctcgatcttctccaggctgattacaccgagggggatgctctggatgccttgggcttggttcgctactgctgccgccgtatgctcatgacccatgttgaccttatcgagaagttgctcaactacaacacgctggagaagacggagacaagttgaagttaattgaacccatgctgcctggaaacccttgttcctttgtactacttttcaagatggatggtatgctgtttcttatgtcagtgcttaggaggtgcaaagtgtcaggtagtcctgatatgatatgaagttggtttgtccatgaatctccaaggactattagtgtgaccatgcatttctactatgtaatcttcagggctattagttaaccaacaaatctaatgcattgtccagtttcaaacttattatgctccaagtgttgaacatgttatccctgtgttttctgttggatcttgttggttgtgggcacccatgggtatcttaccattgaatcgtta

SEQ ID NO: 1797 - DNA, 618 bp, Hordeum vulgare
cggcacgaggcaccatcgacccttcttcttccccagcggcggcggcggcggatcgaagatgatcatcccggttcgctgcttcacctgcggcaaggtgatcgggaacaagtgggaccactacctcgatcttctccaggctgattacaccgagggggatgctctggatgccttgggcttggttcgctactgctgccgccgtatgctcatgacccatgttgaccttatcgagaagttgctcaactacaacacgctggagaagacggagacaagttgaagttaattgaacccatgctgcctggaaacccttgttcctttgtactacttttcaagatggatggtatgctgtttcttatgtcagtgcttaggaggtgcaaagtgtcaggtagtcctgatatgatatgaagttggtttgtccatgaatctccaaggactattagtgtgaccatgcatttctactatgtaatcttcagggctattagttaaccaacaaatctaatgcattgtccagtttcaaacttattatgctccaagtgttgaacatgttatccctgtgttttctgttggatcttgttggttgtgggcacccatgggtatcttaccattgaatcgttacagtga

SEQ ID NO: 1798 - DNA, 532 bp, Festuca arundinacea
ggcacgaggcgtccccggctgacctcctccccagccgacctcgtcctcaggcagagcggcgtagtcgcagcgtagaagatgatcatccccgtgcgctgcttcacctgcggcaaggtgatcggtaacaagtgggaccactatctcgatcttctccaggccgattacacggaaggggatgctctggatgccttgggcttggttcgctactgctgccgacgtatgctcatgacccatgttgaccttatcgagaagttgctcaactacaacacactggagaaaacagagacaagttaatttgaacccatcctgctgcgaaacctttgttcctcttctcgacatgggtggtggcttacaaggtgtgaggtcctaatgtgaagtttgttcgttactgaatgtccaaggactgttagtgtgacaatgcgtttctgctatatgtaattttcggtcctattaacgaacgtatgtatgcactatccagtatgaaacttcttaagttgtaagctttggaattataaatccgtgttttatcttt

SEQ ID NO: 1799 - DNA, 769 bp, Triticum aestivum
cattatcctctgtcctcggccactcgtcgctcgtcaaccctagccgccagcgacgaggccgtcccgacgccgccatctctcgtcgctggtgaacttcgtccggcgatcccgtcaccaccccgactaccgtctggtcatcgagccgcccttccccgacactgcgagtccgtccttctccctcgccgccccaacctgcccctgccgccggcgacgctgctcttctcccccgccgtcgccacttcagaagctcaagcggcagcggcaaaggcggaggcggaggatagaagatgatcatcccggttcggtgcttcacctgcggcaaggtgatcgggaacaagtgggaccactacctcgatcttctccaggctgattacactgagggggatgctctggatgccttgggcttggttcgctactgctgccgccgtatgctcatgacccatgttgacctcatcgagaagttgctcaactacaacaccctggagaagacggagacaagttgagttaattgaacccactctgcctcgaaacccttgttcctttgtacttttcaagatggtggtatgctgtttcttatgtcagtgcttaggaggtgcaaagtgtgaggtcctgaaatgaagttggtttgttcatgaatctccaaggactgttagtgtgaccatccgtttctaccatgtaatcatcagggctatattaagcaacaagtctatgcattatccagtttcaaacttattaagctccaagcgttgaacatgttattcctgtgctt

SEQ ID NO: 1800 - DNA, 752 bp, Triticum aestivum
ctgtcctcggccactcgtcgctcgtcaaccctagccgccagcgacgaggccgtcccgacgccgccatctctcgtcgctggtgaacttcgtccggcgatcccgtcaccaccccgactaccgtctggtcatcgagccgcccttccccgacactgcgagtccgtccttctccctcgccgccccaacctgcccctgccgccggcgacgctgctcttctcccccgccgtcgccacttcagaagctcaagcggcagcggcaaaggcggaggcggaggatagaagatgatcatcccggttcggtgcttcacctgcggcaaggtgatcgggaacaagtgggaccactacctcgatcttctccaggctgattacactgagggggatgctctggatgccttgggcttggttcgctactgctgccgccgtatgctcatgacccatgttgacctcatcgagaagttgctcaactacaacaccctggagaagacggagacaagttgagttaattgaacccactctgcctcgaaacccttgttcctttgtacttttcaagatggtggtatgctgtttcttatgtcagtgcttaggaggtgcaaagtgtgaggtcctgaaatgaagttggtttgttcatgaatctccaaggactgttagtgtgaccatccgtttctaccatgtaatcatcagggctatattaagcaacaagtctatgcattatccagtttcaaacttattaagctccaagcgttgaacatgttattc

SEQ ID NO: 1801 - DNA, 697 bp, Hordeum vulgare
cggcacgaggcaaaacctcgttcctgggaagcctttcttttactctcactcaccctcgccttcgcccccaaaacccttgttcccctccccttcttctccagcggcggcggcggcaaaggcagaggcggaggatcgaagatgatcatcccggttcgctgcttcacctgcggcaaggtgatcgggaacaagtgggaccactacctcgatcttctccaggctgattacaccgagggggatgctcttgatgccttgggcttggttcggtactgctgccgccgtatgctcatgacccatgttgacctcatcgagaagttgctcaactacaacaccctggagaagacagagacaagttgaagttaattgagcccattctgcttcgaaacccttgttcctttgtacttttcaagatggatggtatgctgtttcttatgtcagtgttaggaggtgcaaagtgtgaggtcctgatatgaagttggtttgttcatgcatctccaaggactgttagtatgaccatgcgtttctactatgtaatcttcagggctattgaccaacaaatctatgcattttccagtttcaaacttgttaagctccaagcgttgaacatgttattcctgtgttttctgctggatcttgttagttgtgggcacccacgggtatcttatcattgaattgtcactaaactgatatgcattgaact

SEQ ID NO: 1802 - DNA, 706 bp, Hordeum vulgare
cggcacgaggcaaaacctcgttcctgggaagcctttcttttactctcactcaccctcgccttcgcccccaaaacccttgttcccctccccttcttctccagcggcggcggcggcaaaggcagaggcggaggatcgaagatgatcatcccggttcgctgcttcacctgcggcaaggtgatcgggaacaagtgggaccactacctcgatcttctccaggctgattacaccgagggggatgctcttgatgccttgggcttggttcggtactgctgccgccgtatgctcatgacccatgttgacctcatcgagaagttgctcaactacaacaccctggagaagacagagacaagttgaagttaattgagcccattctgcttcgaaacccttgttcctttgtacttttcaagatggatggtatgctgtttcttatgtcagtgttaggaggtgcaaagtgtgaggtcctgatatgaagttggtttgttcatgcatctccaaggactgttagtatgaccatgcgtttctactatgtaatcttcagggctattgaccaacaaatctatgcattttccagtttcaaacttgttaagctccaagcgttgaacatgttattcctgtgttttctgctggatcttgttagttgtgggcacccacgggtatcttatcattgaattgtcactaaactgatatgcattgaacttccacattt

SEQ ID NO: 1803 - DNA, 749 bp, Triticum aestivum
cctcgccttcgcctcaaaacccttgttcccctttccttctccagcggcggcggcggcaaaggcggaggcggaggatcgaagatgatcatcccggttcgctgcttcacctgcggcaaggtgatcgggaacaagtgggaccactacctcgatcttctccaggccgactacactgagggggatgctctggatgccttgggcttggttcgctactgctgccgccgtatgctcatgacccatgttgacctcattgagaagttgctcaactacaacaccctggagaagacggagacaagttgaagttaattgaacccattctgcctcgaaacctttgttcctttgtactttccaagatgctgtttcttgcgtcagtgcttaggaggtgcaaagtgaggcactgaaatgaagttggtttgttcatgaatctccaaggactgttagtgtgaccatgcgtttctactatgtgatcttcaaggctatattaaccaacaagtctatgcattctccagtttcagacttattaagctccaagcgttgaacatgttattcctgtgctttctgttggatgttgttggttgtgggcacccatttaccattgaatcgtcactagtgatatgcattgaacttccacatgtaccttcatgcttgatatttgtttgttttctattcctctgatgatatcgatgtatctaaaatcaagatagataactattgcggttttgagcacatgcaaacaatgctcatcgatgatt

SEQ ID NO: 1804 - DNA, 733 bp, Aristolochia fimbriata
gttggaggctgcgaggggtcggaactcggacgttcagtcggagaagaaagagacgcgattagggttgagaaagaggggtcggaggagcaattagggttgtcgagggaagatgatcattccagtgcgctgtttcacctgtgggaaggtaatcggtaacaaatgggatacgtatttggatcttctccaggctgactacactgaaggggatgctctggatgccctaggattggtgagatactgctgcaggcgtatgcttatgacccatgttgacctcatcgagaaactccttaactacaacactcttgagaaaaacgagaccagttaagatgctgtaacctctcattttgtcgtccagtcatatagacacatgtaggtggataatgatgaacaggggagaactgctgtcgagtgtgttaggagtctcaagtatgatagactatttggagtgtaatgtgaggcttatgcctttgttttgaatccatttatatgatcgaattggttgtcccttaacagtagacccattttgtgattgaactcaacgagttctgaaactgtaatttaaacgcgaggaacctggaaaatagctatggaactcgccgagtatatctaattaaagtgtaagttggaacttggaaggtagatatgatatgagtgtcgaaggacaacttatgctttacaacaacccaaaatcgggatccaaggattagttaaaataaaggttggaagcagataa

SEQ ID NO: 1805 - DNA, 685 bp, Theobroma cacao
ttagccaagtttgggagtttaggaaaaggtttcagcaggtctgttatttctattaaaaaaaaagaaaagaaaaaagaaaggtgtcagcgggttaaaacgacgtcgtttataagacaaagttaatggctgaaacgactccgccttcaaacaacctaaaatcccggtcagaacattctagggcagtagaaaaagctaggagagtgaagaggcgggaactagggaaaagccaagaacaagaactaaagaggatgattattccagttcgctgcttcacatgtgggaaggttattggtaataaatgggacacttaccttgatcttctccaggccgactacacagaaggagatgctcttgatgctttgggcttggttcgttattgttgtaggcgaatgcttatgactcatgttgaccttattgagaagcttctgaattacaatactttggagaagtcagagaccagttgaggaaacatgtagaagttagtcctgcatggtctgttgcagttgtgagtgcctctgctattctcagttttgtgtaatgtggaccatggtcagaagccaaagaatgaaagacttcaatggtagtctacttttatcttttatttctataacggatcatttttatatttgaacctacctggtaattttaaatattaaatgattggaacattgtggctgttgttcag

SEQ ID NO: 1806 - DNA, 583 bp, Curcuma longa
ttgccgtttccttgcctatccccgtcccacgcgacgaactccgtcgatctctcgccgcctcttttccggctcttctcctcactgcgccggcttcctttctccggttctccctccttttctcttttccaaactctccgctgttgttgagaagatgatcatcccggtgcgctgcttcacttgcggcaaggtgattgggaacaaatgggatacgtatctagatcttctgcaggcggattacactgaaggagatgctctggatgctgtgggcttggttcgctactgctgtaggagaatgctcatgacccatgttgatctcatcgaaaagctactcaactacaacactctcgagaagacggagacaagctaatgagatggcaaatggaatcagttccaccatagtattagcatgaatcatggaatcatactttaatttgcataatgtcatggaatctgtatcagtactgtgttggatcagtatgaattgtgtgaattcccaaactactagttgatgacttgatctgattaatgtatgtttatatgctttgttgcgtgtttttaattggcatatggactcaactttttt

SEQ ID NO: 1807 - DNA, 473 bp, Cynodon dactylon
  misc_feature (35)..(35): n is a, c, g, or t
gactcccgagtttccctcgccctccccacccgcanacccttccccttcttctccaggctccggcggcggcggcggcgaagatgatcatcccggtgcggtgcttcacctgcggcaaggtgattggaaacaagtgggacatgtacctggaccttctccaggccgactacaccgaaggggatgctctggatgccttgaatttggttcgctactgctgcaggcggatgctcatgacccatgttgacctcatcgagaagttgcttaactacaacacgttggagaagaccgagacaagctaagtgacactgctccagaactctgtcgtttgtcagtgtcgtccagtgtggataggtagagtatcatgagtcgtgtgatgaggtgagactattgtttctcactgtcggtggtatgtgctgatgctactgaatcaggaaactggttgtgagatgattatgtgaactggttgttcttgaatt

SEQ ID NO: 1808 - DNA, 567 bp, Setaria italica
tgttcgttcagccggccttctccacgccgaaacccaaccaaacccttcccctcctccggctccggcggcggcggcggcggcgaagatgatcatcccggttcgctgcttcacctgcggcaaggtgatcgggaacaagtgggaccactacctcgacctcctccaggccgactacacggagggggatgctctggatgctttggacttggtccgctactgctgcaggcgaatgctcatgacccatgttgacctcattgaaaagttgctcaactacaacacattggagaagactgacacaaccacttgaacacgccatgctccataaacactaccgtttcttagtaacttaagagtgtcggtggtatgttgtttcttctataccaggagaggcaggttgtgacatgatgatgtgaatttggtttgctcatgaacattcaaggatttctcatgtgatggtgcatgttgcgtctacactatgaacttgtacgcagttggatatttgaagcaatataactgttgactaaaaattactcgtatatcaatgtgtagacgcaacatgcaccatcacat

SEQ ID NO: 1809 - DNA, 516 bp, Heritiera littoralis
gaattcgaacttgtttaagtataaactagggaaaagccgatatcaagaacaagcagaacaggatgataatcccagttcgttgtttcacatgcggaaaggttattggcaacaaatgggacacgtaccttgatcttctacaggctgactacactgaaggagatgctcttgatgctttgggcttggttcgttattgctgtcggagaatgcttatgactcatgttgacctgattgagaagcttctgaactacaacacattggagaagtcagagaccaattgaggaccagttgaggaaacatgtagaacttacccttgcgtgatctgttgcagttgtgtgagtgcgtgtctgggattctcagttctgtgtaatgtggaccatggtctgaaaccagacaaatgaatggacttaaatagtactagtctacttgttttgtttagctttatgatggatctctgtatgtatgaacctacctggtgtttgaaatacttaaagtgatgggatcacttcgatgtttcct

SEQ ID NO: 1810 - DNA, 716 bp, Gossypium hirsutum
agaacaagggtattttcgtgaaaactgcaaacccccgtacttaaagccatgtagggctgaagacgagagcgcgcaaagcgaaaaagggagcagtgggtggaactagctagggcaaatctttaaaccaagaagaagaagaaaaagacgtattagccgagcaggatgataatcccagtccgttgcttcacatgcgggaaggttattggtaacaaatgggacacctaccttgatcttctccaggccgactatactgaaggtgatgctcttgatgcattgggcttggttcgatattgctgtaggagaatgcttatgactcatgtcgatctcatcgagaagcttctgaactacaacacattggagaaatcagagaccagttgaggaaacaagtagggcttacctgcaatgttccgtttcagttatgcgagtgcctgtttatgattctcagttttttgtgtaacgaggaccatggttttaactttgaactttggaggcggacaagttaaagggtttaagtagaactagttctgcatgttttcttattgcaatacaacataaacaccatgacagtgcatcggagaaaaaaaacgagaaacattataatattatatacatacactgatttatgaagtcattttcattaaaatcagagttctatataaaaactacccctgtacgagccaaaaatttccaatcattggagtaaaacattttcacta

SEQ ID NO: 1811 - DNA, 659 bp, Gossypium hirsutum
  misc_feature (40)..(40): n is a, c, g, or t
  misc_feature (65)..(65): n is a, c, g, or t
  misc_feature (71)..(71): n is a, c, g, or t
tggccggggggcgcaaagcgaaaaagggagcagtgggtgnaactagctagggcaaatctttaaancaagangaagaagaaaaagacgtattagccgagcaggatgataatcccagtccgttgcttcacatgcgggaaggttattggtaacaaatgggacacctaccttgatcttctccaggccgactatactgaaggtgatgctcttgatgcattgggcttggttcgatattgctgtaggagaatgcttatgactcatgtcgatctcatcgagaagcttctgaactacaacacattggagaaatcagagaccagttgaggaaacaagtagggcttacctgcaatgttccgtttcagttatgcgagtgcctgtttatgattctcagttttttgtgtaacgaggaccatggttttaactttgaactttggaggcggacaagttaaagggtttaagtagaactagttctgcatgttttcttattgcaatacaacataaacaccatgacagtacatcggagaaaaaaaacgagaaacattataatattatatacatacactgatttatgaagtcattttcattaaaatcagagttctatataaaaactacccctgtacgagccaaaaatttccaatcattggagtaaacattttcactaaaga

SEQ ID NO: 1812 - DNA, 1545 bp, Theobroma cacao
tgcccgttttctctaaaccctccctcccttattcggtcctgtcgtcggcctaacctttctagcaacggctccctctttctttctctttccttttttttttcttctcttccccttccttctgcccccagtttcatctctttctaaaaaaggctagctaccgatcttctcggagtgcaaggtctccttcactctaaaaactgtataataccttgaaatttatcctatccgtatcacctttctctccaaaaaaacatatttttctttctctctgtctaataatccattcaatcagggttagaaaaacccggagatcttattttggtttaattgttatcttattcttgggcatccttcttctttataaatctagagagggaactagggcaaagccaagaacaagatgattattccagttcgctgcttcacatgtgggaaggttattggtaacaaatgggatacttaccttgatcttctccaggccgactacactgaaggagatgctcttgatgctttgggcttggttcgatattgctgtaggcgaatgcttatgactcatgttgacctcattgagaagcttctgaactataacactttggagaagtccgagaccagttgaggaaacatctagaagttagtcctgcatgctctattgcagttctgactgcctatgtgattctaagatttgtgtaatgtggaacgtagtcagaatccaaacaatgaaagacttcaatagtagtcaacttgtactttggttctataatggatcatttatacgtttgaacctacctggtaattttaaaatattaaattattggaacattgtgcctgttgttcagaactttgctatttccttggataaatatttagtcaaaggatatggttgagggatgtgatatgttcaatagtggtcaatatgtttgtatttattcctcttcatttggagtcctttgtcaagcagatttcttttcgaaacaaatccaaatagtctatctgaagtggcattcctatgcatgcggattactctaaacaggaattcctttttgcttttatttgagtaaatttttaaatttacttctattatttatggctgactgtttagatgcgtctttacaccactgtttgtgttgggaatactaagattccattatatggtggttgtagaaccagctcattatggtcacacctgaggccaaaattctgcgagcaatgcaattgatgacaggtacagtatgctgcttctaggacatatactgtcttttcattaggctcttccttggcaagctagttgtaacctgaagtattttggcagataaccgaatcagacacattccagtgattgttgagaagggaatggtcggcatgggcaggttcctagaggatgatgaaatcttgtgtgtttcacctgttatgccgcatacttgtcggacataagtaagcagagagcaagtaaatactgtgttttgtgcatctttcgtcgcgtggctttggctttatctttcccatgtgttaatatgcaacgatgtgaaataaaatcatgtggactaa

SEQ ID NO: 1813 - DNA, 597 bp, Theobroma cacao
  misc_feature (551)..(551): n is a, c, g, or t
  misc_feature (591)..(591): n is a, c, g, or t
cgggggatcttattttggtttaattgttatcttattcttgggcatccttcttctttataaatctagagagggaactagggcaaagccaagaacaagaacagaacaagatgattattccagttcgctgcttcacatgtgggaaggttattggtaacaaatgggatacttaccttgatcttctccaggccgactacactgaaggagatgctcttgatgctttgggcttggttcgatattgctgtaggcgaatgcttatgactcatgttgacctcattgagaagcttctgaactataacactttggagaagtccgagaccagttgaggaaacatctagaagttagtcctgcatgctctattgcagttctgactgcctatgtgattttaagatttgtgtaatgtggaacgtagtcagaatccaaacaatgaaagacttcaatagtagtcaacttgtactttggttctataatggatcatttatacgtttgaacctacctggtaattttaaaatattaaattattggaacattgtgcctgttgttcagaactttgntatttccttggataaatatttagtcaaaggatatggttgngggata

SEQ ID NO: 1814 - DNA, 520 bp, Vitis vinifera
taagggcaccgtcaaagccagggggaacataagcacaacggaggagtagagagtctagagacgcccaaagttagggctaccagtagcgaaggatgatcattccagttcgttgttttacctgcgggaaggtgattgggaataaatgggatacctatctggatcttcttcaggccgactacaccgagggagatgctcttgatgcactggggttggttcgatattgctgtagacgaatgctcatgactcatgttgatctcattgagaagcttctgaactacaatacactggagaaatcagagaccagttgaaggtgcttatggagttaaaagggaggtggaattgcttatggcataattccgttgcatatggactggaaaatttgtctctgtgtggccctgtttttttagtattatgtaatagagttcatggtatttggtttagaaatatgatgaagccagactgcagatacatttaaggttgtgcatgtaaggtaaatataacatcattttagtttgtgtga

SEQ ID NO: 1815 - DNA, 745 bp, Gossypium hirsutum
tggtctagtttcaggacaaaacgacggcggctcgaggcagggatatttggtgaaacggcaccaccttaaaggcaaagttaaaatccccgttagaagttctagggcgcgagaataagaaggaaggttggtgagagagaaaaagaggtaaggcaaaattcgaagtcgaggcgagaccaagaagtagcatgataatcccagttcgctgcttcacctgcggaaaggtcattggtaacaaatgggacacttatcttgatcttctccaggccgattataccgaaggagatgctcttgatgctttgggattggttcggtactgctgtaggagaatgcttatgactcatgttgacctcattgagaagcttctgaactacaacacattggagaagtcggagaccagttgaggaaacatgtagaatctaagggtttgttgcagtttgtgtgagtgcctgtcaataattctcagttttgtttaagtggggccgtggtttgaatccagaaaaagggaaggaaaggacttaaatagtactagtctagtttgttttctttagctctatgatggatccctgtatgtacgaaaatagtgggatttgaaatgctgaaagtgattggaatgctttgctgtttgctgggataattgtatgatcaaagactaacttttgttagttgcattgctacagatgtgttagtaagtgtaggatgaatggaaaccttaatcgagcattttaaaatcaataataatgacatg

SEQ ID NO: 1816 - DNA, 670 bp, Panicum virgatum
gggagcctggctgcatctctcgctagctctccattgtttcgttcagccgggccttctccacgccgaaacccttcccctcttcatccgggttccggcggcggcggcggcgaagatgatcatcccggtgcgctgcttcacctgcggcaaggtgattgggaacaagtgggacctctacctggacctcctccaggccgactatacggagggagatgctctggatgctttggaattggtccgctactgctgcaggcgaatgctcatgacccatgttgatctcattgaaaagttgctcaactacaacacattggagaagactgatacaaactaaagagaacacgccatgctccacaatcacctactgtttcttagtatgatagtgtgtggtatgctgtttcttctgtaccgggagaagctggttgtgagataatgttaatttagtttgctcatgaacaaaggacgtttgatgtgccgtgcatgttgcatctatgctatgaacttgtgatgctgtcagatatttgaagcgatgtttgaactgttgaccaaaaactagtacgttggtgtggattggatctataatgtttttgtttcaaattttttgttagatttcatctagcggtgcatgattgtatgtctctttactactgcctttttcatagaggacgcactttgt

SEQ ID NO: 1817 - DNA, 529 bp, Musa acuminata
gggacgcaccgattcttggggtttccgcggcggcgaggcaacaggcgagagagagggagagagagggggaagagatgatcatcccggtgcgctgcttcacctgcggcaaggtgattggtaacaaatgggatacgtacctcgatcttcttcaagcggattatactgaaggagatgctttggatgctttgggcttggttcgctattgctgtaggaggatgctgatgacccatgttgatctcatcgagaagttactcaattacaacactcttgagaagaccgagtccaattaaggaggtgatgtagtcttcccaagatcagttcattctgaagtggcgtttggtcccggtagcagaaacacattttataccatacatcagtttgttggtcggtacaaaaaaacccatgtgaggtgtcatgaaacactacctactgttagagatctatacactttgcgtgagttatgagtggggtttgtgcagcaaacagctttgtcagtcgataactcattggagtagtaattttctctaca

SEQ ID NO: 1818 - DNA, 541 bp, Musa acuminata
  misc_feature (9)..(9): n is a, c, g, or t
  misc_feature (26)..(26): n is a, c, g, or t
  misc_feature (38)..(38): n is a, c, g, or t
  misc_feature (98)..(98): n is a, c, g, or t
  misc_feature (278)..(278): n is a, c, g, or t
  misc_feature (295)..(295): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (304)..(304): n is a, c, g, or t
  misc_feature (312)..(313): n is a, c, g, or t
  misc_feature (317)..(317): n is a, c, g, or t
  misc_feature (319)..(319): n is a, c, g, or t
  misc_feature (337)..(337): n is a, c, g, or t
  misc_feature (392)..(392): n is a, c, g, or t
  misc_feature (415)..(415): n is a, c, g, or t
  misc_feature (427)..(427): n is a, c, g, or t
  misc_feature (494)..(494): n is a, c, g, or t
gggacgcancgattcttggggtttcngcggcggcgagncaacaggcgagagagagggagagagagggggaagagatgatcatcccggtgcgctgcttnacctgcggcaaggtgattggtaacaaatgggatacgtacctcgatcttcttcaagcggattatactgaaggagatgctttggatgctttgggcttggttcgctattgctgtaggaggatgctgatgacccatgttgatctcatcgagaagttactcaattacaacactcttgagaagacngagtccaattaagttgnagncnangnagtcttcnnaagntngtcccggtagcagaaacncattttataccatacatcagtttgttggtcggtacaaaaaaacccatgtgaggtntcatgaaacactacctactgttngagatctatacnctttgcgtgagttatgagtggggtttgtgcagcaaacagctttgtcagtcgataactcattggagtngtaattttctctacaagcaatgtcagttaaatatcagtatctataac

SEQ ID NO: 1819 - DNA, 599 bp, Panicum virgatum
ggctgcatctctcgctagccctccattatttcgttcagccagccttctccacgccgaaacccttcccctctttctccgggttccggcggcggcggcggcgaagatgatcatcccggtgcgctgcttcacctgcggcaaggtgattgggaacaagtgggacctctacctggacctcctccaggccgactatacagagggagatgctctggatgctttggaactggtccgctactgctgcaggcgaatgctcatgacccatgttgatctcattgaaaagttgctcaactacaacacattggagaagactgatacaaactagagagaacacgccatgctccacaatcacctgctgtttcttagtatcagagtgtgtgtggtatgctgtttcttctgtaccaggagaggctggttgtgagatgataatgttaatttggtttgctcatgaacgaaggacgtttgatgtgtcggttgcatctatgctatgaacttgtgatgctgtcagatatttgaagcaatttaactgtcgaccaaaactactcgtacattggtgcggattggatctataatgttcttgttgtcaaatttttagttaagacttc

SEQ ID NO: 1820 - DNA, 864 bp, Carthamus tinctorius
  misc_feature (637)..(637): n is a, c, g, or t
  misc_feature (728)..(728): n is a, c, g, or t
  misc_feature (731)..(731): n is a, c, g, or t
  misc_feature (740)..(740): n is a, c, g, or t
  misc_feature (743)..(743): n is a, c, g, or t
  misc_feature (750)..(750): n is a, c, g, or t
  misc_feature (784)..(784): n is a, c, g, or t
gggggcgctcttatttcgtcttcaatatcgaagtttgaatttgtgaaggcgaagattgaaattagggcaaaccagagatgatcattccggtcagatgcttcacctgcggcaaggttatcggaaacaaatgggacacgtatctcgatcttctccaatctgattacacggaaggagatgctcttgatgctttggggcttgttcgttactgttgcagaagaatgctgatgactcatgttgatctcattgagaagcttctgaactataacacattggagaagtccgataccacctgaggcctagttggaggcgatcgttatctgctttgaacaagtgtacttgctggtaaactttgtttgctttctagaatgaaagtataatcaatgaaaaacatgcatcaacttctagtttagaactatgtagcaatgcaaatctcagttttctgcaaactgcactttgtgtcattgcattgttaacctgaatatatgcttccgattgcttggttttttacatggggagagctccaaaaggggaaaagacgaattgggtgattcatgaatttagattagagggtaaattgagcctgcaaaacttgccaaaatcagccaagaacgattgggtgatctgccgtgtgtttcanaaggcttcaggaggaaagaagttccaattttccgggttatcgaggatgaattccggtggtgtcgttcttggttctctgccgccattgatgnacncacccgtgnttntcggtgncaggatgacgaatccgagcatatccgagtcgatnaacgtgccctgcttctccaatccaatcgaattcccaacaacccagaaagccatgatcagtaatttcctcagtaatccggt

SEQ ID NO: 1821 - DNA, 634 bp, Zingiber officinale
gtcggttgccgtttccttgcctatccccgtcccacgcgacgaactccgtcgatctctcgccgcctcttttccggctcttctcctcactgcgccggcttcctttctccggttctccctccttttctctttgccaaactctccgctgttgttgagaagatgatcatcccggtgcgctgcttcacttgcggcaaggtgattgggaacaaatgggatacgtatctagatcttctgcaggcggattacactgaaggagatgctctggatgctgtgggcttggttcgctactgctgtaggagaatgctcatgacccatgttgatctcatcgaaaagctactcaactacaacactctcgagaagacggagacaagctaatgagatggcaaatggaatcagttccaccatagtattagcatgaatcatggaatcatactttaatttgcataatgtcatggaatctgtatcagtactgtgttggatcagtatgaattgtgtgaattcccaaactactagttgatgacttgatctgattaatgtatgtttatatgctttgttgcgtgtttttaattggcatatggactcgacttttttatgttttttagttgagattaattcttttcaatccaaatgttaactt

SEQ ID NO: 1822 - DNA, 521 bp, Ipomoea nil
  misc_feature (123)..(123): n is a, c, g, or t
  misc_feature (174)..(174): n is a, c, g, or t
  misc_feature (219)..(219): n is a, c, g, or t
  misc_feature (231)..(231): n is a, c, g, or t
  misc_feature (252)..(252): n is a, c, g, or t
  misc_feature (323)..(323): n is a, c, g, or t
  misc_feature (335)..(335): n is a, c, g, or t
  misc_feature (369)..(369): n is a, c, g, or t
  misc_feature (385)..(385): n is a, c, g, or t
ccgccaccttctacagacaacagctgggaaactagggcagacagagtcgagagagaagcgaggatgatcataccagtccgttgcttcacctgtggaaaggtcatcgggaacaaatgggacgantaccttgatcttctccaagctgattacaccgaaggggatgctcttgatgcnttgggtttggttcggtattgctgtcgaagaatgcttatgactcangttgatcttatngagaagcttctgaactacaanacattggagaaagccgagggcagttgatgcagccatgtaggaagcggctactggcaagtgcatgtctcatngttttctgttantatgagcattctctttatgttcacaattgtgggncgtgtctatatgctcntgatgtactcgaacaagtaacaaaatgtaggtattaatgaagtaaaagtctagtctacaagctttactcgcctagttttgaacttgtattttgctactggtatccctgtttgaaattcaagtcagtttgcagtctg

SEQ ID NO: 1823 - DNA, 588 bp, Elaeis guineensis
actactgcgagcggagagacggatcggatttccggagcctccgaaggaacgaagagatgatcattcccgtgcgttgcttcacctgtggaaaggtgattggcaacaagtgggatacgtatctcgatcttctccaggctgattattctgagggggatgcactggatgctttgggtctagttcgctattgctgcaggcgaatgctcatgactcatgttgacctcatcgagaagttacttaattacaatacacttgagaaaacagatcccaattaaggcgatagcaggtggcatgtggattttcttctgtcacagtttcttcttgtgggtggcatgacatctagttgtaggtctggtagagatgttccgatttgtattatatatttgttttagaagtgggtgcatgagacagacatgtgagttaaagtgaatgtactgtgttgatgatggttcacaaacattttgttgaagatacaatttgttgatgttggtttatgaatcctttgaagatattatgccttggtgatgaatgtactatatattagcccatcaatttggagccatctatttgaaattcactttagtattggtt

SEQ ID NO: 1824 - DNA, 1951 bp, Zingiber officinale
  misc_feature (89)..(90): n is a, c, g, or t
  misc_feature (94)..(94): n is a, c, g, or t
  misc_feature (97)..(97): n is a, c, g, or t
  misc_feature (254)..(254): n is a, c, g, or t
  misc_feature (266)..(266): n is a, c, g, or t
  misc_feature (386)..(386): n is a, c, g, or t
  misc_feature (464)..(464): n is a, c, g, or t
  misc_feature (500)..(500): n is a, c, g, or t
  misc_feature (519)..(519): n is a, c, g, or t
  misc_feature (606)..(606): n is a, c, g, or t
  misc_feature (612)..(612): n is a, c, g, or t
  misc_feature (639)..(639): n is a, c, g, or t
  misc_feature (672)..(672): n is a, c, g, or t
  misc_feature (690)..(690): n is a, c, g, or t
  misc_feature (708)..(708): n is a, c, g, or t
  misc_feature (738)..(738): n is a, c, g, or t
  misc_feature (762)..(762): n is a, c, g, or t
  misc_feature (771)..(771): n is a, c, g, or t
  misc_feature (828)..(828): n is a, c, g, or t
  misc_feature (834)..(834): n is a, c, g, or t
  misc_feature (1742)..(1742): n is a, c, g, or t
caaaaaaaaaaaaaaaaaaaaaaaacaaaaaaaatagagtccatatgccaattaaaaacaagcaacaaagcatataaacacacattaannagancangtcatcaaggagtagtttggaacttcacacaattcatactaatcagacacagtacggatattgattcaatgacatcatgcaaactaaagtatgattcgatgatgcatgctgatactatggatgaactgattccatttgccatcttcattagctcgcntctgtcttctcnagagtgttgtagttgagtagtttttcgatgagatcaacatgggtcatgagcattctcctacagcagtagcgaaccaagcccacagcatccagagcatctccttcagtgtaatccgcctgnagaagatctagatacgtatcccatttgttcccaatcaccttgccgcaggtgaagcagcgcaccgggatgatcatcttntcaagtttggaaaatagatgagggagaaccggagangggacgccggcgcagcagngagaaagccggaagaggggcggcgagagatcgagggagttcgtccgtgggacgggggtaggcaatggaacgggaaccggtcgacganaagatngtggctgttcatgctgccatgggcggnggcacagggctgaattatttccaaaagaggttncctgagaagtgcttcgangtgggaattgccgagcancatgcagtcacttttgctgccgggttggcngcagagggcctgaagcccttctgngccatctantcctcgtttctgcaacgaggatatgatcaggtggttcatgatgtggacttgcagaanattccngttcggtttgcactcgatcgagctggcctcgtcggtgccgacggacctacacattgcggggcattcgacatcacctacatggcctgcttgcccaacatgatcgtgatggctccatctgatgaagctgaactgatgcatatggtggccacagcggcagccattgatgacagacctagctgcttcagattccctaggggcaatggagttggagtgcccctccctacaggctacaaaggcactcctcttgaggttgggaagggtaggattctgatggaaggagatagagtggccatcctcggatatggttccatagttcagacatgcttacaggctgcagactcacttaagacccatggaatctttacaacagtggctgatgctcggttctgtaagcctctggatgtggaactgatcaggaggctggtagatgagcatgagatactgatcacagtggaggagggctccattggaggtttcggttcgcatgtcgcgcagttcttgggcctgaatggccttctggatggacacctcaagctgagatcaatctttttgcctgaccgatacatcgaccacggatcgccaaaggaccaagtcgaagcggctggactttcctccgagcagattgcaggaaccgtgctcaatctcttgggcaaaccgaaggaagcattgcacctccaatgaaaaaatcggagcaatcaaatatgcaattactacagaacaacaaaatttagattcaagggaatatgagggtttggaattaattgcaaataccaccctttgccttcccatcttttcgttcttcattgctgcctcatcctcggttcaaatatgtgagaggatgaatataatttatcgatctgattccatttaattcaagcaattggaataagaattctgtttatgacttnaggaactcgagtcgtgtagaagtcggggatgatgccctcttcactggtgctcataccgagaagaaacatgagaagaagaaatgtgctctccattccgacaggaagatgagagaatggtggaaggaagaatacttcgcagagattagccggaaaggccattgcaagaaagatcgacagcggtggttccgaactataagtaacctcggcga

SEQ ID NO: 1825 - DNA, 465 bp, Helianthus annuus
  misc_feature (464)..(464): n is a, c, g, or t
gcggggaatcaattgaacttgtgaaggcgaaactagggcaaaagatgatcattccggttcgttgcttcacctgcggcaaggtcatcggaaacaaatgggacacgtatcttgaccttctccaatctgattacactgaaggagatgctctcgatgctttggggctggttcgttattgttgcagaagaatgttgatgactcatgttgatctcattgaaaagcttctcaactacaatacattggagaaatccgacaccaattgaagctagttgaagcttattgaggatgtttgtggatagttctctcatgaatgaatgttcttcgtatgtttgcgttatggatgatatcttaagttagttatttcacatgtagtatgtatttagtaagtaatgccctgaaggttgtttcaccatatgacatgtttgttcgtctctttaaattaatcacgttgcaatagtttgcatgcng

SEQ ID NO: 1826 - DNA, 520 bp, Ipomoea batatas
ccgccaccttctacagacaacagctgggaaactagggcagacagagtcgagagagaagcgaggatgatcataccagtccgttgcttcacctgtggaaaggtcatcgggaacaaatgggacgaataccttgatcttctccaagctgattacaccgaaggggatgctcttgatgcattgggtttggttcggtattgctgtcgaagaatgcttatgactcacgttgatcttatcgagaagcttctgaactacaacacattggagaaagccgagggcagttgatgcagccatgtaggaagcggctactggcaagtgcatgtctcatcgttttctgttaatatgagcattctcttatgttcacaattgtgggacgtgtctatatgctcatgatgtactcgaacaagtaacaaaatgtaggtattaatgaagtaaaagtctagtctacaagctttactcgcctagttttgaacttgtattttgctactggtatccctgtttgaaattcaagtcagtttgcagtctg

SEQ ID NO: 1827 - DNA, 463 bp, Ipomoea nil
gatatcgccaccttcttctacagctcggaaactagggcagacagattcgagaagcgaggatgatcataccagtccgttgcttcacctgtggaaaggtcatcggaaacaaatgggacgagtaccttgatcttctccaagctgattacaccgaaggggatgctcttgatgcgttgggtttggttcggtattgctgtcgaagaatgcttatgactcatgttgatcttattgagaagcttctgaactacaacactttggagaaagccgagggcagttgatgcagccatgtaggaagtggctactggcaagtgcatgtctcatcattttctgttaatgtgagcattctcttatgttcacaattgtgagacgtgtctatatgctcgtgatgtactcgaacaagtaacaaagtgtatgtattaatgaattaaaagtctagtctacaagctttactcgcgcaaaaaaaaaa

SEQ ID NO: 1828 - DNA, 577 bp, Tropaeolum majus
acggccggggtctttcctacaacttataaaccgccattgacgtaccagcaagcgagcaagtttgagagacgaaagccggaggaaaagccaagatgattattccagttcgttgctttacatgcggcaaggtgattggtaacaaatgggacacttatcttgatcttctccaggctgactacagtgaaggagatgctcttgatgctttaggattggtccgatattgctgtaggcgaatgcttatgacacatgttgatctcattgagaagcttctgaactataacactctggagaagtccgacacaacttgatgagtccatgaagttttacccttttgtcagtttgatgtctcatctggctttagtataagtaacaagtcatatgaagcaaattagttaaacatcacttgtagcgaagactattttgtaatgtaggtgtagttctattttatccatgaaactaaaactaaactaacctcaacagtatattgctaatattgcttcaatatcgttgttgcttgatgtatatcgattcttttacttttacctaattaagtaaaaaaaaaaaaaaaggccgcctc

SEQ ID NO: 1829 - DNA, 452 bp, Tropaeolum majus
tacggccggggtatcgagggagagacgaaatcagagagaaaatcaaagatgattataccggtccgttgctttacatgcggcaaggtgattggtaataagtgggatacttatcttgaccttctccaggctgactacagtgaaggagatgctcttgatgcgttggggttggttagatactgctgcaggcgaatgcttatgactcatgtggatctcatcgagaaactcctgaactataacactttggagaagtctgacacaacttgaacagaactactttcaccgacccttctgaaacgtttttgtggagctatgaagcgattagtttatggtatgtagttaagatattagagaattgtttattgtgtaagtaatcttggaagcacttgaagattcaaatccatgtgattgtttatcaaactttatttctaagctgaaattaattaaaagtattt

SEQ ID NO: 1830 - DNA, 594 bp, Pinus taeda
agccaggagtagcggaagcggtctgcatattcggcccatcacagagaggagtaaagccattaggggcgcttgcctgtgatctgtgaaaatgattatccccgttcgatgtttcacctgcggaaaggtgattgggaataaatgggacacatacctcgaccttctgcaggccgactatactgaaggggacgctcttgatgcattggggttggtgagatactgctgtaggcgtatgctgatgactcatgttgatctcatcgagaagcttttgaattacaacactttagagaggagtgaaacaagttagtaaaatttctggacggttatggaagagctcccctaatatttttggacttgtcttcatattgctagatggcttcaagagtatcatttgtgtgcatatataaataggatattccattaccatgttggattatgctcaataatgataggtcactgttcttgtgatggagacaaattagtcataagttaatggttattatgcgaacgttttcccaatatatgaaatattgtcatatctatggatggtttgtgaatattatacatatgaatatataaatagcatattccagtacc

SEQ ID NO: 1831 - DNA, 703 bp, Pinus taeda
gtattcggcgcatcacagagcggaggaaaggccaatatctgtcgcctgcttgtggtctgtgaaaatgattatcccagttcgttgttttacctgcggaaaggtgattgggaataaatgggatacgtacctcgaccttctgcaggccgactatactgaaggggacgctcttgatgcattggggttggtgagatactgctgtaggcgtatgcttatgactcatgttgatctcattgagaagcttttgaattacaacactttagagaggagcgaaacaagttaatgataatcaaaattttggacggttattatgggagatgttctcataatatttttggacttgtcttcatattgctagatggcttcaagagtactatgcgtgtgtatttataaatagcatattcctgtaccttggattgtgctcaatgatgataggtcattgttcttggacggagacaaattagtcacgaagttaatggttacgatgtggacgttttcctaatatttggaattattgtcatatctatggatggtttgtgaatatataaatagcgtattccagtaccgtgttggactgtgctctatgatgataggccattgttcatctgatagagtcaggttatgcttttacatgaatgaaaggttcgtaactgtgttgatctggttatttaaagtcataaattttagcaaaaaaaaaaaaaaaaaa

SEQ ID NO: 1832 - DNA, 243 bp, Prunus persica
agagacttagggcaaaacaagatgatcatcccagtgcgctgtttcacctgcggaaaggtgattggaaacaaatgggatacgtatcttgaccttctgcaagcagattacaccgaaggagatgcacttgatgcattgggtttggtccgttattgctgtcggcgaatgcttatgactcacgtcgacctcatcgagaagcttctgaactacaatactttggagaagtctgaaaacagctgaggaagc

SEQ ID NO: 1833 - DNA, 270 bp, Triphysaria pusilla
agcgattgaagatgattattccagttcgctgcttcacttgtggaaaggtgattgggaacaaatgggatacttatctggatttgctccaagctgattacaccgaaggtgatgcacttgatgcgttgggtttggttcgttattgctgtcgaagaatgctgatgacacacgtcgatctcatcgaaaagcttctaaactataacactttggagaaatcggagggcagttgaattaatttgtctaaaacctcatcaagttttctcgaaatttgaa

SEQ ID NO: 1834 - DNA, 621 bp, Zostera marina
aaatgatacatggggtgaaaaccagaaaggagtagtccaagagtggagaaaaccctaatttttagcgaagaggtttatatcgggatttggtaaggcacggcgtttctcttccattagttctccagctcaaacgaaatagtcccttttcgattttgtactagaatcaaggtcgagagtgtgagagacgattggaagaaaaaatgatcattcctgtgcgttgtttcacttgcggaaaggttattgggaacaagtgggacaactacctcgatcttctccaggctgattattccgaaggcgatgctctagatgcattgggtcttgtccgttattgctgcagacggatgcttatgacccatgtcgatctcattgagaaactactcaattacaacactttggaaaagaatgatcccagtgcgaataactaaatcactttgtttgctgctgccccaatgactaataaagatctaaattccacaatattaatttaccataataaatttctttttttgtgttggttttatttttcaaagtttagacaaagcgacttaattgaccagttagcctagttttaataatccaatgaatttagtatgttattactttgaattaaactagtttcta

SEQ ID NO: 1835 - DNA, 540 bp, Amborella trichopoda
  misc_feature (129)..(129): n is a, c, g, or t
  misc_feature (374)..(374): n is a, c, g, or t
  misc_feature (474)..(474): n is a, c, g, or t
  misc_feature (502)..(502): n is a, c, g, or t
ggtctggggagctgcagttagggcatcaaaatgatcatccctgtgcgctgcttcacctgcggcaaggtgattggtaataaatgggatacatacctggaccttctacaggctgattatactgaaggtgangctcttgatgcactgggcctggttcgctactgctgcaggcgcatgctgatgactcatgtcgacctcattgaaaagctcttgaactacaacactctcgagaaaaatgaaaccagctaaatgggtgctgtggtgggaagaaaatggccctatagaaactcgaagcttatacaaggcctcagtgatttgaggaatgtacatattaaaacttgttgattatcatgcgcaaacctcatcctatggtattnttcagtggtctttggacttgtatgactagttttgccgccagcccccacacacaggggactaagttttgagctacagaaactgtgatgtgccatgtgattnggtgattgcaacgaactacatgtctttngtattgtaaggtaaaccaactgaagctattagtaaaag

SEQ ID NO: 1836 - DNA, 898 bp, Picea glauca
ccccccccccccccgaagtgactattcattctccgtatcacttcaccttactcccgttcgcttttaggagttgggcaagagtgtgtctccattactccaggttgtgtggatgggccaaaagaaaggagtaaaacgaacgacgaaatccagcaaagaaatccaggtccgaagtcacccatagaagcggtgtacatattcggtgcatcacagagaggagtagaagccagcagtgtttgcctgcctgtggtctgcgaaaatgattatccccgttcgatgttttacctgcggaaaggtgattgggaataaatgggatacatacctcgaccttctgcaggccgactatactgaaggggacgctcttgatgcattggggttggtgagatactgctgtaggcgcatgctcatgactcatgttgatctcattgagaagcttttgaattacaacactttagagaggagtgaaacaaattagtcaaagttcttgacgtggttattatgggagcgttctcctaaaattttgtggacttatctttatatttatagatggcttcgagagtattatgtatgtgtatatataaatagcatattccagtaccatgttggactttgatcaatgatgataggtcatttttcttatgacggagacaaattagtcatgaagttaatggttattatgtgagcgttttcctaatatttttggaattattgtcatatctatagatggttttgtgaatattatacatgtgaatatataaatagcatattccagtaccatgttggactgtactctatgatgataggccattgttcttatgacagagagtcaggttgtacttttacatgaatgaaaattttgaaaatatgttgatttaattattgaaagtcattgatttcagca

SEQ ID NO: 1837 - DNA, 695 bp, Picea glauca
tcccgaatcattaaacctgaggaggctaaaaggggaaggttctgcatttgttaccaaaagcctgagtagaaggcaacatcagagagtaggagtcattagttcttaggttctgcatttgttacgaaaaacctgagtagaaggcagcatcagagagagtagaagtcattagtgcttgcctgcctgcggtctgtgaaaatgattatccccgttcgatgttttacctgcggaaaggtgattgggaataaatgggatacatacctcgaccttctgcaggccgactatactgaaggggatgctctcgatgcattggggttggtgagatactgctgtaggcgtatgctcatgactcatgttgatctcattgaaaagcttttgaattacaacactttagagaggagtgaaacaaattagtcaaatttcttgacgcggttattatgggagcgttctcctaatatttttggactttatatatatagatggctttgatagtattatgtatgtgtatatataaataacatatttcagtaccatgttggactgtgatcaatgatgataggtcatttttcttatgacggagacaaattagtcatgaagttaaaaggttattatgtgaacgttttcctaatatttcatatctatagatggttttgcgaatattatacatgtgaatatataaatagcatattccagtacca

SEQ ID NO: 1838 - DNA, 679 bp, Populus trichocarpa
agacacctagaaaatagaacacgcagaacgccaccatagagcagagaagctctaaaagggaaactagcacaggctgaaaatcttaagagagccaagcaaagatgattatcccagttcgttgttttacttgcggcaaggtgattggaaataaatgggatacgtatcttgatcttcttcaagccgattacactgaaggagatgctcttgatgctctggggttggttcgttattgttgtagaagaatgcttatgactcatgttgacctcattgagaagcttctgaactacaatactctggagaaaagtgagggcagttgagaagctcattgcatcacggttgacatgaagctggttatggaaattgatgattaattgttggatgtgtggtgaatatggtgaaagtagacatgggacaaagttcaaatactgtataaacttttaaccactcttgccttgcatacttcgttttggaacctagtcactgtttaagaccaatgttttgagaagcttatcagtcattttaaatgcctgttgtgcgatgctgttggcaatattctttcaaatgtgatgccttctacgatgatcaatatagtccggttgcaacctagtcgctgggtactaatagaagtgatgaattgcttttcatgagtatatataattggacaatctaaatttgtttg

SEQ ID NO: 1839 - DNA, 593 bp, Populus trichocarpa
agacacctagaaaataaaacacgcagaacgccaccatagagcagagaagctctaaaagggaaactagcacaggctgaaaatcttaagagagccaagcaaagatgattatcccagttcgttgttttacttgcggcaaggtgattggaaataaatgggatacgtatcttgatcttcttcaagccgattacactgaaggagatgctcttgatgctctggggttggttcgttattgttgtagaagaatgcttatgactcatgttgacctcattgagaagcttctgaactacaatactctggagaaaagtgagggcagttgagaagctcattgcatcacggttgacatgaagctggttatggaaattgatgattaattgttggatgtgtggtgaatatggtgaaagtagacatgggacaaagttcaaatactgtataaacttttaaccactcttgccttgcatacttcgttttggaacctagtcactgtttaagaccaatgttttgagaagcttatcagtcattttaaatgcctgttgtgcgatgctgttggcaatattctttcaaatgtgatgctttctacgatgatcaatatagtc

SEQ ID NO: 1840 - DNA, 1817 bp, Zea mays
ccgagcatctttatctagccaagtagataagccgagccgtcgtttccagccctaccggtacggattgaagccggtacaatacaacctgcgtaagtagccaggcccaatctcccagcccaaagtcccatcccattgctcgttctgtcccttcgttcacaacctcctccacgaccaaacgatccgggttccagcggcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagaccgagacaagttaagtgagcaagcatatcatgctctgaaagcactactgtttcgcagtatcatatatattgtaggcggtatgttgtctcttctctatcaggagaggattgttgtcagtgtgaacttgcttttgctcacgagcattcaaggactgacagtgcatgttgcatctatgccacgatgttggagattttaatcgatataataactgctaactaatactctctttgtctctgtcccaatttataattcgtttgacctttttacatcaagtttgattggctcgtattattgcatcggccgtatgcatactcatgtgcttcgaggtatacaacggccgaaaatggccactcggtccgtcgtcgtcgcgaggtatatacaatggccactcggtcatgtgcttcgagctaggctgtacctcatttcgcttcgttgacttccacaataggctgtacctgtacgtgctgctattattcatctgggactggcatatagtacgttcagattcttcatgttttggcctgatcaggtgtatttttcaccggatctcagtacccgtttggcctgatcaggctatggcgatatgcagacgatgttcaactttactaatctctctctctttttttctgtccaaactgtattattgcatccgtttgtgaatgcacgaattcatttgcaaggaggaacaaaactgtgatcaaagaacaaagaatcaaagagaacgaccgacctatgtacagttgtacacacacacacaaaaatggcgcgcgatccccgcaactgggggatcgagcaggcggcggattcgttcggccgccggccggtcagccctcgaagctggacgagcggctccatctccccctgaggtactcctccaacgacacggcggcggcggcggcgaagatgatcataccggtgcgctgcttcacctgcggcaaggtgattgggaacaagtgggacctctacctcgacctcctccaggccgactactcggaaggggatgctctggatgctctggaactgttccgctactgctgcaggcgaatgctcatgacccatgttgacctcattgagaagttgctcaactacaacacactggagaagactgagacaagttaagtgagcaagcatatcatgctctgaaagcactactgtttcgtagtatcatatatattgtaggcggtatgttgtttcttctctatcaggagaggattgttgtgagtgtgaacttgcttttgctctcgagcattcaaggactgacaagggcatgttgcatctatgctacgatgttggagattttaatcgatataacggctaactaatactctctgtgtctctgtcccaatttataattcgtttgacctttttacatcaagtttgattggctcgtgttattgcatcgac

SEQ ID NO: 1841 - DNA, 568 bp, Zea mays
agcccaaagtcccatcccattgctcgttctgtcccttcgttcacaacctcctccacgaccaaacgatccgggttccagcggcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctctgaaagcactactgtttcgtagtatcatatatattgtaggcggtatgttgtttcttctctatcaggagaggattgttgtgagtgtgaacttgcttttgctctcgagcattcaaggactgacaagggcatgttgcatctatgctacgatgttggagattttaatcgatataacggctaactaatactctctgtgtctctgtcccaatttataattcgtttgacctttttacatc

SEQ ID NO: 1842 - DNA, 669 bp, Saccharum officinarum
tttcgttcacaacctcctccacgaccaaacgaccaaacccttccccaccccccgcagctccgggctccagcggcggcggcgaagatgattatcccggtgcgctgcttcacctgcggcaaggtgattgggaacaagtgggacctttacctcgacctcctccaggccgactactcggaaggggatgctctggatgctttggaattgttccgctactgctgcaggcgaatgctcatgacccatgtcgacctcatcgagaagttgctcaactacaacacactggagaagactgagacaagttaagtgagcacgtcatgctccaaaagcactactgtttcgtagtatcatagagtgtgggttgtatgttgtatcttctcaatcgggagagatatgttgagtgtgaacttgcttttgctcatgaacattgaaggacttttcatgtgacagtgcatgttgcatctatgccacgacgttggatattttaagtgatataactgttaactgaaaactaatgtatttgtgcgaattggattcgataatattttgtttacagatgcgtgtctttggttggactacatttagtgaatgcatgcttgtacacatcttattattgtattctactgtataactctaatagacatttctggtccatatgagctattgctgtttctt

SEQ ID NO: 1843 - DNA, 568 bp, Pinus taeda
  misc_feature (121)..(121): n is a, c, g, or t
  misc_feature (124)..(124): n is a, c, g, or t
  misc_feature (315)..(315): n is a, c, g, or t
  misc_feature (444)..(444): n is a, c, g, or t
catattcggcccatcacagagaggactaaagccattagtgggcgcttgcctgtgatctgtgaaaatgattatcccagttcgttgttttacctgcggaaaggtgattgggaataaatggganacntacctcgaccttctgcaggccgactatactgaaggggacgctcttgatgcattggggttggtgagatactgctgtaggcgtatgcttatgactcatgttgatctcatcgagaagcttttgaattacaacactttagagaggagtgaaacaagttagtgaaatttctggacggttatggaagagctcccctnatatttttggacttgtcttcatattgctagatggcttcaagagtatcatgtgtgtgcatatataaatagcatattccattaccatgttggattatgctcaatgatgataggtcactcttcttgtgatgnagacaaattagtcaataagttaatggttattatgcgaacgttttcccaatatatgaaatattgtcatatctatggatggtttgtgaatattatacatatgaatatataaatagcatattccagt

SEQ ID NO: 1844 - DNA, 680 bp, Sorghum bicolor
gaccgcctcgctcgctcctgtgtttcgttcacaacctccatcccgaccaaacgaccaaaccctccctctcctgctccgggctccagcggcggcggaggcggcggcggcggcgaagatgatcatcccggtgcgctgcttcacctgcggcaaggtgattgggaacaagtgggacctctacctcgacctcctccaggccgactactcggaaggggatgctctggatgctttggaattgttccgctactgctgcaggcggatgctcatgacccatgttgacctcattgagaaattgctcaactacaatacactggagaagactgagacaagttaagtgagcacatcatgctccaaaagcactactgtttcgtagtatcatagtgtgttgtatgttgtttcttatccatcaggagagagatgctttgagtgtgaacatgcttttgctcatgagcgtggacttttcatgtgaaattgcatgttgcatctatgccatgacgttggatattttaagtgatataactgtaactgaaacctaatgtatttgtgtggattgaattcgataatattttgttgacagatgtgcgtctttggttggactacttttggtcatgcatgcttgtacacctcttattattgtattctatagctctaagagacatttctcatccataggagctattgct

SEQ ID NO: 1845 - DNA, 587 bp, Musa acuminata
ggactccagttcctaagtctacacgcccttcccttcgagtcccggagtcggcgagcgaagaaaggaaagacgaagggagatgatcatccctgtgcgctgcttcacctgcggcaaggtcattggcaacaaatgggacacgtatctcgaccttctccaggcggattacactgagggggatgctttggatgctctgggcttggtccgctattgctgtaggcgaatgcttatgactcatgttgaccttattgagaagttactgaactacaacactctcgagaagactgatagttaaggagatgatatggtggaaaagagtatgattccgatccgggcgtcacgtaattttgtttgatgtgttgggcattatgaataacattctgtagtgtttttattgtaattcattcttatgagaattacaagtaagatggatttctaagttgtccagaatattacctgttgaaagtcttttaagtttggtttgcaattgctgcttggtctagaaatcatttttgtttgtgtgaagagaaggattacatcagcaacttgataagtaggtgaatcatcaaacatatgcaaactgttcccct

SEQ ID NO: 1846 - DNA, 587 bp, Musa acuminata
  misc_feature (324)..(324): n is a, c, g, or t
  misc_feature (329)..(329): n is a, c, g, or t
  misc_feature (359)..(359): n is a, c, g, or t
  misc_feature (397)..(397): n is a, c, g, or t
  misc_feature (539)..(539): n is a, c, g, or t
  misc_feature (554)..(554): n is a, c, g, or t
  misc_feature (564)..(564): n is a, c, g, or t
ccactccagttcctaagtctacacgcccttcccttcgagtcccggagtcggcgagcgaagaaaggaaagacgaagggagatgatcatccctgtgcgctgcttcacctgcggcaaggtcattggcaacaaatgggacacgtatctcgaccttctccaggcggattacactgagggggatgctttggatgctctgggcttggtccgctattgctgtaggcgaatgcttatgactcatgttgaccttattgagaagttactgaactacaacactctcgagaagactgatagttaaggagatgatatggtggaaaagagtatgattcngatcngggcgtcacgtaattttgtttgatgtgttnggcattatgaataacattctgtagtgtttttattgtanttcattcttatgagaattacaagtaagatggatttctaagttgtccagaatattacctgttgaaagtcttttaagtttggtttgcaattgctgcttggtctagaaatcatttttgtttgtgtgaagagaaggattacatcancaacttgataagtangtgaatcatnaaacatatgcaaactgttcccct

SEQ ID NO: 1847 - DNA, 469 bp, Catharanthus roseus
tagtggatccaaagaattcggcacgaggggcgaatcgactcgattgcagaagaagagctttctgaagatgatcattccagttcgttgcttcacctgcggcaaggtgatcggaaacaagtgggattcgtatctcgaccttctccaggctgattatcccgaaggtgatgctcttgatgctctgggtttggttcggtactgctgtcggagaatgctcatgacccatgtggatctcatagagaagcttctaaactacaacactttagagaaatcagaggggacttgatgcaataactttagacagtttctctcattgacgaatgcgtgatcgataaattgtatctaatcttattagcagtatgatatgcattttctgagttgttatgtagctctgaacatttcacactatcactattgttgtagtattcaagagtctctttgttggtaaaaaaacattgaactttttcgcctt

SEQ ID NO: 1848 - DNA, 808 bp, Pinus taeda
  misc_feature (727)..(727): n is a, c, g, or t
gagcgacatccctcaattcatccacatcaaccttcaagaaaaatatttctgggaacctccttgaaagctcaacaaacactggactgataactcgacaaggtccacaccacgttgcagtgaaatctaccaccaccagacgtttagtatcgatggcctcctgcaacttggaacgccatgcctctgtagagtgacaagcaaacacgtttccatccgccatctcttcttcctcttctcaagatcaaaagtcttctttctcttctcaacaacgcagtagtgaacggtctacgtattcggcgcatcacagagcggaggaaaggccaatatctgtcgcctgcttgtggtctgtgaaaatgattatcccagttcgttgttttacctgcggaaaggtgattgggaataaatgggatacgtacctcgaccttctgcaggccgactatactgaaggggacgctcttgatgcattggggttggtgagatactgctgtaggcgtatgcttatgactcatgttgatctcattgagaagcttttgaattacaacactttagagaggagcgaaacaagttaatgataatcaaaattttggacggttattatgggagatgttctcgtaatatttttggacttgtcttcatattgctagatggcttcaagagtactatgcatgtgtatttataaatagcatattcctgtaccttggattgtgctcaatgatgataggtcattgtncttggacggagacaaattagtcacgaagttaatggttacaaagtggacgttttcctaatatttggaattattgtcatatct

SEQ ID NO: 1849 - DNA, 587 bp, Populus trichocarpa
aagttcccacggaaacacgcagtagcagaacagcgcaggagtcgagcacgagcacgagcacgagcacaggcttatcttagtcgtgagagagacagccaaagatgattatcccagttcgttgtttcacttgcggcaaggtgattgggaacaaatgggatacgtatcttgatcttctccaagctgattacactgaaggagatgctcttgatgcgttggggttggttcggtattgctgtagaagaatgctcatgactcatgtcgaccttattgagaagcttctgaactacaatactctggagaaaagtgagggcagttgagaacctcataggatcgctagggacctggagctgctttgtgtgactcatggatgtattggaggatgtgtggtgaatatggtgatagtagacacgagggatgttcaaatactctgcagaactttttgttacaacctagtcactgtttgagaccattgttttgagaaactgctcaatcatttcaatgcctgttgtgcgatactgttggcaaacttttttgaaaatgtgatgctatatatgatgatcaatataatcttgctgcagccgacctga

SEQ ID NO: 1850 - DNA, 599 bp, Populus trichocarpa
aagttcccacggaaacacgcagtagcagaacagcgcaggagtcgagcacgagcacgagcacgagcacgagcacgagcacaggcttatcttagtcgtgagagagacagccaaagatgattatcccagttcgttgtttcacttgcggcaaggtgattgggaacaaatgggatacgtatcttgatcttctccaagctgattacactgaaggagatgctcttgatgcgttggggttggttcggtattgctgtagaagaatgctcatgactcatgtcgaccttattgagaagcttctgaactacaatactctggagaaaagtgagggcagttgagaacctcataggatcgctagggacctggagctgctttgtgtgactcatggatgtattggaggatgtgtggtgaatatggtgaaagtagacacgagggatgttcaaatactctgtagaactttttgttacaacctagtcactgtttgagaccattgttttgagaaactgctcaatcatttcaatgcctgttgtgcgatactgttggcaaacttttttgaaaatgtgatgctatatatgatgatcaatataatcttgctgcagccgacctga

SEQ ID NO: 1851 - DNA, 346 bp, Senecio madagascariensis
aagcagtggtatcaacgcagagtacggcgggggtagctcgaaattgtaaaggcgaaagtagggcaaacatgatcattccagtccgttgcttcacttgcggcaaggtaattggtaacaaatgggacacgtatctcgatctccttcaatctgattataccgaaggagatgctcttgatgctttgggtctcgtacgctattgttgccgaagaatgttgatgactcatgttgatctcattgagaagcttttgaactacaacaccttggagaaatctgataccacttgaggctcatcagagaatgttagtggatacttctctcacgaagagaagatacttggaacaattgt

SEQ ID NO: 1852 - DNA, 545 bp, Zea mays
gttcacaatcacaacctccacgaccaacgaggcaacgaccaaacgtccaaacccttccccctccctagctccgtgctccagcgggagtccgcggcggcggtgaagatgattatcccagtgcgctgcttcacctgcggcaaggttattgggaacaagtgggatctatacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttggcagtatcatagagcttaggtagtatgttgtctcttctctatcagtagaaatgggttgtgagtgtgaacatgcttttcaaggacttttcatgcgacagtgcttgttgccacctatgcaacgatgttggatattttaagtgatataattgctaaaagaaagctaatgtatttgtgtgaattgggtcgata

SEQ ID NO: 1853 - DNA, 562 bp, Saccharum officinarum
  misc_feature (183)..(183): n is a, c, g, or t
  misc_feature (366)..(366): n is a, c, g, or t
  misc_feature (369)..(369): n is a, c, g, or t
  misc_feature (376)..(376): n is a, c, g, or t
  misc_feature (384)..(384): n is a, c, g, or t
  misc_feature (397)..(397): n is a, c, g, or t
  misc_feature (425)..(425): n is a, c, g, or t
  misc_feature (427)..(427): n is a, c, g, or t
  misc_feature (430)..(430): n is a, c, g, or t
  misc_feature (469)..(469): n is a, c, g, or t
  misc_feature (545)..(545): n is a, c, g, or t
tcctccatttcgttcacaacctcctccacgaccaaaccctccctccctccccagctccgggctccagcggcggcggcggcggcagcggcgaagatgatcatcccggtgcgctgcttcacctgcggcaaggtgattgggaacaagtgggacctctacctcgacctcctccaggccgactactcngaaggggatgctctggatgctttggaattgttccgctactgctgcaggcgaatgctcatgacccatgttgacctcatcgagaagttgctcaactacaacaccctggagaagaccgagacaagttaagtgagcacgtcatgctccaaaagcactactgtttcatagtatcatagagtgtaggtngtntgttgtntcttctcnatcaggagagatntgttgtcagtgtgaacttgcttttgctnangancattcaaggacttttcatgtgacagtgcatgttgcatcnatgccacgacgttggatattttaagtgatataactgttaactgaaaactaatgtatttgtgcgaattggatttganaatattttgttgacaga

SEQ ID NO: 1854 - DNA, 409 bp, Ipomoea nil
acagctcggaaactagggcagacagattcgagaagcgaggatgatcataccagtccgttgcttcacctgtggaaaggtcatcggaaacaaatgggacgagtaccttgatcttctccaagctgattacaccgaaggggatgctcttgatgcgttgggtttggttcggtattgctgtcgaagaatgcttatgactcatgttgatcttattgagaagcttctgaactacaacactttggagaaagccgagggcagttgatgcagccatgtaggaagtggctactggcaagtgcatgtctcatcattttctgttaatgtgagcattctcttatgttcacaattgtgagacgtgtctatatgctcgtgatgtactcgaaccaagtaaccaaagtgtatgtattaatgaattaaa

SEQ ID NO: 1855 - DNA, 571 bp, Coffea canephora
cggccgggggcttccaaaactccttccatccctttcccttgaggactagaaaagatgatcattccagtgcgttgcttcacctgtggaaaggtgatagggaataaatgggacacttatcttgaccttcttcaggctgactacaccgaaggagatgctcttgatgcactaggtttggttcggtactgctgtcggaggatgttgatgactcatgttgatcttattgagaagcttcttaactacaacactttggagaaatctgagggcagttgatcagggttctggaggattcttcttaggagacagtgtggcatttgtatgaagtaaaagaatttacatgtagcacaatctatgtaatgtgtacttgtcgtccttgcagcttaccatgtgatgagttggtaattttgactactgctgcctagcttatgattctgattttgctacttgtgtcccatcttataatgttttctgttacagtttggtaaaagatttggtatctcgtaagggcttaacattcgtaattattctctctctctcttgcccgtatagggatttacatcaacagaattcatgt

SEQ ID NO: 1856 - DNA, 476 bp, Coffea canephora
ctttcctttgagggctagaaaagatgatcattccagtgcgttgcttcacctgtggaaaggtgatagggaataaatgggacacgtatcttgaccttcttcaggctgactacaccgaaggagatgctcttgatgcactaggtttggttcggtactgctgtcggaggatgttgatgactcatgttgatcttattgagaagcttcttaactacaacactttggagaaatctgagggcagttgatcagggttctggaggattcttcttaggagacagtgtggcatttgtatgaagtaaaagaatttacatgtagcacaatctatgtaatgtgtacttgtcgtccttgcagcttaccatgtgatgagttggtaattttgactactgctgcctagcttatgattctgattttgctacttgtgtcccatcttgtaatgttttctggtacagtttggtaaaagatttggtatctcgtaagggctc

SEQ ID NO: 1857 - DNA, 525 bp, Centaurea maculosa
  misc_feature (243)..(243): n is a, c, g, or t
  misc_feature (252)..(252): n is a, c, g, or t
  misc_feature (321)..(321): n is a, c, g, or t
  misc_feature (323)..(323): n is a, c, g, or t
  misc_feature (361)..(361): n is a, c, g, or t
  misc_feature (369)..(369): n is a, c, g, or t
  misc_feature (407)..(407): n is a, c, g, or t
  misc_feature (513)..(513): n is a, c, g, or t
  misc_feature (523)..(523): n is a, c, g, or t
ttggcgggggctcttattttttgtcttcaaaatcgaagtttgaaatttttgaaggcagagattgtgaaattagggcaaaccaaaaagatgatcattccggtcagatgcttcacctgcggcaaggttattggaaacaaatgggacacgtatctggatcttctccaatctgattacacggaaggagatgctcttgatgctttggggcttgttcgatactgttgcagaagaatgctgatgactcangttgatctnattgagaagcttctgaactataacacattggagaagtccgataccacctgaggcctagttggagtcgancnttatctgctttgaacaagtgtacttgctggtgaacttngtttgctntctagaatgaaagtagaattaatgaaaaacaggaatcnacttctagtttagaactatgtagcaatgcaaatctcagttttctgaatactgtcattgtcattgcattattaaacctgaatatatgtaatatgcttaagaaaagcnccgttgcgancc

SEQ ID NO: 1858 - DNA, 799 bp, Pinus taeda
  misc_feature (531)..(531): n is a, c, g, or t
acgcggggctgcatattcggcccatcacagagaggagtaaagccattaggggcgcttgcctgtgatctgtgaaaatgattatccccgttcgatgtttcacctgcggaaaggtgattgggaataaatgggacacatacctcgaccttctgcaggccgactatactgaaggggacgctcttgatgcattggggttggtgagatactgctgtaggcgtatgctgatgactcatgttgatctcatcgagaagcttttgaattacaacactttagagaggagtgaaacaagttagcaaaatttctggaaggttatggaagagctcccctaatatttttggacttgtcttcatattgctagatggcttcaagagtatcatttgtgtgcatatataaataggatattccattaccatgttggattatgctcaataatgataggtcactgttcttgtgatggagacaaattagtcataagttaatggttattatgcgaacgttttcccaatatatgaaatattgtcatatctatggatngtttgtgaatattatacatatgaatatataaatagcatattccagtaaacactggaaagcagtcgtgcaacactgttgccgagtgatgaggtaaacaaggatgtagggagacaggaaggagaagatgcatatatgactcatttagctgtagaggctgttgagcagcatagagtccaaagctggatctctacctgagttgtgtcttgcccatatgaataatgggattttgctatccctctaataacatgttatgcttgtgtgagaaaaa

SEQ ID NO: 1859 - DNA, 570 bp, Camellia sinensis
cgcgtgcagagagaatttgagcttagagcataaaacaagggcataatccgaagatgatcataccagtccgttgcttcacttgcgggaaggtcattggaaacaaatgggacacctatcttgatcttctccaggcggattacactgaaggggatgcccttgatgcattgggtttggttcgctattgctgtagaagaatgctcatgacacatgttgacctcattgagaagcttctgaactacaatactctggagaagtctgaaggcagttgaggaggcttgttgccatacacataacagcatatctttgtttgtatggttggtactcgtaaattttttttgtcatggtatccatgtatggagtaggatgaagtaaatggtgtcggaaaagacacttgaataatgtacaatttagttagactctttcatcattccttttttgtgctatgccttggttgcttttgtacagggcaacattccacgagttctgaataccattaagggtatatgttattcaaagctttgttgaaacactcgtactgttcattcaaaagggggttgggctttcatctac

SEQ ID NO: 1860 - DNA, 670 bp, Saccharum officinarum
caacctcctccacgaccaaacgaccaaacccttcccccctccccagctccgggctccagcggcggcggcggcggcggcggcgaagatgattatcccggtgcgctgcttcacctgcggcaaggtgattgggaacaagtgggacctttacctcgacctcctccaggccgactactcggaaggggatgctctggatgctttggaattgttccgctactgctgcaggcgaatgctcatgacccatgtcgacctcatcgagaagttgctcaactacaacacactggagaagactgagacaagttaagtgagcacgtcatgctccaaaagcactactgtttcgtagtatcatagagtgtgggttgtatgttgtatcttctcaatcgggagagatatgttgagtgtgaacttgcttttgctcatgaacattgaaggacttttcatgtgacagtgcatgttgcatctatgccacgacgttggatattttaagtgatataactgttaactgaaaactaatgtatttgtgcgaattggattcgataatattttgtttacagatgcgtgtctttggttggactacatttagtgaatgcatgcttgtacacatcttattattgtattctactgtataactctaatagacatttctggtccatatgagctattgctgtttctt

SEQ ID NO: 1861 - DNA, 433 bp, Artemisia annua
gaacgaaactagctagggcaaaacgaaaaaaagatgatcattcccgtccgttgcttcacctgcggcaaggttattggaaacaaatgggacacgtatcttgatcttcttcagtctgattacaccgaaggagatgctcttgatgcattggggcttgttcgttactgttgcagaagaatgctgatgactcatgttgatctcattgagaagcttctgaactacaacactttggagaaatctgataccaattgatgcgtcattggagaatgttagaggacaatttctcatggagagagattactttgaacaattgtagtgggtaaagtgtgttactttctaggatgattgtagaatctattggaaaccagtatcttctagtttaatactaccatgtagtaatgtagtatctagtaatggacatcttagtttcctgcac

SEQ ID NO: 1862 - DNA, 919 bp, Taraxacum officinale
aaattgtgaaagagaagccagggcaagcacaagatgatcattccggtccgttgtttcacatgcggcaaggtcatcggaaacaaatgggacacgtatcttgatctgcttcaatccgattacacggaaggagatgctctcgatgctttggggcttgtccgctactgctgcagaagaatgctgatgactcatgttgatctcatcgagaagcttctgaactataacacattggagaaatctgacaccaattgaggctttatgggagaatgttaatgaaaccttttacaagtgtacttgctaagtaaacgttgtgtttgtttctagaaactttgtagaatgttaatggaaccttaagcctaaatatatgcttatctttgtctacaagttaatcttcatggtgatcatttacacattgcatgtatgacaagtcaaattagaaattataaggtatggacaaataatgaagaaacaaagctagttgaggcattggtgaatatgacaaatggtggaggatttaaagccgataacggttttaaatcgggttatttacaacaccttgagcaagcattgaaacaatcacttcctgattcgggcattttaggaaaaccacatattgagtcgaagataaaaaccatgaagagagattggcaatgtgtctatgatatgttaaacggttcaaacacaagcgggtttggccgtgacaccgaaaagcattgtattactgctgaggaacccgtttgggaggcatacctacaggttcacaaggaagcgactagatggaaacataaatcatttccttactatgaagatctttgcattgtttttggaaaggaccgagctcaaggaaatagagctagaggtttttgtcgaaatgggacaagatgtgaacgggggaagaagaaacacaagagtcggatgatga

SEQ ID NO: 1863 - DNA, 521 bp, Unknown
  Sequence found in Organisms: Ipomoea nil, Ipomoea nil
ccgcacgccctgcgctccctagtccccctacccagagctccaaactagggcaagcaccacttgtttcttctgcaccctcgaacccgcttcttctccacggttccaaactaggccagcggcgaagatgataattccagtacgttgcttcacctgtggaaaggtaataggaaacaaatgggacgagtatctcgatcttctccaagccgattacactgaaggggatgcacttgatgctttgggtttggttcgctactgctgccgaagaatgctgatgacccatgttgatcttattgaaaagctgctgaactacaacactttggagaaagctgatggcagctgattaaaacatttttggaagtggctaatgtgcaagtcttatccttgtgtgtgggtagttgattgatatgagaacttatctaacttctgtgcatttattcaagatttctagtttgtaatataacagacaagtaacaaagtgtttttggtaatggagtaaactgacaatttgcataaaaaaaaaa

SEQ ID NO: 1864 - DNA, 503 bp, Orobanche aegyptiaca
ctgatttataatgccactggagaaaataaagaaaacaaaaatctgcgcagaacagaacagaaaccctagcgatcgaagatgatcattccagttcgttgcttcacttgtggaaaggtaattgggaacaaatgggatacttatctggacttgctacaggctgattacagcgaaggagatgcccttgatgcattgggtttggttcgttattgctgtcgaagaatgatgatgacccatgtcgatctcatcgagaagcttctgaactataacactttggagaaatctgagggcacttgatgctgtgtgaatggctccaagattgttatcttagaacacctcgattttcgagatgattgtctgtatatgttgaggagaaaatgacttatgtcatggtgaactagcagagtgtattttgaaacatgctctacctatttgatgaaagacctttgaatacatgatctcattagctatgtaattttatcccacaatttctctatattttactt

SEQ ID NO: 1865 - DNA, 800 bp, Pseudotsuga menziesii
gtttgaggggaacaatgtaaaccaaaaaacttttaaatccctcgcctttctataagtatctttacttacacttctctctcgatatatagatatcaaatttccctaccggatctcggtgcatttgttacctaactctacgaaaggcagcgatctccaggttcggtccaaggcagcgaagagtagaaaccatttgtgctttcctgcccgtgatctgtgaaaatgattatcccagttcgatgctttacctgcggaaaggtaattgggaataaatgggatacatacctcgaccttctgcaggccgactatactgaaggggatgctcttgatgcgttggggttggtgagatactgctgtaggcgtatgcttatgactcatgttgatctcattgagaagcttttgaattacaacactttagagaggagtgaagcgaattagtcaaatttctttatggctattataggagtgttctaatatttttggacttatcttcacatttatagatggttacgagaatattatgtataaatatataaatagtatattccagtacgatgttggactgctcaaggataatagatcattgttcataggacaactagacaagttaggcatgcagttaatggttattatgcgagcgttttcttaatatttttgaaactattatcacatctatggatggttttgtgaatattacagtatcagatctatgaatatataaacaacatattctaataccatgttggactgtactcaattatgataggcctattgttttatgacagttgaaagttatacaaagt

SEQ ID NO: 1866 - DNA, 406 bp, Tragopogon dubius
aggggtaaaggtaaaccaaagatgattattcctgttcgttgtttcacttgcggcaaggtcatcggaaacaaatgggacacgtatcttgatcttcttcagtccgattacactgaaggagatgcacttgatgctttgggacttgttcgttattgttgcagaagaatgctgatgactcatgttgatctcattgagaagcttctgaactacaatacattggagaaatctgatacgagttgaggccttgtgaagttggtgcaggatgttttggataaacttaagtaggattctctagtatatgctaagtaaacaaaatggattcgaatctgggatgtatgactataaactgtgatctctaatgtgggaatgttatcttggtttggtactaaaaaaaaaaaaaaaaaaagaa

SEQ ID NO: 1867 - DNA, 543 bp, Helianthus annuus
aggagttcaaagtgcaatttaggggtttaggggttagcctcataaccgggcgggctatatgaaccttaaaatcatgactccgtcaaatcaattgaacttgtgaaggcgaaactagggcaaaagatgatcattcccgttcgttgcttcacctgcggcaaggtcatcggtaacaaatgggacacgtatcttgaccttctccaatctgattacactgaaggagatgctctcgatgctttggggctggttcgttattgttgcagaagaatgttgatgactcatgttgatctcattgaaaagcttctcaactacaatacattggagaaatccgacaccaattgaagctagttgaagcttattgaggatgtttgtggatagttctctcatggatgaatgttcttcgtatgtttgctttatggatgatatcttaagttagttatttcacatgtagtatgtatttagtaagtaatgccctgaaggttgtttcaccatatgacatgtttgttcgtttctttaaattaatcacgttgcaatagtttgcatgca

SEQ ID NO: 1868 - DNA, 625 bp, Taraxacum officinale
  misc_feature (363)..(363): n is a, c, g, or t
  misc_feature (457)..(457): n is a, c, g, or t
gcggggatgacattcttcttcttcgctccttctgtcgttcatcgtctccacagcgcctctctctctctccgctcaaatctccagctattccgtttgaaggggggttttaacaggttctcgcgttttagggttttgcataatagcctgcccacactatacccaaccgcattcttcattcgtcgtctgaaatcgcagctcaaattgtgaaagagaagccagggcaagcacaagatgatcattccggtccgttgtttcacatgcggcaaggtcatcggaaacaaatgggacacgtatcttgatctgcttcaatccgattacacggaaggagatgctctcgatgctttggggcttgtccgctactgntgcagaagaatgctgatgactcatgttgatctcatcgagaagcttctgaactataacacattggagaaatctgacaccaattgaggctttatangagaatgttaatcaaaccttttacaagtgtacttgctaagtaaacgttgtgtttgtttctagaaactttgtggaatctattaaaaacaagcctctttttaaagctaaatatatgcttatctttgtctacaagtacatcttcattaaaaacaagcctctttttaaagct

SEQ ID NO: 1869 - DNA, 574 bp, Lactuca sativa
gaaatcgcagctttgaaattgtgaaaacgaaagtttagggcaaacaaaaatgatcattccggttcgttgtttcacctgcggcaaggtgattggaaacaaatgggacacgtatcttgatcttctccaatccgattacacggaaggagatgctcttgatgcattggggcttgttcgttactgttgcagaagaatgctgatgactcatgttgatctcatcgagaagcttctgaactataatacattggagaaatctgataccagttgagaggcttggctttatcagagaatgttaattgatggagtaaacaagtgtgtacttgttggtaaaaatgttggtgtttctttctagaagtattgtagaatcttattttaaactaataggctaatgaaaaagcaaatctcaattttctgcacactttctgtgttgattataactttgtgtatgtatgtctacatacatacatacatacatacatacatacatgcatccatcatatatgtatgtttgatttgtgtatgttgcttataatgaatatgaatgtgtactctgcaattcatgggtgatgccaaaaaa

SEQ ID NO: 1870 - DNA, 604 bp, Lactuca sativa
  misc_feature (423)..(423): n is a, c, g, or t
  misc_feature (435)..(435): n is a, c, g, or t
atatagtccgccaacactatattcgtctctgaaatcgcagctttgaaattgtgaaaacgaaagtttagggcaaacaaaaatgatcattccggttcgttgtttcacctgcggcaaggtgattggaaacaaatgggacacgtatcttgatcttctccaatccgattacacggaaggagatgctcttgatgcattggggcttgttcgttactgttgcagaagaatgctgatgactcatgttgatctcatcgagaagcttctgaactataatacattggagaaatctgataccagttgagaggcttggctttatcagagaatgttaattgatggagtaaacaagtgtgtacttgttggtaaaaatgttggtgtttctttctagaagtattgtagaatcttattttaaactaataggctaatgaaaangcaaatctcaantttctgcacactttctgtgttgattataactttgtgtatgtatgtctacatacatacatacatacatacatacatacatgcatccatcatatatgtatgtttgatttgtgtatgttgcttataatgaatatgaatgtgtactctgcaattcatgggtgatgccaaaaaa

SEQ ID NO: 1871 - DNA, 414 bp, Senecio madagascariensis
ccaaggttgaagcaaaaagcaagatgattattcctgttcgttgtttcacttgcggcaaggttatcggaaacaaatgggacacgtatcttgaccttcttcagtctgattacaccgaaggagacgctcttgatgctttggggcttgtgcgttactgctgcagaagaatgctgatgactcatgttgatctcattgagaagcttttgaactacaatacattggagaaatctgatacaaactaaggagcaaggccttgtgcagttgcgacaacgacgagttcatgaaaaatgttgtagttagacctacaaaaccttttccaaatatgctaccatttagtgttttgtttaactgaaattcgtattggctaagactattaaatgttttctctagtacggaaatattatctgttgaagtttg

SEQ ID NO: 1872 - DNA, 441 bp, Elaeis guineensis
  misc_feature (419)..(419): n is a, c, g, or t
ccgactccgagagataaagcggacttccggcggcggtgaaggaagatatgatcattcccgtgcgttgcttcacctgtgggaaggtgattggcaacaaatgggatacgtatctcgatcttctccaggcggattactctgagggggatgctttggatgctttgggcctggttcggtattgctgcaggcgaatgctcatgactcatgttgacctcattgagaagttactgaattacaatactcttgagaaaacagaccccaattaaggtgatagccggtggcatgtggactttcctaccatcaagagtcgaatcatgggtggcatcacatccagttttatgcctagtagagatggcccaatttgtattacatttgttacaaaagtgggtccatgagacagacatgtgagttgaagtgataantttaaaatggggtagaagagac

SEQ ID NO: 1873 - DNA, 524 bp, Beta vulgaris
  misc_feature (394)..(394): n is a, c, g, or t
  misc_feature (444)..(444): n is a, c, g, or t
gcacgaggctcgttccccgggagccgtaatatatttgagctgagaacaaaagaaacgagagataaaaaagagagagtgtacaaagagcagcgaattgagaagcaaacatgattattccagttcgttgcttcacctgcggcaaggtgatcggaaataaatgggacacttatcttgaccttcttcaagctgattacactgaaggggatgcccttgatgcattggggttggtccgctattgttgcaggagaatgctcatgacccatgtcgacttgattgagaagctcttgaactacaacactcttgacaagtctgatactagttagtgaagcttgtggaggcagcggtagaacagtattttggtgggggaacagcacttgctgaacagtattggggnaaattttggtgggttagagctatggttctatgataattgtaatgatactngatgtgacgatgaaatgttatcctgagtagtagacattgtggtctattgatttcatgaattattgaccatctactaatct

SEQ ID NO: 1874 - DNA, 659 bp, Cycas rumphii
  misc_feature (21)..(21): n is a, c, g, or t
  misc_feature (27)..(27): n is a, c, g, or t
  misc_feature (75)..(75): n is a, c, g, or t
gattatctatgatacattcanattccntaaaaggctatcatcatctcagataacatgagcttctctgcaacccantcgcgacacacagagaggccaaagtcttcggctttaacttgtggaaatgataatcccagtgcgatgcttcacctgcgggaaggtgattgggaacaagtgggatacttacctggaccttctgcaggcggactattctgaaggggatgctcttgatgcattagcactggtgcgatattgttgtaggcgtatgctcatgactcatgttgacttaattgagaagcttctcaattacaatacattggagaagagtgagacaaattagtcccaaaaatattgaaattagatttagaagtttttttgaagaaactgtttggactacatttgctatctgtgtgtatggaggtaatttaagatatttttgagattgaaatggcatgttttgattagggttgaatgtaacgtttctattttcacattttgtgttggaaaatgtctagttcgaatgatggtctaagtcaacaccatatggtttatgtgacaacttaggacattaaccttatgatggagtgtcatgttattgtttgatttcaagaaaaaaaaaaaacttaaaataaaaatgtaaaatttggttgtaagaaaaaaac

SEQ ID NO: 1875 - DNA, 481 bp, Linum usitatissimum
ccacgcgtccgagcaaaatttctagagaagatgattataccagttcgttgcttcacttgcggcaaggtgattggccacaagtgggatacttaccttgatctacttcaggctgattacactgaaggtgatgctcttgatgcactggggttggttcgttattgttgcagaagaatgctcatgacccatgtcgatctcatcgaaaagctcctaaactacaatactctggagaagagcgagggctcttaatggtaaaaaaaacttgtcctggagtcggatttaggtacataaccggtttctgtagagagctgtaatatctatcgatgaaggatgatcgccatttgcaatttgatgaactgggtatttttgttgcaatggaatgtttgtgagtgttgtaagatcggatctatactgttctggaattatcttgtgcttttagtgttgaatgaaatggaagtagcctgagtgcaaaactggttgagtc

SEQ ID NO: 1876 - DNA, 550 bp, Malus domestica
tccgtctctctcaagccctcgtggttgtcgaagactgacaaacacttggacacgcagaacagagttagggcaaatcaagatgatcatcccagtgcgctgtttcacctgcggcaaggttatcggaaacaaatgggatacgtatctcgacctgctgcaggccgattacactgaaggagacgcactagatgcattgggtctggtccgctactgctgccggcgtatgcttatgactcacgttgatcttatcgagaagcttctcaactacaatactttggagaagtctgacgccagttgaggaagctcgtgtaacaagtgccagatgctcgttttatgtgatctttgtcaagtatcttaatgtggtaaaaccttcatgttgttttgtctggatcaccatcgatccttattgccatacttagaaacttgaaatatctaatatgattatctagttgtagggagatacttatgtatgcacttgaggcatttatgttgctgcactagtttacgaacttattaaatagaatgaaagactgaatgcttctgacaaaaaaaa

SEQ ID NO: 1877 - DNA, 535 bp, Actinidia deliciosa
  misc_feature (67)..(67): n is a, c, g, or t
  misc_feature (430)..(430): n is a, c, g, or t
cagctactggttccttcgtcaatccacagcagcgtttcagagagctttgaggggacgaaactagggnaaccgaagatgatcataccagtccgttgctttacttgcggcaaggtcatcggaaacaaatgggacatgtatcttgatcttcttcaggcggactacaatgaaggagatgctcttgatgcattggggttggtgcgctattgctgcagacgaatgctcatgacacacgttgacctcattgagaagcttctgaactataacactctggagaagtccgaaggcagttgaggaggtctacggagctgagatgaacttagaagtatgttacaagatatatcaagcaacatatctggatgtttgtgtagttggtactctttttaggttttatgattcatgtatggagggggatggagcaattaatgatggntaagacacttgatgcaccagcaatttatgtgtctgctttttcaatttgttactcgaattggttgcttatgcatatgaacatattgaatgagtgttcacagtcaaa

SEQ ID NO: 1878 - DNA, 556 bp, Nicotiana benthamiana
gggggctaaaccttcaaacttggaagttcagaacgtctagggttttggcaagatgatcattccggtgcgctgtttcacctgtggcaaggtcattggaaacaaatgggatgaatatcttgatcttctccaagctgattacgccgaaggggatgctcttgatgcactgaatttggttcggtattgctgtcgtagaatgctgatgacacatgttgacctcattgagaagcttctcaattacaacacattggagaagtctgagggcacttgaaatttgcttaagtgatgagctgaagtagcaagtgtttatacctagaatgtttctcctttgtctgtttcctctttctagttggaaggaggtacttaaaatgttcccatatgggatgaagactttcgaatcttgtaactcgttaaaataacattccaagaaaccagtaaacagtattatgttgaacacaataggtatctgttcaatttttactgtgcactttccctttctcttctctaatctttcaatgtaatagaaattttatgaaaggaaaaaaactatccttttgac

SEQ ID NO: 1879 - DNA, 592 bp, Camellia sinensis
tatcggccattacggccggggacgcgtgcagagagaatttgagcttagagcataaaacaagggcataatccgaagatgatcataccagtccgttgcttcacttgcgggaaggtcattggaaacaaatgggacacctatcttgatcttctccaggcggattacactgaaggggatgcccttgatgcattgggtttggttcgctattgctgtagaggaatgctcatgacacatgttgacctcattgagaagcttctgaactacaatactctggagaagtctgaaggcagttgaggaggcttgttgccatacacataacagcatatctttgtttgtatggttggtactcgtaaattttttttgtcatggtatccatgtatggagtaggatgaagtaaatggtgtcggaaaagacacttgaataatgtacaatttagttagactctttcatcattccttttttgtgctatgccttggttgcttttgtacagggcaacattccacgagttctgaataccattaagggtatatgttattcaaagctttgttgaaacactcgtactgttcattcaaaagggggttgggctttcatctac

SEQ ID NO: 1880 - DNA, 693 bp, Physcomitrella patens
acccctgtgttctgtcgaaccgagttgcgtcgcctcccaggtcgttgtgatttcgggactcatacccgcacgaaccccacagcagtcagagcagactgtcaagatgattattcctgttcggtgcttcacctgcggcaaggtgattggaaacaaatgggatacatatctcgaccttttgcaggccgattattctgaaggagatgctctggacgccttggctcttgtccgctactgctgccggcgcatgctgatgacccatgtcgaccttatcgagaagcttctgaactacaacactttggagaggaacgagaacaccaataactgaaacccattacaatctgcgccaacatcatggaagtgtcaatggacaatggatagcatgtttaattttctggaaaactggccgaaactcttcacaggaggttttgatagggatgagaggcggctcttttcattcaggctacgaaccatggtcgtaaggatatatgataatatgaaatgtagatgtcttgcactaaatcagtcaaaagctattttgtagaatcattaaccagtcacaatgcggcattccgactatgtcaaatgtcctcaaccttaatcgccgtaaaattgctatgcaggcagtctgtattcttacgattttgaattcgactctacaccgtggatgaactcttgattcggcagttcgtaaca

SEQ ID NO: 1881 - DNA, 672 bp, Malus domestica
aattccccaaccaaaaaccctaaacctctcccgcccccgcaattaggcactctctcctccccttctctgtgtttctctttcccccgtggttgtcgaagactaagaaacattcggacacgcgaagcagagttagggtaaatcaaaatgatcatcccagtgcgctgtttcacctgcggcaaggttatcggaaacaagtgggatacgtatctagacctgctgcaggccgattacactgaaggagatgcacttgatgcattgggtctggtccgctactgttgccggcgtatgcttatgactcatgttgatcttatcgagaagcttctcaactacaatactttggagaagtctgatgccagttgaggaagctcggtgtaacaagtgccagatgcttgtttgatgtgacctttgtcaagtgtctttgtgtggtaaatgttccgtgctgttttgtctggatcatgatcgatccttattaccatacttggaaacttggaatgtctaataggattatctctatgtagggagatacttatgcatgcacttgaggcgtttatgttgccgcactagtttatgaacttattaaatagaatgaaagactgaatgcttctaacaaacaatagtgttattgttagcgttgcttgatttaaaatgattctggttttttcataaaaaaaa

SEQ ID NO: 1882 - DNA, 768 bp, Helianthus annuus
ctcatagccgggatatataaagcggcccacactatacgcaaaagcacccgtttcatcttgaatttgtgaaggcgaaaactagggcaaacatgatcattccggtccgatgcttcacctgcggcaaggttattggaaacaaatgggacacgtatcttgatcttctccagtctgattacaccgaaggagatgctcttgatgctttggggcttgtccgttattgttgcagaagaatgctgatgacgcatgttgatctcattgaaaagcttctcaactataacacattggagaagtctgacaccagctgaagcgtcattggagaacggttagcaatggagaatgattgcttagaacaagtgtactggcattttgtttcaacattgtgtttcatttctaaaagtcggtgtaaaattactggaaacaagcaaacatgttaactttatagtatgtagtaggtatcttgaacatttgtttctatgttgatgcattagcattcttctttatgtgcatacacgaaagacatacctacacatgtatctgtttttcaaagattgggtggtatgaaaaaatggttgtgctgttaccacccaattatttgcataagctttcaagggtcccttggtcatgtgacgtgtttttgtcttgataattgataccataacattgcaataatatgcatacataccagctacctgtcgatatgatatatgtgtttatgtgcgcacatgtttgtaatcaaataaaatattctccatgtttttgttcaaaaaa

SEQ ID NO: 1883 - DNA, 440 bp, Lactuca sativa
aacaaagatgattattcctgttcgttgtttcacttgcggcaaggtcattggaaacaaatgggacacgtatcttgatcttctccagtctgattacacggaaggagatgctcttgatgctttgggacttgtccgttattgttgcagaagaatgctaatgactcatgttgacctcatcgagaagcttctgaactacaacacattggagaaatctgatacgagctgaggccttttgaagaatgttttggataaacctaaattgcttccctagtatatgctaaattgtattgattaatcaaaatggattgatgtttgggttgtgttgtctactatgggaatattattttggtttgaaggatatgtaaacttgttgtcgatccatttagagaacattgttttctggtttaaatcaaaaaacatatggcgaatacagtaaacgtgtc

SEQ ID NO: 1884 - DNA, 599 bp, Fragaria vesca
aatataaatcaaaaacctcgtcaaaaccctaatctcagcgcaaccccaagaagaaagaagaagaaagatgatcatcccagtgcgttgcttcacctgcgggaaggtgattggaaacaaatgggacacttatcttgacctcctgcaagcagattacaccgaaggggatgcacttgatgccttggggttggttcgatactgctgcaggcgcatgcttatgactcatgttgatctcattgagaagcttctcaactacaatactttggagaagtcggacaacagttagaggaagcttagtatggtgtaaaaaactacgaaacaaggtgctggaagttgttgttattactttcttggttagtgtccgagtgtgtgagtacatgctttgtcttgactggagctgtattattccttagtttcatgcttggattaagtctaataggatatttcggattaatggagtatgttcctactccattttgggcttatgttataatctgtatgaccctcttaattagaatgaaagactgaatgcttgtgtgttgcgtaaaactctgtttattgcatcatagtattattgtttctatttggttgaactgcctatc

SEQ ID NO: 1885 - DNA, 483 bp, Lactuca sativa
aacaaggatgattattcctgttcgttgtttcacttgcggcaaggtcattggaaacaaatgggacacgtatcttgatcttctccagtctgattacacggaaggagatgctcttgatgctttgggacttgtccgttattgttgcagaagaatgctaatgactcatgttgatctcatcgagaagcttctgaactacaacacattggagaaatctgatacgagctgaggccttgtgaagaatgttttggataaacctaaatagcttccctaatatatgataaattgtattgattaaacaaaatggattgatgtttgggttgtgttcgtctactgtgggaatattattttggtttgatggatttgtaaacttgtatctttttacaagggttgtagatccatttgaagagcattgagttctagtttatagctgcatttatttggatgttttgaaaacactatattcaaaataaacatttgaacacttct

SEQ ID NO: 1886 - DNA, 534 bp, Rhizophora mangle
ggagtctgacaaataaccagaaaaaagagagagagaagaagaatgatcattccagttcgctgcttcacctgtggcaaggtgattgggaacaaatgggacatgtatctggaccttcttcaggcggattacatggaaggtgatgctcttgatgcactggggctggttaggtattgctgcaggcgaatgcttatgactcatgttgacctcattgagaagcttttgaattataatactttggaaaatctgataccagttgaggcagcttatgggtcacaaagggatctaaaggcagttgtcatggatgccctggcaggatattggcatgtgtgtgcatgtgttccgatgcttgtctgttttgtgacactaccaatgtcatttttatcgttatattttctatgacaaagattaccattgtggataacatctgaaaactatgtttaatgaggccatatctgtataatttagttggtgttgtggattatcttttaatatgtaaggaacctgctttgagatagatatgttttgtctaaaaaa

SEQ ID NO: 1887 - DNA, 855 bp, Gossypium hirsutum
gtgaagagaaagaggtaaggcaaaattcgaagtcgaggcgagaccaagaagtagcggagcaagatgataattccagttcgctgcttcacctgcggaaagatcattggtaacaaatgggacacttatcttgatcttctccaggccgattataccgaaggagatgctcttgatgctttgggattggttcggtactgctgaaggagaatgcttatgactcatgttgacctgattgagaagcttctgaactacggcacatgggagaacacggagaccactggaagaaacatagaaaaatactatggaatgatagactcgcgtcgagcgcctgcgggtgagtgcgggcgtgggagaaacgagagcgagtatgtaatacctaagagatgaaagagtggagaaaattatgatgtggagggggaagcgatctaatatcataaaaagaggcgcaacgtgagcaaggagggtgggagggataaggtggggtggtgagagagtgggggtgcaaggggggaggataagagactcatacaagaatataggagagaagcgtaggagcggtgtagaaaaataagaagtatagagtcataagataaagagaagcgttgtcagactttagtgtgaggctggggtggatgggacagcgacagacggagaaagtaaaaagtgcagatttagagggggcgtgacggactatgcgcgaacaagtagagtcggtcgtggtttctactgatcgccgccgggcggcggcgtcgtcaggtgtgaggggaaagtggatagtgatgtgctgtctttgttaaatttatgctagtgaaggaagaggattgggagtggggagggaggaggcgggagtatagagct

SEQ ID NO: 1888 - DNA, 1447 bp, Citrus sinensis
aaaacaactacaaatccctcatactatcagattggcctcacgaatgagtaaataagttacaatgacgaatacaaactcagttaacgatacgaccatatctaccaaggaaaacaaattcaaacaactaaaacaatctcaagcacttgaaacgcagctgccaatttaggttcattacatataacaaactatgacacacacacacccccccaaaattatccatgacttgggtaagagttaagtctttaatgcatttgatgcctaatattcctcaatactaaacataacggcaagtgctcacagagacattacaatatggaagttgacatgcagatgcaacaggcaacatgaacaaaaccaacttcaggtccatccatgggcttcctcagctggtgtcagacttatccaatgtgttgtagttaagaagcttttcaatgaggtcaacgtgagtcataagcattcgcctacagcaatagcggaccaaccccaaggcatcaagtgcgtctccttcaggataatcagcctgtagaagatcaagataggtgtcccatttgtttccgatgaccttgccgcaagtgaagcaacgaactgggattatcatcttccttgagtcttacgctcgagtcgcctctttctcccttctctcctgcgaatcgtttgtcaccctagagcaagactggtggaggcacggggttcaaattctgtccagctcaaagccagacacccgcctgacgcctctcttcccagttcacaacggctttttcgtctccgcaaactaacaacaaacaaaatcactaatgggatacgttcaggaggcacgtgagaatcacgtgaagaagaaagtcgaagaagctttacggagtaaaatgaagcaaaaggcgttaaaagagtgcgatcagtacacttccaagtatgctcaatgtgcttccggaagaacgttttcagttgtgtggaagtgtcgcgaacaagctaaagaactaaacaattgccttcaccaatacacaaatgatgctgtcctggaagaaatgaagaaagaatacatgcttcagcaggatggaaaagaggctgcaagagtctaaccactacttttcagtcgatccacagcggagcatctatgtatcttatgtctatgcatcgagtgtctgcactcgaccagtgggccagcagatgttatttctggtttcgtgcactttgccatgctgtcttcacacattttctgggttacatgttcctatttctgcttaatgaagcattttcaacagttattggggatgaagattatctactttgtgaaatttgttgaactattcttgatcttaattttgttttttccccttgtttttagaacttcagcctgtccattcagaatgtcaacatcgaccggttgaaaacaaggattattgtattagaagagtcaatgctagcaatgaaaaacatgctattatctttt

SEQ ID NO: 1889 - DNA, 465 bp, Euphorbia esula
  misc_feature (8)..(10): n is a, c, g, or t
  misc_feature (14)..(14): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (38)..(38): n is a, c, g, or t
  misc_feature (453)..(453): n is a, c, g, or t
ggcacgannncagnaanagngangagcgagcgacgcanatatgatcattccagttcgttgttttacttgtggcaaggtcattggtaacaaatgggacacctatcttgaccttcttcaagcagattactctgaaggagatgctttggatgcccttgggttggttcgttattgctgcaggagaatgctaatgactcatgtggacctcattgagaagcttttgaactacaatactctagagagaagtgaaggcagctgaaggagatgatggaattacgaggcgtatgaaggtataaactgttaggacatgtagtaagtacaatatggtgtgactttagccattggaaaaagaaaaggggattttgagatattagctaaatgtgatgtattaaattgtaagaaactgctaagatcctttttgttgatgatgtttagatctaattgaagtctggtttncctttattgttc

SEQ ID NO: 1890 - DNA, 531 bp, Triticum aestivum
  misc_feature (443)..(443): n is a, c, g, or t
  misc_feature (499)..(499): n is a, c, g, or t
  misc_feature (511)..(511): n is a, c, g, or t
gttcacaacctcctccacgaccaaacgatccgggttccagcggcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaattgctcaactacaacacactggagaagaccgagacaattaagtgagcaagcatatcatgctcctgaaagcactactgtttccgcagtatcatatatattggtaggcggtatgttgtccctcctctatcaaggagaagatgttgtcagtgtgaactgcttttgctcacgacattcaaggactgacatgcatttcatctatccacatttggngattttaatcgatataataactgctaactaatacctccttgtcccgtccaaattanaatcgtttgacntttaaatcaaaaaaaaaaaa

SEQ ID NO: 1891 - DNA, 448 bp, Ocimum basilicum
gcacgcgtttagagaaccctagctcaaccaagatgattattcctgtcgctttgcttcacctgtggaaaggttattggaaacaaatgggacagttaccttgacttcctccaggcggattacactgaaggggatgcccttgatgcattaggcttggttcgttactgctgccgaagaatgttgatgacccacgttgatctcattgagaagctcctaaactacaacactctggagaaatccgaaggcagttgatgcagcgacttcaagtgtcaaatcgagccatcttatgttaagatgttattcaaacgtgcaatcactgcactgcaaagattattccaattgtgtgtaagtatatgctgaatactttgtgaaccataatactcaacgaaaacgttgtcagatttgtccaaaatctattctacacttttgctgaaaaaaaaaaaaaaaaaaa

SEQ ID NO: 1892 - DNA, 756 bp, Cucumis melo
  misc_feature (661)..(661): n is a, c, g, or t
  misc_feature (674)..(674): n is a, c, g, or t
tcggatatcagaaaggggtttgggcaaaacctctcggaaccctagaaggcgaagttggaggcatcgtcggtcggcgacagaagagagtgaagatgatcattccagttcgttgcttcacttgcggaaaggtgattggaaacaaatgggatcattaccttgatcttctgcaggcagattattcagaaggtgatgcacttgatgctttgggtttggttcgctactgctgtaggcgaatgctcatgactcatgtcgaccttattgagaagcttcttaattacaacactctggataagtctgataccagttagccaagcgacgagttttctgatttttcacgtgcagccgtattggctttatgatggtgtttgtgttcagttatgagaaaagaaaaactaccggagggctcgagttaagctatgtcttggcattctagtttgtttaattatggattcatacggactcgagtacttaatcttctacgtgtttattagtatttaggagttgtatattagagccgtgtagcattttccataggatgcagttactcattgattttagttctctgacgtttttgtggtgtttacatccagttaagagaacaaaatttataggatcatgtagtgcaagatttgatttaagctatatcttggtgtcctggttngtttgcttattgntacatacgaacccaggtatttaatcttctatgtgttcattagtatttaggagatatatgagagttgtgtagcattaaaaaaa

SEQ ID NO: 1893 - DNA, 504 bp, Brassica napus
gaaagcacgaaagagaaaaccctaaagaagaaatcgcaagagcggcaacagttcgtgcacgatgatcatcccagttcgttgctttacttgtggaaaggtgattgggaacaaatgggacacttaccttgatcttctccaggctgattacaccgaaggggatgctcttgatgcgattgggttagttcgttactgctgcaggcggatgcttatgactcatgtcgatcttatcgaaaagcttcttaactacaacactttggagaaatctgatgccaattaaaaatgatgctataacgaataacatatgagcaagaggaatagtcaagtctttacctatgaatgaatgatgatgtttctacttggcaagttgggtctagttttagactactttttgaaccacaaataaagctcgagcttgcttgtggattcgtcctctgttgatgatctgcttttggtaatctagtctagtctactgattttatatttctaagaactcagtctacaatc

SEQ ID NO: 1894 - DNA, 382 bp, Cleome gynandra
agaggaggcaacccatacaggtctgtaagttcttcgaagatgataattccagttcgatgcttcacttgcggaaaggtgattggcaacaaatgggacacatatcttgatcttctccaggctgattactccgaaggagatgcccttgacgccctcggattagtccgctactgctgcagacggatgcttatgactcatgtggatctcattgagaagcttttgaactacaacactcttgagaaatccgacaacagctaaagggtattaataaaaactaatgccaacatttaatgttaagttttagaacttagatcaatgtctgaatcacattgttgctgaagatgttatttgtatatccaaaaccctatcacttgtgcttcttttg

SEQ ID NO: 1895 - DNA, 385 bp, Cleome spinosa
ctaagttcatcgaagatgataatcccagttcgttgctttacttgtggaaaggtgattggcaacaaatgggacacataccttgaccttctccaggctgactactccgaaggagatgcccttgatgccctcgggttagtccgctactgctgcaggcggatgcttatgacacatgttgatctcatcgagaagcttctgagctacaatactctcgagaaatctgacaacacttgaaggatatgctataaccaacaaaaccgaagacacttttgtctgaatcacattgttatcggcgattggtaatgactaggtattgacatatacacacacacacacgagttctttcatccaaaaagccgatctatgtattgatctcttcccattttgg

SEQ ID NO: 1896 - DNA, 626 bp, Solanum melongena
tttctctacagacaaatttctaagccgcagatcaattgcagtgacgacccaattgattagccacggggagaaattttgggaagcttgaaagagagttcaaattagggtttcgacgagatgatcattccagtgcgctgttttacatgcggaaaagtcattggaaacaaatgggatgaatatcttgatcttctccaagctgattactctgaaggagatgcacttgatgctctgaatttggttcgatattgctgtcgaagaatgctgatgacacatgttgacctcattgagaagcttcttaactataacacactggagaaatctgagggcagttgaggcaatttccctgaaatgcatatatctagaacatttatttttagcagtaatgtaattttatttctagtagtaaggaggtgaagtaagttgttcccatataaatgtgtgccttttcaattgtgttactagtaaacagtgcctttttgaattgttggaacttccaatcatctttgccttgttctaccaagataaaagcttgctgtgtttgcaatcttttctcctatttattcaagtaaatcatttctctgtggagagtaaaattgcttacatagtaaagtgctctttaatttgta

SEQ ID NO: 1897 - DNA, 449 bp, Guizotia abyssinica
gaccctaaaatcgaagcttcagcttgaaggcgaaactagggcaaagatgatcattccggtccgatgcttcacctgcggcaaggttatcggaaacaaatgggacacgtatctcgatctactccagtctgattacaccgagggagatgctcttgatgctttggggcttgttcgttattgttgcagaaggatgctgatgacccatgttgatctcattgaaaagcttctcaactacaatacgttggagaaatctgacaacagttgaagcttcattggataatgtaatggtgtgattactttgaacaaatgtactggcattaattttgtgttctctaaaactagtgcagaattattggaaacaagaaacttctagttccgtgtcatgtagtatctattgacctaaattttcctgtgtatctggctctatggtgatgcattagcattctgaataa

SEQ ID NO: 1898 - DNA, 654 bp, Momordica charantia
ctctcagagccctaggaaggcggttgaatagtgaggcagcgtcggaaccccgggctagggcagaaagcgaagatgatcatcccagtacgttgcttcacttgcggaaaggtgattggaaacaaatgggatcattaccttgatcttctacaggcagactattctgaaggagatgctctcgatgcactgggcttggttcgctactgctgtaggcgaatgctcatgactcatgtagaccttatcgaaaagcttcttaattacaacactttggataagtctgataccagttaggccggggacaagtttctgcttattcgtgtgcagcagtcagtatttgggttttatggtttctgggtccagttaagagaaaaagagaatgtgtaggaagattcagtgcaggactcaagttaagctgtgttgccgtcctgctttgtttacttgttgatttatacgaacccaaatatttaattgtgaagtgtttttaggtctctaccagttatatatcacaattatgtaacttttggcatgttgatgttagcaaagagaaaaagggaagtagttagttatgctgggaaagagttcccttcacttaactgacccggtggaaggctgtctgtatctgcattatctagagacctaatagtataaatatcgaat

SEQ ID NO: 1899 - DNA, 561 bp, Quercus alba
tccctctttagaaagagagaaagagtgagagggcggcagcagcagaagacagcagttaagatgataattccagttcgttgctttacctgcggcaaggtgattggaaacaaatgggacatgtatcttgaccttctccagtcagattactccgaaggagatgcacttgatggattggggttggtccgttactgctgcagacgaatgcttatgactcatgtagatctcattgagaagcttctgaattacaacactctggagaggaacgagaccacttgatgaatggggttgcttgcaagtgagccaaagttcgttttactgaatgtctagtggggcatgtttgtctttgtttgtgaatgtctatgtcttaagactctttttaacttttttatttagttggagcaagacagaagtgaagatatgcatggatgtgtttgtgacaattctgttgttgcttgtgaatttttttgatgtgtatgaatcttatccactaaattaaaatatgttaaattaaaatatgtttgttgcttgagcgataatgtttcttgtgaaatatttgtcatt

SEQ ID NO: 1900 - DNA, 505 bp, Podocarpus macrophillus
caaaatgattatcccagtgagatgcttcacctgcggcaaggtgattgggaataaatgggatcagtacctcgatcttcttcaggccgattatcttgaaggagatgctcttgatgcattggggttggtcagatactgctgcaggcgtatgctcatgactcatgttgacctcattgagaaacttctcaactacaacacattagagaggactgatgcaaattaatcaagaagcccctattggtttatcatggaagaaattttgctaatgcattttggactggttatgatccatgcatgtaattgaatactttgatataaatagcatgagttttactcaccagttgtgatcttcagatcgttaaatctattgtgcttttccaaactatgctaagtatgcttcatagtgatagttgggaagcattgtggttatagtaaactggtgggttgtacaacaccaatacatctgaatgctctaggaaatgtattagttttgtactcgtacatattt

SEQ ID NO: 1901 - DNA, 551 bp, Podocarpus macrophillus
cagctgaactctgcggtcctccggcgagcaaaatgattatcccagtgcgatgcttcacctgcggcaaggtgattgggaataaatgggatcagtacctcgatcttcttcaggccgattaccttgaaggagatgctcttgatgcactggggttggtcagatactgctgcaggcgtatgctcatgactcatgttgacctcattgagaaacttctcaactataacacattagagaggactgatgccaattaatcatgaagcccctattggtttttatgatggaggaagttttgctaatgcattttggactggttatgatccatgcatgtaaatttaatactctgatataaatagcatgagttttactcatcagttgtgatcttcagatccttaagtgtattgtgctattctaaactatgcttcatagtgatagtcgggagtcattgtggttatagtaaactagcgggttgtacaacaccaatacatctgaatgctcgaggaaatgtattagttttgtaatcatacatatttgaataataatatgtttgttttgac

SEQ ID NO: 1902 - DNA, 459 bp, Solanum tuberosum
cttcaaactagggtttcagcaagatgatcattccagtgcgctgtttcacctgcgggaaggttattggcaacaaatgggatgaatatcttgatcttcttcaagctgattatgccgaaggggatgcacttgatgcactgaatttggttcgatactgctgtcgtagaatgctgatgactcatgttgatctcattgagaagcttctcaactacaacacactggagaaatctgagggcagttgaagcaatttcctgaactaatgagcttacaaatgtttatatctagaacatttacttttagctgtaattctctttctagttgcaaggaggtgaagtaaattgttctcatatgaagggagtctcttgaatcgtgtaaccagtaaacagtgtgatactgcaagctactcttgatgttttgttggttctgaatctcctggttgcctatttaacaatatatttgttg

SEQ ID NO: 1903 - DNA, 365 bp, Salvia sclarea
ctactagaccttggctgtcactcagaagagctgaaatcgcagagggtgaatcatccgaaccctagcaaaagccccaatatgattatccccgttcgttgcttcacctgtggaaaggttattggaaacaagtgggacatgtatctcgacttgctccaggcagactacagtgaaggggatgctcttgatgcactattattggtgcggtactgctgccggaggatgttgatgacccacgttgatctgattgagaagctcctcaactataacactctggagaaatccgaaggcagctgattcaacatcttcaagcgtgtggatgatgagggaagtatatgctaagtgcttctgaaccatatagtacttat

SEQ ID NO: 1904 - DNA, 889 bp, Cucumis melo
tctcggaaccctagaaggcgaagttggaggcatcgtcggtcggcgacagaagagagtgaagatgatcattccagttcgttgcttcacttgcggaaaggtgattggaaacaaatgggatcattaccttgatcttctgcaggcagattattcagaaggtgatgcacttgatgctttgggtttggttcgctactgctgtaggcgaatgctcatgactcatgtcgaccttattgagaagcttcttaattacaacactctggataagtctgataccagttagccaagcgacgagttttctgatttttcacgtgcagccgtattggctttatgatggtgtttgtgttcagttatgagaaaagaaaaactaccggagggctcgagttaagctatgtcttggcattctagtttgtttaattatggattcatacggactcgagtacttaatcttctacgtgtttattagtatttaggagttgtatattagagccgtgtagcattttccataggatgcagttactcattgattttagttctctgacgtttttgtggtgtttacatccagttaagagaacaaaatttataggatcatgtagtgcaagatttgatttaagctatatcttggtgtcctggttggtttgcttattgatacatacgaacccaggtatttaatcttctatgtgttaattagtatttaggagatatatgagagttgtgtagcattatccatatgcagtcattctgtcagtattgacgtttttgtggtgtttgcatctagttaagagaaaacagaactatgggaatattcagttcagaacttgagttaagctatatattggtgtcccaatttgtttgcttaaaaaaaaaaactagagacacgcaacaggggataggc

SEQ ID NO: 1905 - DNA, 563 bp, Brassica napus
  misc_feature (8)..(8): n is a, c, g, or t
  misc_feature (10)..(11): n is a, c, g, or t
  misc_feature (19)..(20): n is a, c, g, or t
  misc_feature (524)..(524): n is a, c, g, or t
ttcgacgngnnccattacnnggcccggggaactaaaagcacgaaagagaaaaccctaaagaagaaatcgcaagagcggcaacagttcgtgcacgatgatcatcccagttcgttgctttacttgtggaaaggtgattgggaacaaatgggacacttaccttgatcttctccaggctgattacaccgaaggggatgctcttgatgcgattgggttagttcgttactgctgcaggcggatgcttatgactcatgtcgatcttatcgaaaagcttcttaactacaacactttggagaaatctgatgccaattaaaaatgatgctataacgaataacatatgagcaagaggaatagtcaagtctttacctatgaatgaatgatgatgtttctacttggcaagttgggtctagttttagactactttttgaaccacaaataaagctcgagcttgcttgtggattcgtcctctgttgatgatctgcttttggtaatctagtctagtctactgattttatatttctaagaantcagtctacaatcttaatcaatggtcaattgtgcgaagt

SEQ ID NO: 1906 - DNA, 458 bp, Antirrhinum majus
ggggatcgaatagggtttttgcggagaatccaaaaccctagagagcttgtgaagatgattattcctgttcgttgcttcacttgtggaaaggtgattggaaacaaatgggatacgtatctcgatttactccaagctgattacagcgaaggagatgcccttgatgcactacatttggtacgttattgctgtcgaagaatgctgatgacacatgtggacctcatcgagaagctgcttaactacaacactttggagaaatcagaaggtagctgattgtgcgtctaagtaggaactttgtggagaatgttcttcatggtgttatttccaagtagatggtgtggatctatttttccaatgaaaaagaacagtatgtaactatgaatatgatgcaaacttgttgaaacttgtcgcttttggagaaacttctgctagtagatatgcaaacgtgtatccttctctaa

SEQ ID NO: 1907 - DNA, 551 bp, Raphanus sativus
ggaactaacgcaagagcgaaagagaaaaccctaaaaaaataagaagaaatcgcaagagcggcgacacaagagccctagttcgtggcacgatgatcattccagttcgttgctttacttgtggaaaggtgattgggaacaaatgggacacataccttgatcttctccaggctgattacaccgaaggggatgctcttgatgcgattggtttagtccgttactgctgcaggcgtatgcttatgactcacgtcgatcttattgaaaagcttcttaactacaacactctcgagaaatctgatgccaattaaaagattgctattaccaataacagatgagcaagagcaatagtcaagtctttacctatgaatgatgatgtctacttttcttttgttcgggtttttaggaactttggtctagtttggattggccacaagtaaagctcgagctatcttgtagattcgtcctctgttgatgatctgcttttgataatctagtctagtctactgatactgcctttaagatcataaatacataagattttacatttctaacca

SEQ ID NO: 1908 - DNA, 828 bp, Ricinus communis
atagacgcgctgatcaaggaaacagtagcgagcgagagagatagagagaaaagaagcaccgcaaagatgataattccagttcgttgttttacatgtggcaaggtgattggcaacaaatgggacacgtatctggatcttcttcaggccgattactccgaaggagatgctcttgatgcattgggtttggtccgttattgctgcaggcgtatgctcatgactcatgttgatcttattgagaagcttttgaactacaacacactggagagaagtgagggcagctgaagcaaaccatggacatggaactacaaggcacctgaaaacaactgggagtgttagaaattttccccaaatgttaatgatttttggacttattatgcttgtaaacctatttactaattgtgatagaatggtgcgagaaactcttctaatcattttacatatgcttgttgtctaatgtgggatgtcttctttgaatagtgatgatctctgtcatgaccgcgatgatcaatcaaagacctatttccagggctagtccgttgccctgttccgcgagtgtattgttgaaatgacaaacatgaattgctagtcttagtaaagcggaaggggaacttgcccaaggtttcccctgacgatgcctgacaaccaagtcgtggaaacacatgattcttggagcgaggctccttatcaattgaaaggtcaaaatttcaatagtttttgaaggttgtcatgtttccttcctgttaaagaataggaaacgtttacaatttagcttgtcatcatcaattaaaacagtgagggttttcggctgctaataagattgatccatta

SEQ ID NO: 1909 - DNA, 533 bp, Adiantum capillus-veneris
gaggccttgtgattttatcacttgttcaagatcgtgctcccatatacccgtgcgttaagttgaaggactaccaggagtgactcgagcacaagcagccatgatcattcctgtgcgctgcttcacttgcggaaaggtgatcggaaacaaatgggacacttatctggacctccttcaggctgattacacagagggagatgcacttgatgctctgggtttagttcggtactgctgcaggaggatgctcatgactcatgtggacctcatcgagaagctcttgcaatacaatactcttgaaagaaatgaatccaatcagtaacataaaaaggggaagatgcggatgggagaagcggacattatttatttgcttcaaggtctcttgcaacacctgacttcttgttggcccaaactcaaatgttatccttagatgtacgttgatcgtgggacgatgtttagaaaacgcccaacagttccaggtgtatgtgtacaggttctatacagacaaaactttgatttagtctaattatggtcaccta

SEQ ID NO: 1910 - DNA, 493 bp, Solanum tuberosum
tgaaagttggagacttcaaactagggtttcagcaagatgatcattccagtgcgctgtttcacctgcgggaaggttattggcaacaaatgggatgaatatcttgatcttcttcaagctgattatgccgaaggggatgcacttgatgcactgaatttggttcgatactgctgtcgtagaatgctgatgactcatgttgatctcattgagaagcttctcaactacaacacactggagaaatctgagggcagttgaagcaatttcctgaactaatgagcttacaaatgtttatatctagaacatttacttttagctgtaattctctttctagttgcaaggaggtgaagtaaattgttctcatatgaagggagtctcttgaatcgtgtaaccagtaaacagtgtgatactgcaagctactcttgatgttttgttggttctgaatctcctggttgcctatttaacaatatatttgttggtgtagtggcgctcgaaagtt

SEQ ID NO: 1911 - DNA, 460 bp, Brassica rapa
  misc_feature (18)..(18): n is a, c, g, or t
  misc_feature (354)..(354): n is a, c, g, or t
gaaagcacgaaagagaanaccctaaagaagaaatcgcaagagcggcaacagttcgtgcacgatgatcatcccagttcgttgctttacttgtggaaaggtgattgggaacaaatgggacacttaccttgatcttctccaggctgattacaccgaaggggatgctcttgatgcgattgggttagttcgttactgctgcagacgcatgcttatgactcatgtcgatcttatcgaaaagcttcttaactacaacactttggagaaatctgatgccaattaaaaatgatgctataacgaataacatatgagccaagtctttacctatgaatgatgatgtttcaatattttctacttggnaagttgggtctagttttagactactttttgaaccacaaaaaaagataaacacctcaagttcaaaaacaaataggcatttcataagtaaatcgtatatttaaatttt

SEQ ID NO: 1912 - DNA, 540 bp, Juglans hindsii x Juglans regia
gaagccctacccgagtcgacgccacgccctctctagtctggaaaagaacgcagagaaagagaatcagctctagacaatcgaagatgattatcccagttcgttgttttacctgcggcaaggtgattggaaacaaatgggacacatatcttgaccttctccagtcggattactccgaaggagatgctcttgatgcgttggggttggttcgttactgctgtaggcgaatgctcatgactcatgttgacctcattgagaagcttctgaattacaatactttggagaagaacgaaaacagttgatgaatggattacaattgaccagaagttggttttacagagtgtcatgttacctttttttggtctttgtgcctgtccatgtcttccctgttttgttcagctcgatacatgggaaatatttatagaatgggttcgagtagattatgttgatttagcttccatcatgaattgtcttgacatgtgtaaggtctgaatgtagctactaaatcaaaatgtttgttatcagatgtggttatgctttcgg

SEQ ID NO: 1913 - DNA, 513 bp, Solanum lycopersicum
gggatattgctgctgaagcttgaaagttgcagacttagaactagggtttcagcaagatgatcattccagtgcgctgtttcacctgcgggaaggttattggcaacaaatgggatgaataccttgatcttctccaagctgattacgccgaaggggatgcacttgatgcactgaatttggttagatattgctgtcgtagaatgcttatgactcatgttgatctcattgagaagcttctcaactacaacacactggagaaatctgagggaagttgaagcaatttcctgaactaatgagctccaaatgtttatatctagaccatctacttcttagctgtaattctctttctagttgtaaggaggtgaagtaaattgttcccatatgaagggagtcttatgaatcgtgtaaccagtaaacagtgtgatactgcaagctactcttgatgttttgttggttctgaatctcctggtttcctatttaacaatatatatgctggtgtagtggcactctaaactt

SEQ ID NO: 1914 - DNA, 489 bp, Centaurea maculosa
  misc_feature (203)..(203): n is a, c, g, or t
  misc_feature (467)..(467): n is a, c, g, or t
ttggcggggaaggaaagtgaagatgatcattcctgttcggtgttttacttgcggcaaggttattggaaacaaatgggacacatatctcgatcttcttcagtctgattacaccgaaggagatgctcttgacgctttgggacttgttcgttattgttgccgaagaatgctgatgactcatgttgatctcatcgagaagcttctgnactacaatacattggagaaatccgatacgagttgagtccttctaaagcttggacaagttcatggagaatgttgttgataaaccaacctaaatcccttttcgcaaattatgtgatcttgtggtgttattaaagaaaatgggatttgctttattttatattatgctaattattttggggatgattacttgattgaaacattgtttgcccttgtatgttgtatccttcttttaccaggatttgaaacataattataaattattccancaaagagaaaactctttgaaat

SEQ ID NO: 1915 - DNA, 521 bp, Solanum tuberosum
tgaagcttgaaagttggagacttcaaactagggtttcagcaagatgatcattccagtgcgctgtttcacctgcgggaaggttattggcaacaaatgggatgaatatcttgatcttcttcaagctgattacgccgaaggggatgcacttgatgcactgaatttggttcgatattgctgtcgtagaatgctgatgactcatgttgacctcattgagaagcttctcaactacaacacactggagaaatccgagggcagttgaagcaatttcctgaactaatgaactacaaatgtttatatctataacatttatttttagctgtaattctctttctagttgtaaggaggtgaagtaaattgttcccatatgaaggggagtcttttgaatcgtgtaaccagtaaacggtgtgatactgcaagctactcttgatgttttgttggttctgaatctcctggttgcctatttaacaagatatttgttgttggtgtagtggcgctcgaaagttaaaagttgaaccttctac

SEQ ID NO: 1916 - DNA, 509 bp, Juglans hindsii x Juglans regia
  misc_feature (367)..(367): n is a, c, g, or t
gggggagagaaaaaagtgataacggagagagaacagtgactgcgtagcaaccctaggcaatcgaagatgatcatcccagttcgttgctttacctgcggaaaggtgattggtaacaaatgggacacatatcttgaccttctccagtcggattactccgaaggagatgccctcgatgccttggggttggtccgttattgctgtaggcgaatgctgatgactcatgttgacctcattgagaagcttctgaattacaatactttggagaagaacgaaaacagttgatgaatggtttattacttacaagtgaggagttggttctacacaatgtcctgtaaaatttttatctgactctgttatgtctgtccancctgttttgttctgccagatacaggcagagaattatggaatgtgttcgagtagactgttgtttatatagcttgcatcatgaattgtcttagatatgtttaagttatgaacctaccttctaaatgaaaaattatgtttgccac

SEQ ID NO: 1917 - DNA, 549 bp, Zamia vazquezii
  misc_feature (153)..(153): n is a, c, g, or t
  misc_feature (242)..(242): n is a, c, g, or t
  misc_feature (312)..(312): n is a, c, g, or t
  misc_feature (321)..(321): n is a, c, g, or t
ataggcgaggcgcgaacggtgggcgtgtggcgtctgtattgtttggcggtgggtctctgtgaaaatgatcatccctgtccgatgcttcacctgcggaaaggtgattgggaacaaatgggatacttacctggaccttctccaagcggactattntgaaggggatgctcttgatgcattggggttggtgagatactgttgcaggcgcatgctcatgacccatgttgacctgattgagaagcttnttaattacaatacattggaaaagagtgacacaaattagttgggaggatgtagtgtattttgcagaatttntgggagggntactgatagctctctcaacggaggccatctaggatatcactgacatgttttgatacgttaaggtgatattaaacatcatgatacataatccagtgccaccgagactactggtttatgatgcaaacttaaatgaggtgcttggatgttggacttatgtaagagagtatgcttgaagctgctgtaaatatgtaaatctaaatataaaatctcttttgttttgaaaaaaaa

SEQ ID NO: 1918 - DNA, 610 bp, Medicago truncatula
atttcaagccaaacgctaaatatttgaaaggtttctactgttgtgcggcgtgagcagagaggaagatgattatcccagttcgttgtttcacctgcggaaaggtcattggaaacaaatgggattcttaccttgactttcttcaagctgattacactgaaggagatgcactggatgctttggggttggtccgatattgctgcaggcgtatgcttatgacccatgttgaccttatcgagaagctactgaattacaatactatggaaaagcatgaagccaattaaggagtcttaaggaactgcagacgaccgaaatgtgtcagttgcgtgctagtcctgtggccacatgtcaatttttttttttttggggtccttttcctttaaattgttctagcaagcagttttagctgtgttttggtgttaatgtatgctatgatagacaaaactgtagaatgacaggtttttataaaaacgggattatttgtgaaatgtcagaatttatactaatgcttaggaatattgataccttgcatactctgcatgttatgttttaacatgcatataatgtgtgtagtgataactaagggataatcaaatcattttggcctctggtt

SEQ ID NO: 1919 - DNA, 559 bp, Quercus alba
tccctctttagaaagagagagagagagagagggcggcagcagcagaagacagcagctaaggcaagcacgaagatgataattccagttcgttgctttacctgcggcaaggtgattggaaacaaatgggacatgtatcttgaccttctccagtcagattactccgaaggagatgcacttgatggattggggttggtccgttactgctgcagacgaatgcttatgactcatgtagatctcattgagaagcttctgaattacaacactctggagaggaacgagaccacttgatgaatggggttgcttgcaagtgagccaaagttcgttttactgaatgtctagtggggcatgtttgtctttgtttgtgaatgtctatgtcttaagactctttttaacttttttatttagttggagcaagacagaagtgaagatatgcatggatgtgtttgtgacaattctgttgttgcttgtgaatttttttgatgtgtatgaatcttatccactaaattaaaatatgtttgttgcttgagcaataatgtttcttgtgaaataatttgtcatt

SEQ ID NO: 1920 - DNA, 506 bp, Quercus alba
agagacagagagggcggcagcagtagaagacagcagctaaggcaagcgcgaagatgataattccagttcgttgctttacctgcggcaaggtgattggaaacaaatgggacatgtatcttgaccttctccagtcagattactctgaaggagatgctcttgatggattggggttggtccgttactgctgcagacgaatgcttatgactcatgtagatctcattgagaagcttctgaattacaacactctggagaggaacgagaccacttgatgaatggggttgcttgcaagtgagccaaagttcgttttactgaatgtctagtggggcatgtttgtctttgtttgtgaatgtctatgtcttaagactctttttaacttttttatttagttggagcaagacagaagtgaagatatgcatggatgtgttttgtgacaatccggtggtggctggtgaattttttggatgtgtatgaatcttatccactaaattaaatatgtttgttggctt

SEQ ID NO: 1921 - DNA, 587 bp, Glycyrrhiza uralensis
gggagagcagagagaagagggagagacagggcagaggaagatgattatccccgttcgttgcttcacctgtggaaaggtcattggaaacaaatgggacacctatctagaccttctgcaggcagattacactgaaggagatgcactggatgctctggggctggttcgatattgttgtaggcgcatgctcatgacccatgttgacctcattgagaaactactgaattacaacactctggacaagtctgaccccaactaaggatgcttaaggaactacagatgaccaagatgtgtcagttgcactgcatgtcccgtggccatatggcaatggttttgttttgtccttttccttaggtttagtttgtattctgggtcaattgtggttgttgtacgttgttgagagaggctatgttaaggggcagcttgtgttaattacattttgaattttagtctgtgtgatgcaaagctgtgtcttggtgttaatgtatcaacgtatcatacactgattactgatatgaaagaccaaactgtagaaggctgtaacgggtttttatacaaatcggattattatgaatgtcagtattgataca

SEQ ID NO: 1922 - DNA, 550 bp, Medicago truncatula
ccgacacaatataaagttgtcattaaattgttgtagcaaacaaactcttgaggaaggttctagcagcgtcttgagaagaagaagaagatgattattcccgttcgatgtttcacttgtggaaaggtcattggaaacaaatgggactcttacctggactttcttcaagcagattacactgaaggagatgcactggatgcgttgggtctggttcggtattgttgcaggcgcatgcttatgacccatgttgatctcattgagaaactattgaactataacactatggagaaggctgaagccagttaggaactactgattaccaagagatgtctgttacttgcatgtccctgtcctttaaactgttttccaagcagttatagctagtaaagttaggaagtatttgtggttattaggaggcaactgtaagatgcagcttatgttaagtactttttaaactttagtaatgtgtgatgcaaagctgtgtgttattgactgatatgtaagactaaattgtagaaaactgacagctttttatgaaaatgggattattatg

SEQ ID NO: 1923 - DNA, 739 bp, Cucumis sativus
aggggtttgggcaaaacctctcggaaccctagaacgtgaagtcggaggcatcgtcggtcggcaacagaggagagtgaagatgatcattccagttcgttgcttcacttgcggaaaggtgattggaaacaaatgggatcattaccttgatcttctgcaggcagattattcagaaggtgatgcacttgatgctttgggtttggttcgctactgctgtaggcgaatgctcatgactcatgttgaccttattgagaagcttcttaattacaacactctggataagtctgataccagttagccaagggacgagttttctgatttttcacgtgtaggcgtattggctttctgatggtgtttgtgttcagttaagagtaaagaaaaactaccggagggctcgagttaagctatgtcttggcattctagtttgtttagttatggattcatacggactcaagtacttgatcttctacgtgtttgttagtatttaggagttgtatattagagccgtgtagcattttccatagatgcagttgattttcattcaggcagcattgacgtttttgtggtgtttggatccagttaagagaaaacaaaatttatacgatcatgtagtgcaggatttgatttaagctatatcttagtgtcctggtttatttacttattgattcatacgaacccaagtatttaatcttctatgtgtttattaggatttaggagttatatgtaagagccgtgtagcatt

SEQ ID NO: 1924 - DNA, 511 bp, Solanum phureja
ggacatagctgctgaagcttgaaagttggagacttcaaactagggtttcagcaagatgatcattccagtgcgctgtttcacctgcgggaaggttattggcaacaaatgggatgaatatcttgatcttcttcaagctgattatgccgaaggggatgcacttgatgcactgaatttggttcgatactgctgtcgtagaatgctgatgactcatgttgacctcattgagaagcttctcaactacaacacactggagaaatctgagggcagttgaagcaatttcctgaactaatgagcttacaatgtttatatctagaacatttacttttagctgtaattctctttctagttgcaaggaggtgaagtaaattgttctcatatgaagggagtctcttgaatcgtgtaaccagtaaacagtgtgatactgcaagctactcttgatgttttgttggttctgaatctcctggttgcctatttaacaatatatttgttggtgtagtggcgctcgaaagtt

SEQ ID NO: 1925 - DNA, 289 bp, Nicotiana tabacum
ggggacgtagctgctaaaccttctaacttcgaagttcataccttcaactagggttttggcaagatgatcattccggtgcgttgtttcacttgcggcaaggtcattggaaacaaatgggatgaatatcttgatcttctccaagctgattattccgaaggggatgctcttgatgcactgaatttggttcgatattgctgtcgtataatgctgatgacacacgttgacctcattgagaagcttctcaactacaacacattggagaaatctgagggcacttgaagtttcctga

SEQ ID NO: 1926 - DNA, 730 bp, Carica papaya
ccctctccaattacttcagctttcgtctctttccggaatctttgagcggcttcctctgccattctccatcgtccatctcagactcactgcccggattccgaggagcacggaaaattgctcctgtcgcggttccgcttttcagtcttggcgcactgaaccgtaatccaggcgccgcacgagctgtgcgaaaccaacacttaggagctacaaggggaaagagttccataacaggaaaagacccgagagaggaagaggaagagtgaccagagtccggaaaaagcaaagatgatcattccagttcgttgctttacctgcggcaaggtaattggtaacaagtgggatacttatcttgaccttctccaggctgactacagcgaaggagatgcgcttgatgcactgggattggtccgctattgctgtaggcgaatgctcatgactcatgtggatctcattgagaagcttctgaactacaacaccttggagaagtcggataatgcttaaggaagcctgtggaattatctggggttagttctcatggcatactttattccagtcatgctggtgtggatccttgtctatgattactaagttttgtttggccgagatcattttagtttgcaacttagaatttgaattgcaaaaaagaccagaaattaatgttgaactctgtagtttttattagtgttggagcataggaaataatataactagccaaattttaagatgttgc

SEQ ID NO: 1927 - DNA, 572 bp, Mimulus guttatus
gggagagaaagagagagagaggtttttctgcagaacataaaccctagctagtgaagatgattatcccagtccgctgcttcacttgtggaaaggtcattggaaacaaatgggattcgtaccttgatcttctccaagctgattacagcgaaggagatgcccttgatgcactgcttttggttcgctactgctgccgaagaatgctgatgacccacgttgatctcattgagaagcttctcaactataacactttggagaagtccgagggcagctgatgcagtatgggatcgatcgatatatccaagtctatgatcgtcttaaatctcgattacgagatagttgtttgtaaatgtcctagttaaagatgattctggctgtgtgctgtttaagaccatataaccatctctcagaaagacttgtcgtctgaatatatatgattaggcaatctgttatcttttagtgtattacttgcgtttgtttttaccgttgggtcggaatttcaacctcgataaacgtgtcattttttccccaagttttcttcttggtttggttttagttatttgtgctaagggaaa

SEQ ID NO: 1928 - DNA, 572 bp, Mimulus guttatus
gagagagaaagagagagagaggtttttctgcagaacataaaccctagctagtgaagatgattatcccagtccgctgcttcacttgtggaaaggtcattggaaacaaatgggattcgtaccttgatcttctccaagctgattacagcgaaggagatgcccttgatgcactgcttttggttcgctactgctgccgaagaatgctgatgacccacgttgatctcattgagaagcttctcaactataacactttggagaagtccgagggcagctgatgcagtatgggatcgatcgatatatccaagtctatgatcgtcttaaatctcgattacgagatagttgtttgtaaatgtcctagttaaagatgattctggctgtgtgctgtttaagaccatataaccatctctcagaaagacttgtcgtctgaatatatatgattaggcaatctgttatcttttagtgtattacttgcgtttgtttttaccgttgggtcggaatttcaacctcgataaacgtgtcattttttccccaagttttcttcttggtttggttttagttatttgtgctaagggaaa

SEQ ID NO: 1929 - DNA, 476 bp, Capsicum annuum
ggcacgagctagactccaaaacaaattagggttttgtcaacatgatcattccagtgcgctgtttcacctgcggcaaggttattggcaacaagtgggatgagtatctggatcttcttcaagctgattactccgaaggggatgcacttgatgcactgaatttggttcgatattgctgtcgcagaatgctgatgacgcacgttgacctcattgagaagcttctcaactacaacacactggagaaatccgagggcagttgaagcaaatttcctgaagcaatatcaattgtttatatttagaaccttaatttgtaggtgtagttctccatctagttgtaaggaggtggtaaattgtcccagttgaagtgatgacgttttgaatcgggcaactttaaacagtttgaatgtgtgatactactcttgattacaatgtatttgcttgtttaatgatattcataactttaaagtttggaccttcta

SEQ ID NO: 1930 - DNA, 401 bp, Zinnia violacea
ttattcatgttgtaaccatagggttttaaatttctccgggtatataaagccgctaacactccactaatcgcaaacgcacccataaaatcgcagcttgaggctgtaacagtgaaagtagggcaaacatgatcattccggtccgatgcttcacctgcggcaaggttattggaaacaaatgggacacgtatcttgatcttctccagtctgattacaccgaaggagacgctcttgatgctttggggcttgtccgttattgttgcagaagaatgctgatgactcatgttgatctcattgaaaagcttctcaactacaacactttggagaaatctgacaacagttgaagcttcatcggaggatgttactatgctagtaatgggggattgataacttggaacaagtgt

SEQ ID NO: 1931 - DNA, 471 bp, Bruguiera gymnorhiza
cagagagagagaagaagaagtgcagagccaatctgtgttagaggtgcaaccagaatgatcattccagttcgttgcttcacctgtggcaaagtgattgggaacaaatgggacatgtatctggaccttcttcaggcggattacatcgaaggtgatgctcttgatgcactgggattggtccggtattgctgcaggcgaatgcttatgactcatgttgacctcatcgagaagcttttgaattataacactttggataaatctgataccagttgaggcagctgatgggtcataaagggatctaaaggcagttgtcatggatgcttagcaggatattggcatgtgcgtgcacgtgctccaatgcttgtctgttttgtggtactaccattgtcatttttatcattgtctggactatgatgaagactgccattgtggataacttctgaaaattatgtttaacgaggccatatccgtatg

SEQ ID NO: 1932 - DNA, 264 bp, Castanea mollissima
cagcagcagaagaagacagcagctaaggcaagcgcgaagatgataattccagttcgttgctttacctgcggcaaggtgattggaaacaaatgggacatgtatcttgaccttctccagtcagattactccgaaggagatgcacttgatggattggggttggtccgttactgctgcagacgaatgcttatgactcatgtagatctcattgagaagcttctaaattacaacactctggagaggaacgagaccacttgatgaatgggg

SEQ ID NO: 1933 - DNA, 555 bp, Manihot esculenta
ctgctgaccgacctagaaatcttccaagaacgcgcggggagagcagaagcaggggggcaaccaaaaatgataattccagttcgttgtttcacttgcggcaaggtgattggaaacaaatgggatacttatcttgatctccttcaagctgattactctgaaggagatgctcttgatgcattggggttggtccgctattgctgcaggcgaatgctcatgacacatgttgacctcattgagaagcttttgaactacaatactctggagagaagtgagggcagttgaaggaggctgtggtcctgtgtattctgaaactagctgccaaagatgtgtgtggttactatggtggaagtatagacaatgggaaaaaaaatttgggaatgttcaaatattaatcattgtcgtttttctcctgtttgaaagacctatacattattgtgatgctaacattgtgagaattgagaaatcgttcaaatcgttttgtgtgttacttgtttgatgcttttgtaaatcttctttaaaatagtgatgatctctcatgatcaagatgatcctgcc

SEQ ID NO: 1934 - DNA, 501 bp, Solanum tuberosum
cttcaaactagggtttcagcaagatgatcattccagtgcgctgtttcacctgcgggaaggttattggcaacaaatgggatgaatatcttgatcttcttcaagctgattacgccgaaggggatgcacttgatgcactgaatttggttcgatattgctgtcgtagaatgctgatgactcatgttgacctcattgagaagcttctcaactacaacacactggagaaatccgagggcagttgaagcaatttcctgaactaatgaactacaaatgtttatatctataacatttatttttagctgtaattctctttctagttgtaaggaggtgaagtaaattgttcccatatgaaggggagtcttttgaatcgtgtaaccagtaaacggtgtgatactgcaagctactcttgatgttttgttggttctgaatctcctggttgcctatttaacaagatatttgttgttggtgtagtggcgctcgaaagttaaaagttgaaccttctac

SEQ ID NO: 1935 - DNA, 776 bp, Helianthus annuus
  misc_feature (19)..(19): n is a, c, g, or t
  misc_feature (297)..(297): n is a, c, g, or t
  misc_feature (549)..(549): n is a, c, g, or t
  misc_feature (615)..(616): n is a, c, g, or t
  misc_feature (643)..(643): n is a, c, g, or t
  misc_feature (653)..(653): n is a, c, g, or t
  misc_feature (675)..(675): n is a, c, g, or t
  misc_feature (691)..(691): n is a, c, g, or t
gcggggatgccgggattanagcgaagcggcccacactatacgcaaaagcacccgtttcatcttgaatttgtgaaggcgaaaactagggcaaacatgatcattccggtccgatgcttcacctgcggcaaggttattggaaacaaatgggacacgtatcttgatcttctccagtctgattacaccgaaggagatgctcttgatgctttggggcttgtccgttattgttgcagaagaatgctgatgacgcatgttgatctcattgaaaagcttctcaactataacacattggagaagtcngacaccagctgaagcgtcattggagaacggttagcaatggagaatgattgcttagaacaagtgtactggcattttgtttcaacattgtgtttcatttctaaaagtcggtgtaaaattattggaaacaagcaaacatcttaactttatagtatgtagtaggtatcttgaacatttgtttctatgttgatgcattagcattctgacttatgctttatgtgcatacacgaaagacatacctacacatgtatctgnttttcaaagattgggtggtatgaaaaaatggttgtgttaccacccaattatttgcataagctttcnngggtcccttagtcatgtgacatgtttntgtcttgatnattgataccataacattgcaanaatatgcatacatacnagctacctgtcgatatgatatatgtgtttatgtgcgcacatgtttgtaatcaaataaaatattctccatgtttttgttcaaaaaa

SEQ ID NO: 1936 - DNA, 565 bp, Acacia harpophylla
ggtggcaaagaactgagtctgagacaacgaattgagccactgagtattgagaaagatgatcattcccgttcgttgtttcacctgcggaaaggtgattggaaacaagtgggatacgtatctagatcttctgcaggctgactacagtgaaggagatgcactagatgctttgggtttggtccgttattgctgtagacgcatgctgatgacccatgttgacctcattgagaagcttctgaactacaatgctctggacaagtctgagcccagctaagacaacttaggaatcacagatgactcagagatcagttttgctcctttcctccgatcacgtgtccaatgcgtttgccttcttttacttgatcaaattgtctatcgtcaaacatgtctagtctctatttgagtcaattgagctgtgtgcagttttaaaaggagaatatgatatgaatatgatgtagcttatgttaaatacttggcccccgaaggcctaaactgtgtttgaagtgtgatgtgaaactccaactgtgatatcattagatcatattatgacttgaaagactaaatttac

SEQ ID NO: 1937 - DNA, 585 bp, Brassica juncea
tcgtgaagccgtctcttgtgttcttcttccttcgcctgttaaaggaaagcgtgaagtaaaaccgttaaccctaaaactcccaagcgagacgaagtttagaggtttcagtgctttgctcaagatgatcatccctgttcgctgctttacctgtggaaaggtgattggaaacaagtgggatgcgtatcttgatcttctccagctcgactacactgaaggggacgcacttgatgcgctcaacttagttaggtactgctgcaggcgtatgctcatgactcatgttgatctgattgagaagcttctcaactacaacactctggaaaaatcagacaacagttaagaggaggatgcaaatctgctgaaagaggattcaaaacttaatatgtatgaaaactctctgtgttttggtgtagaaacttgaatcaatctgaatattatggggttttggaagacgctagtgattttgtcatatgtatgtcggtgactctctgtgtgattcagtgttttcctttggagcaattaatctttcagtactctcatagtttcatgatttttccatcaaacacaaaatgaagcatatggttgtac

SEQ ID NO: 1938 - DNA, 418 bp, Brassica napus
tcaagatgatcatccctgttcgctgctttacctgtggaaaggtgattggaaacaagtgggatgcctatcttgatcttctccagctcgactacactgaaggggacgcacttgatgcgctcaacttagttaggtactgctgcaggcgtatgctcatgactcatgttgatctgattgagaagcttctcaactacaacactctggaaaaatcagacaactcttaagaaaagggttaaggaggatgcaaatgttctgaaagagtctctcgtcagagacctatatattaaaaacatgtatgaaactctctgtgtactgtttggtgtagaaacttcaatcaatctgagtcatgttggttttagaccgacgttaacattttgtcatatgtatgtcagtgcctctactatgtgttatgaatgtttct

SEQ ID NO: 1939 - DNA, 830 bp, Sequoia sempervirens
gcgagtaaaacccttcaaagaaaagttcagcttttcgtgaccatgattatccctgtgcgatgtttcacctgtggaaaggtgattgggaacaaatgggatcagtacctcgatcttcttcaggccgattatcccgaaggggatgcccttgatgctctgggattggtgaggtactgctgcaggcgcatgcttatgactcatgttgacctcattgagaaacttctaaattacaatacattagagagaagtgatgcaaattagtcacgaagcgattgatggttgaagatgtatgctattttgtttgatgaacttggaactggttgtgatagacacaaatgaaacctaaaatattatgtatattttatgagtttggctagttcatgctgtacttcaggttcttgatacatattctagcataatgtgtgaccaatgctccataataactattggttcttatgcttttggaagaatggtggtttacacttgtgtatttgaatgcttcatatatgtatcacatttgaccatataaagcctataatgtcagaatagctacattttaaactttccacctcttagtttatgaccatttgaagcctgtgtttttggttcccttgctgtatgcttggctgtcttgccatttggctttcaacaattaggttgggagttccttagaaatatggtgtaatcctttgtgatcttcggtgtctgttgaggattctgttctggaggatcacctcctaatgtctatatgtatgtggtagattaaaaagcttggcatgcattttgggtgtatatgtttgctagttgatctcaaaccaaggtgttttcgtaaa

SEQ ID NO: 1940 - DNA, 595 bp, Taxus baccata
aatgtgctggagcctgggaggtgaaaggaaggaaggaaagaaaggtgtgtggtatttttactgtgtagccatgattatccccgtgcgatgcttcacctgtggaaaggtgattgggaacaaatgggatcaatacctcgatcttcttcaggctgattatcctgaaggggatgctcttgatgcactggggttggtgaggtattgctgcaggcgtatgctcatgactcatgtcgacctcatcgagaagcttctgaattacaacacattagagaggagtgatgcaaattagtcatgaaagtggatgcatttttgctaatgatctttgaactggttatgatacttatgaatgaaagttaaaatatataatgtatatagcatgtgtttgactcagccctgaacttgaggctcccgataaatattctagcatgacgtgtgaaactatgctccataacgactattagttcttgtgctaatggcagaatgttgggctttcctgtgtatttcaatgctttataaatttgtcacttttaaccatataaagcataatgttagaatagctgtcttttgaactttctacgtcttttgaccatataaagcc

SEQ ID NO: 1941 - DNA, 606 bp, Taxus baccata
ggcccttatagggttttcgcggggtttctgctctaccttttgcagggctgaaattgaaagcattgtgtaatacgctagagagtattgggtaaaggtgttcagagaggtgaaaagaagcaaggaaagaaagacctgtaacattttactctgcagccatgattatccctgtgcgatgcttcacctgtgggaaggtgattgggaacaaatgggatcaatatcttgaccttcttcaggctgattatcccgaaggggatgctctcgatgcactggggttggtgaggtactgctgcaggcgtatgctcatgactcatgttgatctcattgagaagcttctgaattacaacacattagaaaggagtgatgcaaattagtcatgaagtgcttaatggtccaagatggatgcattttgctaatgatatttgaaccggttatcatacctatggttggaatttaaaacattattttatggcatgagtttgattctgcgttgaactccaggttcctgaaatgtacatattctagcatgatgtgtgaaactacgcactataatgattattgattgtgctaattgaagaatgctgggttacgtattttaatgctttcatc

SEQ ID NO: 1942 - DNA, 633 bp, Cryptomeria japonica
gaaatgctataatttgactggaagaactcagaaattgcctaaattttcccgagtccattggtctgcttgtgaaaccctagagagaaaaagctcagctcttggtaaccatgattatccctgtgcgatgtttcacttgtggaaaggtgattgggaacaaatgggatcagtacctcgatcttcttcaggctgattatcctgaaggggatgctcttgatgctctgggattggtgaggtactgctgcagacgcatgcttatgactcatgttgatctcattgagaaacttctaaattacaacactttagagagaagtgatgcaaattagtcatgaagcgattgatggtctaagatgtatgcaattttgttttgatgatcttggaactggttatgatagacaaaaatgaaatctataatattatgtatatattatcagtttggctagttcgtgctgaacctcaggttcttgataccttttctagaacaatgtgtaacccatgctccatgataactgttggttcttgtgcttttggcagaatgttggtttacgcttgtgcatttgaatgctttgtatatgtatcatgtttgatcatataaagcctataatgtcaaaatagctagatttaaaactttccaaa

SEQ ID NO: 1943 - DNA, 562 bp, Arabidopsis thaliana
aaccccagttataagctcaaagttgtacttgacctttttaaagaagcacgaaacgaaaaaccctaaaattcccaagcagagaaagagagacagagcaagtacagatttcaactagctcaagatgatcatccctgttcgttgctttacttgtggaaaggtgattggaaacaaatgggatcagtatcttgatcttctccagctcgactacactgaaggggacgcacttgatgcactccagctagtcagatactgctgcaggcgtatgctaatgactcatgttgatctgattgagaagcttctcaactacaacactctggagaaatcagacaacagttagaagaggatgcaaatctgctgaaaaagttttcctctttagaggcttaaatattagtatgtatgaaaacatttggtgtatgtggtgtagacccttcaactccatctaaaattatatatgtgtgtcagttactttctcgtgtgattcaatctcatgatttcctgaccttgaagatttctcctttggattcatgtttcattagtattattgaggtgattttcatggcca

SEQ ID NO: 1944 - DNA, 481 bp, Zea mays
caaatcgagaagagaggcagacccaacacaagtctacagattcacacagttcttagctcgagaagatgattatccctgtacggtgctttacatgcggaaaggtgattggaaacaagtgggatgcgtatcttgatcttctccagcttgactacactgaaggggacgcacttgatgcactcaacttagttagatactgctgcaggcgtatgctaatgacgcatgttgatctgattgagaagcttctcaactacaacactttggaaaaatcagacaacagttaagaggaggatgcaaatctgctgaaagaggattcaaaacttaatatgtatgaaaactctctgtgttttggtgtagaaacttgaatcaatctgaatattatggggttttggaagacgctagtgattttgtcatatgtatgtcggtgactggctgtgtgattcagtgttttcctttggagcaattaatcaacgggtactctcat

SEQ ID NO: 1945 - DNA, 498 bp, Brassica oleracea
ggagaaagagagagaggcagacccaagtctacagattcacgcagttcttagctcgagaagatgattatccctgtacgatgctttacatgcggaaaggtgattggaaacaagtgggatgcgtatcttgatcttctccagctagactacactgaaggggacgcacttgatgcgctcaacttagttagatactgctgcaggcgtatgctaatgacgcatgttgatctgattgagaagcttctcaactacaacactttggaaaaatcagacaacagttagaggaggatgcaaatctgctgaaagaggattcaaccttaaaatatgtatgaaaactctgtgtttggtgtagaaacttgaatcgatctgaatattatggggtttttgaagacgctggtgttttgtcatatgtatgtcagtgactccgtgtgattcagtgttataattttatgagctgaacgaattgttttccttttgagtaattaatctttcagtagattcatg

SEQ ID NO: 1946 - DNA, 546 bp, Arabidopsis lyrata
agctcaaagttgttcttcacctttttaaagaagcacgaaacaataaaccctaaaatcgctagcagagagagagaccaagtacagattttagtttgctcaagatgatcatccctgttcgttgcttcacttgtggaaaggtgattggaaacaaatgggatcagtatcttgatcttctccagctcgactacactgaaggggatgcacttgatgcgctccagctagtcagatactgctgcaggcgtatgctcatgactcatgttgatctgattgagaagcttctcaactacaacactctggagaaatcagacaacagttagaagaggatgcaaatctgctgaaagtgttttcctctttagaggcttatatattagtatgtatggaaacatttggtgtatgtggtgcagaacctttaaattccatctaaaatcatatatgtatgtcagttactttctcgtgtgcttcaatctcatgattttctgacgttaaagatttgcccttttgagaaattcatgttccttagtattattgaggtgattttcatggcca

SEQ ID NO: 1947 - DNA, 612 bp, Lotus japonicus
gggtaccaaaaaaaaagcgccaagttctctgtgagcagcgaagagaacgcgccagagcagaggaagatgattatccccgtccgttgtttcacctgtggaaaggtcattggaaacaaatgggatccatatttggatcttctgcagtcagattacagtgaaggagatgcactggatgctttggggctagttcgatactgttgtaggcgcatgcttatgacccacgttgacctcattgagaagctgctgaattacaacactctggacaagtctgataccagttaagaacactcaagttgcattgcatgcctctgttcatgtgtcaactgtgggtctagtttgtatgctgtcagttttgtttattatccattattgagagtggctatgaatgatatggtgcagctcatgttaatttcttatttgactttagatagtgtgatgcaaagctgttctttggtactgatgtattaactatacactattatgaaagactaaattgtaaaagactgattggtatgaacaaaatctaaagcccacagggctacaaaaacccactcagactgaacgcctagaaagccctgtgggttaaaactagcacatgggctttatattttt

SEQ ID NO: 1948 - DNA, 526 bp, Brachypodium distachyon
agcaaaatcgttttgcaacgttgtttttcttctcactctgccttcccccgaaaacttttcttcccccttattgtccggcagcggcggtagacgcgcaacatcgaagatgatcatcccggtccactacttcacctgcggcaaggtgattggcaacaagtgggaccactaccttgatcttctacaggctgattacacagagggggctgctctagacaccttgggcttggtccgctactgctgccggcgtatgctcatgacccatgttgacctcatcgagaagttgctcaactacaacacgctggagaagaccgagtcgagttaattgaagccatcctgctttgttactttttgaaatgagtggtatgctgcttttatgtaccactagttagggagggactaagtgcgaggtcctgatgttggtttgttgaagaatgcccaaggagtgtttactgtggcggtgtgtttctatcatgcaaacagatatatatgcagtttgcagtttcaaactacttggtagcagtagaaa

SEQ ID NO: 1949 - DNA, 473 bp, Brassica napus
aaatcgagaagagaggcagacccaacacaagtctacagattcacacagttcttagctcgagaagatgattatccctgtacggtgctttacatgcggaaaggtgattggaaacaagtgggatgcgtatcttgatcttctccagcttgactacactgaaggggacgcacttgatgcactcaacttagttagatactgctgcaggcgtatgctaatgacgcatgttgatctgattgagaagcttctcaactacaacactttggaaaaatcagacaacagttaagaggaggatgcaaatctgctgaaagaggattcaaaacttaatatgtatgaaaactctctgtgttttggtgtagaaacttgaatcaatctgaatattatggggttttggaagacgctagtgattttgtcatatgtatgtcggtgactctctgtgtgattcagtgttttcctttggagcaattaatctttcagta

SEQ ID NO: 1950 - DNA, 516 bp, Brassica napus
gaaaaaccccaaatcgagaagagaggcagacccaacacaagtctacagattcacacagttcttagctcgagaagatgattatccctgtacggtgctttacatgcggaaaggtgattggaaacaagtgggatgcgtatcttgatcttctccagcttgactacactgaaggggacgcacttgatgcactcaacttagttagatactgctgcaggcgtatgctaatgacgcatgttgatctgattgagaagcttctcaactacaacactttggaaaaatcagacaacagttaagaggaggatgcaaatctgctgaaagaggattcaaaacttaatatgtatgaaaactctctgtgttttggtgtagaaacttgaatcaatctgaatattatggggttttggaagacgctagtgattttgtcatatgtatgtcggtgactctctgtgtgattcagtgttttcctttggagcaattaatctttcagtactctcatagtttcatgatttttccatcaaacac

SEQ ID NO: 1951 - DNA, 694 bp, Lotus japonicus
acctaaagtcaaagaagagtcttcttcactgcggcgaagaaagcacagagccgactgagaagatgatcatccccgtccgttgtttcacatgtggaaaggtcattggaaacaaatgggatccctatctggatcttctgcagtctgattacagtgaaggagatgcgttggatgctttggggctagttcgatactgttgtaggcgcatgcttatgacccatgttgacctcattgagaagctgctgaattacaacactctggacaagtctgataccagttaagaagactcaaggaattacatgtactgagacgtaccagtggcactgcatgtcaattatcttcactttaaattgttttgcatctattaggtctagtttgtgtgctgtgtcaattctggttgttggccggacttgaaagaggctatgaatgatatggtgcagcttatgttaatttctctttttaagtttagttagggcgatgcaaaactgtcttttggtattgatgtatagactgatatggaagaccaaattgtagaagattggctggtatctacaaaaattaactgtttatgaatgccgtaattgatactaatgcttgttgtaagtttgtattactagataggaatattgctatttgacttactctgcatgttgcaatctaacctttaatgttggcaaacttattggtgagtctcctt

SEQ ID NO: 1952 - DNA, 712 bp, Cicer arietinum
tatattttatatttatttattgatagttgaatttatctacctttaattatgatatatttattatttataatgctttttattagttattatgaatttttataattgtattttcattaagtatgggattattctataattttagatttgaagctgggttttcttgtcttttgtttttttgtttgttttatccgcgtgtgaaagatgattatccccgttcgctgtttcacctgtggaaaggtcattggaaacaaatgggattcatatcttgactttctgcaagcagattacactgaaggagatgcactcgatgctttgggcctggttcgatactgttgcagacgcatgcttatgacccatgtcgaccttattgagaagctactgaattacaatagtttggaaaaggttgatgccagttaaggttttttaaggaactacagatgaccaagacgagtcagttgcgccgcaagtcctgtgtgtcaatgctttgcttttgttttagtccttttcctaaagcagttttagtttgtggttattgagactgattgtaaggtgtagcttgttgttaattacttttttaattttagaatgtgctatctttcattgatatgaaccgaagtgcagaagactaacaagtttttataaaaatgtggttattaggaatgtaagaattgataaattttatttatatgaatgttgtctggtttttttttta

SEQ ID NO: 1953 - DNA, 516 bp, Brassica rapa
gaaacccccaaatcgagaaagagagagagaaagagaggcagacccaagtctacagattcacagttcttagctcgagaagatgattatccctgtacgatgctttacatgcggaaaggtgattggaaacaagtgggatgcctatctcgatcttctccagcttgactacactgaaggggacgcacttgatgcgctcaacttagttagatactgctgcaggcgtatgctaatgacgcatgttgatctgattgagaagcttctcaactacaacactttggaaaaatcagacaacagttagaggaggatgcaaatctgctgaaagaggattcaaacttaaaatatgtattgaaaactctctgtgttttggtgtagaaacttgaatcaatctgaatattatggggttttggaagacgctagtgattttgtcatatgtatgtcggtgactctctgtgtgattcagtgttttcctttggagcaattaatctttcagtactctcatagtttcatgatttttccatc

SEQ ID NO: 1954 - DNA, 673 bp, Brassica napus
gattgagagagagaccaagttttggaggtttcagtgcgtaactcaagaatcaagatgatcatcccggttcgctgctttacctgtggaaaggtgattggaaacaagtgggatgcctatcttgatcttctccagctcgactacactgaaggggacgcacttgatgcgctcaacttagttaggtactgctgtaggcgtatgctcatgactcatgttgatctgattgagaagcttctcaactataacactctggaaaaatcagacaactcttaagaaaagagtaagtaggaagatgcaaatcgtcagaggcctatatactaaaaaaacatgtatgaaactctctgtgtttggtttagaaacttcaatcaatccgagtcatatgttggttttagaccgacgttaccattttgtcatatgtatgtcaatgcctctactacgtgttattaatttttctgagctgaaagatttgctaacagtctaaggaaaaaaaaaaaaaaaagggtagctgccctcgcagctctagcctacctacccgttcctcctataccctccgtcttctttcgtgcacctacatctttcttccctggctcgcgtcttctcacgcatgatggtcaaattcggcgctacccaccttaaactcttcccaccgaccccctttcccagatggtccatatcc

SEQ ID NO: 1955 - DNA, 686 bp, Brassica napus
  misc_feature (454)..(454): n is a, c, g, or t
  misc_feature (458)..(458): n is a, c, g, or t
  misc_feature (467)..(467): n is a, c, g, or t
gctgagaaaaaaagattgagagagagaccaagttttggaggtttcagtgcgtaactcaagaatcaagatgatcatcccggttcgctgctttacctgtggaaaggtgattggaaacaagtgggatgcctatcttgatcttctccagctcgactacactgaaggggacgcacttgatgcgctcaacttagttaggtactgctgtaggcgtatgctcatgactcatgttgatctgattgagaagcttctcaactataacactctggaaaaatcagacaactcttaagaaaagagtaagtaggaagatgcaaatcgtcagaggcctatatactaaaaaaacatgtatgaaactctctgtgtttggtttagaaacttcaatcaatccgagtcatatgttggttttagaccgacgttaccattttgtcatatgtatgtcaatgcctctactacgtgttantaanttttctganctgaaagatttgctaacagtctaaggaaaaaaaaaaaaaaaagggtagctgccctcgcagctctagcctacctacccgttcctcctataccctccgtcttctttcgtgcacctacatctttcttccctggctcgcgtcttctcacgcatgatggtcaaattcggcgctacccaccttaaactcttcccaccgaccccctttcccagatggtccatatcc

SEQ ID NO: 1956 - DNA, 451 bp, Brassica juncea
agaaagagaaagagaggcagacccaagtccacagattcacagttcttagctcgagaagatgattattcctgtacgatgctttacatgcggaaaggtgattggaaacaagtgggatgcgtatcttgatcttctccagcttgactacactgaaggggacgcacttgatgcactcaacttagttagatactgctgcaggcgtatgctaatgacgcatgttgatctgattgagaagcttctcaactacaacactttggaaaaatcagacaacagttagaagagatgcaaatctgctgaaagagtattcctgcttcaaatatgtatggaaactgtgtttggttgtagaaacttgaatcgatctgaacaatttgtggtttttgaagacgctagtgattttgtcgtgtgtatgtcagtgactctctgtgtgtttcagtgttatatttcaatcgaatca

SEQ ID NO: 1957 - DNA, 451 bp, Brassica juncea
  misc_feature (26)..(26): n is a, c, g, or t
  misc_feature (46)..(46): n is a, c, g, or t
  misc_feature (67)..(67): n is a, c, g, or t
  misc_feature (166)..(166): n is a, c, g, or t
  misc_feature (187)..(187): n is a, c, g, or t
tcacaagtctacagattcacacagtncttagctcgagaagatgatnatccctgttcgctgctttacntgcggaaaggtgattggaaacaagtgggatgcgtatcttgatcttctccagcttgactacactgaaggggacgcacttgatgcgctcaacttagttagntactgctgcaggcgtatgctnatgacgcatgttgatctgattgagaagcttctcaactacaacactctggaaaaatcagacaacagttagaagagatgcaaatctgctgaaagagtattcctgcttcaaatatgtatggaaactgtgtttggttgtagaaacttgaatcgatctgaacaatttgtggttttttgaagacgctagtgattttgtcgtgtgtatgtcagtgactctctgtgtgtttcagtgttatatttcaatcgaatcagtctttaaaagttaaat

SEQ ID NO: 1958 - DNA, 570 bp, Raphanus sativus
  misc_feature (97)..(97): n is a, c, g, or t
  misc_feature (416)..(416): n is a, c, g, or t
gggcccccccccccttttgtgttcttcaccttattaaagaaagcgcgaaggaaaaaccccaatcgagaaagagagagagagagagagagagagaganagagagagagagagagagaggcagacccaagtctacagattcacagttcctagctcgagaagatgattatccctgtacgatgctttacatgcggaaaggtgattggaaacaagtgggatgcctatctcgatcttctccagcttgactacactgaaggggacgcacttgatgcgctcaacttagttagatactgctgcaggcgtatgctaatgacgcatgttgatctgattgagaagcttctcaactacaacactctggagaaatcagacaacagttagaagagcatgcaaatctgctaatatctatggaaactctctgngttttttctgtgtaaaaacttgaaatcgatctggggttttggaagactctagtgaatttgtcatatgtatgtcagtgactctctgtgtgattcagtgttaaaattttatgagctgaaagaattgttttccttttgagtaattcatctttcaaga

SEQ ID NO: 1959 - DNA, 553 bp, Brassica napus
gcccttttgtgttcttcactttattaaaggaagcgcgaagcagaaaaccctaaacccccaaatcgagaaagagagagaggcagacccaagtctacagattcacgcagttcttagctcgagaagatgattatccctgtacgatgctttacatgcggaaaggtgattggaaacaagtgggatgcgtatcttgatcttctccagctagactacactgaaggggacgcacttgatgcgctcaacttagttagatactgctgcaggcgtatgctaatgacgcatgttgatctgattgagaagcttctcaactacaacactttggaaaaatcagacaacagttagaggaggatgcaaatctgctgaaagaggattcaaccttaaaatatgtatgaaaactctgtgtttggtgtagaaacttgaatcgatctgaatattatggggtttttgaagacgctggtgttttgtcatatgtatgtcagtgactccgtgtgattcagtgttataattttatgagctgaacgaattgttttccttttgagtaattaatctttcagta

SEQ ID NO: 1960 - DNA, 524 bp, Brassica napus
atcaacgcagagtacgcggggaaatcgagaaagagagagaggcagacccaagtctacagattcacgcagttcttagctcgagaagatgattatccctgtacgatgctttacatgcggaaaggtgattggaaacaagtgggatgcgtatcttgatcttctccagctagactacactgaaggggacgcacttgatgcgctcaacttagttagatactgctgcaggcgtatgctaatgacgcatgttgatctgattgagaagcttctcaactacaacactttggaaaaatcagacaacagttagaggaggatgcaaatctgctgaaagaggattcaaccttaaaatatgtatgaaaactctgtgtttggtgtagaaacttgaatcgatctgaatattatggggtttttgaagacgctggtgttttgtcatatgtatgtcagtgactccgtgtgattcagtgttataattttatgagctgaacgaattgttttccttttgagtaattaatctttcagtagattcatgc

SEQ ID NO: 1961 - DNA, 471 bp, Trifolium pratense
tcttcttcctgttcgttcgttcgttgtagcgtgcgtagcagagagtacagagagagagagaggagaaaatgattatccctgttcgttgtttcacctgtggaaaggtcattggaaacaaatgggattcgtatcttgactttctgcaagctgattacactgaaggagatgcactggatgctttgggtctggttcgttattgttgtaggcgcatgcttatgacccatgttgaccttattgagaaactactgaattacaattctcttgaaaagcatgatgccaattgaggattcatacagaactacagacgaccaagatatgtcagttgcaccgcaagtcccatggccataagtcaatatttttgtttttgtttttgtccttttccatctataaattgtgttgtaacaagcagttttattgtgttctggatcagttgtagttgttgagaggctactgtaaggtgcagcttatgct

SEQ ID NO: 1962 - DNA, 455 bp, Thellungiella halophila
ggtcgtaaacgaagcgcgagagagaaaaaccctaaattttggacaaagtctgaaataccaaattcgtgcacgatgatcattcctgttcgttgctttacgtgtggaaaggtgattgggaacaaatgggacacataccttgatcttctccaggctgattacaccgaaggagatgctcttgatgcgattggtttagtccgttactgctgcaggcgtatgcttatgactcatgtcgatctaatcgaaaagcttctaaactacaacactatggagaaatcggaccccaattaagaaagatgatataacgaataacaaatcagcaagagccaaagtgaagtcttacctcggaatgatgatgatgtttcactgtctttctcttgtttttgttcggttttaggaacttgggtctaatgtagacagctatttagagccacaaataaagcttgagcttttagatt

SEQ ID NO: 1963 - DNA, 574 bp, Raphanus sativus
  misc_feature (287)..(287): n is a, c, g, or t
cctattaaaaaggaaagcgtgaagtgaagcagtaaaacctaaaactcccaagcgagaaaaaatatatagagagagagagagaaacaaagtttagaggtttaagtgcttagctcaagatgatcatccctgttcgctgctttacctgtggaaaagtgattggaaacaagtgggatgcgtatcttgatcttctccagcttgactacactgaaggggatgcacttgatgcgctcaacttggttagatactgctgcaggcgtatgcttatgactcacgttgatcttatcganaagcttctcaactacaacactctggaaaaatccgacaacagttgataaagagtggatgcaaatctgttgaaagagtgttgttactcgtcagacggcttatatatttatgaaatatgtatgaaactctagtgtgtttggtgtagaaacttaatcaatctgaatcatgttggttttagactacgtcagggattttatcatatgtatgtcggtgtctctacgtgttatgcttttctgagctgaaagatttgtacttctaagtaattcgtctttcaccagttcgtataccc

SEQ ID NO: 1964 - DNA, 557 bp, Lotus japonicus
acataaaagtcaaagaagagtcaaattctctcctgttgtgagcggcgaagaagagaacgcagcggaggcaacaatctgctgaggaagatgatcatccccgtccgttgtttcacctgtggaaaggtcatcggaaacaaatgggatccctatctggatcttctgcagtctgattacagtgaaggagatgcattggatgctttgggtctagttcgatattgttgtaggcgcatgcttatgacccatgttgacctcatcgagaagctgctgaattacaacactctggacaagtctgataccagttaagaagactcaaggaatcatatgtgactgaagatgtgtcagttgcactgcatgtcaattacataccctttaaattgttttgcatcaagtaggtctagtttgtgtgctgtgtcaattttggttgttgtccggtcatgagacaggctatgaatgatatggtgaagctcatgtttatttcttttttaagtttagttagggtgatgcaaaactgtcttttggtattgatgatgtatacactgatatgaaagaccaaattg

SEQ ID NO: 1965 - DNA, 752 bp, Glycine max
gggctaccctggggtcatgaagcggcccatttagttgtgaatagcaaagatcttcaaagccgttttgttcatgaaataacctcaacggccgcaagcacatttattagaaagggcgtggttttgttgtgagtactgagctgagaagagggagaagatgatcatccccgttcgttgttttacctgtggaaaggtaattggaaacaaatgggatacctatttggaccttctccaggcagattacagtgaaggagatgcactggatgcattgggactggttcggtattgttgtaggcgcatgcttatgacccacgttgatctcattgagaagttgctcaattacaatactttggacaagtctgatctcaattaagaagaaggcttgaggaataacagatgaccaagatgcttctgttgtattccatgccctatggcaatgcatcaatttttcttttcttttatgaattgctttggtacaagcaggtcatgtttgtgtgctggttcaggtcaagtgtgtttgttatcagttctgaggagctatgaaaagacacagcttatgttaatatctcatataatgatatgatatgacagaccaaacttttgaataatctgactggtatttttaaaaatctgattgttttagaatgtcgacattgacaccaatgcatgtccttaatttatattaggaatattgctacctgacttactctgcttgttgtaatttaaattgtacaatgcatatgaataattcttaa

SEQ ID NO: 1966 - DNA, 708 bp, Glycine max
ttttcttcgcttctttcttcttctctgttaattcttttcttacatcttaaaaaacaatataaagaagggcgtggttttgttgtgagtactgagctgagaagagggagaagatgatcatccccgttcgttgttttacctgtggaaaggtaattggaaacaaatgggatacctatttggaccttctccaggcagattacagtgaaggagatgcactggatgcattgggactggttcggtattgttgtaggcgcatgcttatgacccacgttgatctcattgagaagttgctcaattacaatactttggacaagtctgatctcaattaagaagaaggcttgaggaataacagatgaccaagatgcttctgttgtattccatgccctatggcaatgcatcaatttttcttttcttttatgaattgctttggtacaagcaggtcatgtttgtgtgctggttcaggtcaagtgtgtttgttatcagttctgaggagctatgaaaagacacagcttatgttaatatctcatataatgatatgatatgacagaccaaacttttgaataatctgactggtatttttaaaaatctgattgttttagaatgtcgacattgacaccaatgcatgtccttaatttatattaggaatattgctacctgacttactctgcttgttgtaatttaaattgtacaatgcatatgaataattcttaa

SEQ ID NO: 1967 - DNA, 621 bp, Glycine max
aacagttttgttcatgaaatagcctttccagtcaccggcgttagttgatcagagtcacagtcactacggcaagcacattattagagtggaagggcgtggttttgttgtgagtactgagcagagaagagaaaaatgatcatccccgttcgttgttttacctgtggaaaggtcattggaaacaaatgggacacctatttggaccttctccaggcagattacagtgaaggagatgcactggatgcattgggattggttcgatattgttgtaggcgcatgcttatgacccatgttgatctcattgagaagttgctcaattacaacactctggacaagtctgatcccaattaagaaggcttaaggaataacagatgatgtttcagttgcattccatggcctatggcaatgtatcgatttttgttttcttttttgaattgcatttttacaagcagttcatgtttgtgtgctggttcagagcaagtatgtttgttatcggttctttagaggagctatgacaagagacagtttatgttaatatctcatacaatggtattatatgacagaccaaactttagaaggatgccacatgcaaacaagttaattggcacataaaaattcacgatt

SEQ ID NO: 1968 - DNA, 369 bp, Ceratodon purpureus
tttgcaggtgttggactgacttagcgctcgcacttgatcagggcgaggttggtttctgttgggttcagcgcttcacgatgattattcctgtgcgttgcttcacctgcgggaaggtgattggcaacaaatgggacacatatctcgacctcttgcagcggactattccgagggtgatgccctggacgccttggctctgtccggtactgctgccgccgcatgctgatgacccatgtggatctcattgagaagcttctgaattacaacactctggagaggaatgagaacgccaataactgaagtcagcagtaatgaccagtgtcagcatggctctgtttatggcgttctcatttcctctccagagtgttgtaa

SEQ ID NO: 1969 - DNA, 372 bp, Lactuca sativa
  misc_feature (333)..(333): n is a, c, g, or t
ggggaacaaagatgattattcctgttcgttgtttcacttgcggcaaggtcattggaaacaaatgggacacgtatcttgatcttctccagtctgattacacggaaggagatgctcttgatgctttgggacttgtccgttattgttgcagaagaatgctaatgactcatgttgacctcatcgagaagcttctgaactacaacacattggagaaatctgatacgagctgaggccttttgaagaatgttttggataaacctaaattgcttccctagtatatgctaaattgtattgattaatcaaaatggattgatgtttgggttgtgttgtctactntgggaatattattttggtttgaaggatatgtaaacttgt

SEQ ID NO: 1970 - DNA, 528 bp, Cenchrus ciliaris
ggcgatcccaccatttcggcggcggcggcgaagatgatcatcccggtgcgctgcttcacctgcggcaaggtgatcgggaacaagtgggacgcgtaccttgacctcatccaggcggactacaacgagggggacgctatggatgctttgggcgtgatccgctactgctgtaggcgaatgctgatgacccatgtcgacctcatcgagaagcttctcaactacaacacgctggagaagaaggccgaagaagaagctgccaattaagcgaacatggcatgctcgagtgctggtccgttgcacctagtgttactctgtgtttagtacatgtctggacaaacccaattctattctccctattccatgctgtgtcaccagggatcttcctgtgtaacaatttctgaacaaccggaagagcgataagtccgcgtacgaatcgacttgcaattttaccccaaattcccatggtcatacatactgtaattccctcaagggacatgcccttgcaacatccggaaaggccggtgacctgca

SEQ ID NO: 1971 - DNA, 557 bp, Pennisetum glaucum
cccacccgtcccacccccctctcgcaaccggcgaccccatccttccggcggcggcggcgaagatgatcatcccggtgcgctgcttcacctgcggcaaggtgataggtgacaagtgggacgcgtatcttgacctcatccaggcggactacaacgagggggacgctatggatgctttgggcttgatccgctactgctgtaggcgaatgctgatgacccatgtcgacctcatcgagaagcttctcaactacaacacgctggagaagaagcccgaagacgaagctgccaattaagcgaacatggcatgctcgaatgctggtccgtcacacctagtaccctacgctggagtgttactctgtgtttagtacatgtctggacaaactcaatgctattctccatttctccctgttccatgttgtgtctgctgatgaccgtaatcggtaggtcatcataacttcagttttaccagggatctgcctaagtaacgatttgtgaacagctggaagagccatgggcgtactaattgactagcagtttaattacccttcgatgccaaaaaa

SEQ ID NO: 1972 - DNA, 541 bp, Vigna unguiculata
gggaactcacagaagaagatgattatccccgttcgttgtttcacctgcggaaaggtcattggaaacaaatgggattcctatttggaccttttgcaggcagattacagtgaaggagatgcactggatgctttgggactggttcgatattgttgtaggcgcatgcttatgacccatgttgatctcattgagaagttactaaattacaactctctggacaaatctgatcccagttaagaagacttgaggaataacgaatgagcaagatgtttcacttgcattccattctctctgggcatgtatcaatttttttttttttccttttttgaattgttttgctacaagctgctcatggttgtgttcttgttcagggttatctgttctatatgatagggtatgttaagtacttttagtcattgtaaggaaaaactgtattttgatgttaatagttcatacaatgatatgtaaaatttagaagactcacttgtttttcttaaatatctgataattggattccaatgcatgtcctaaatttatgtttata

SEQ ID NO: 1973 - DNA, 268 bp, Tamarix hispida
gggggactaccggcagggacaatgattatacccgttcgttgtttcacctgcggcaaggttattggtaacaaatgggacacctaccttgatcttctccaagctgattacagtgaaggagatgcactcgatgcattgggcttggtacgatactgctgcaggaggatgctcatgacacatgtggacctcattgaatagctcctgacctacaacactcttgacaaatccgacaccagttgatgcagtctatagacggtgaatcgaatatctg

SEQ ID NO: 1974 - DNA, 620 bp, Gossypium hirsutum
  misc_feature (605)..(605): n is a, c, g, or t
ggcacgaggaaagaggtaaggcaaaattcgaagtcgaggcgacacaaaaagtaacggagctagatgataattccagttcgctgcttcacctgcgtgaaaggtcatgggtaacaaatgggacacttatcttgatcttctccaggccgattatacctgaacgagatgctcttgatgctttgggattggttcggtactgctgtaggacaatgctcatgactcatgttgacctcatagagaagctgctgaactacaacacattggagaatcggatacagttgagggaacatgtataatctaagggtttgttgcagtttgtgtgagtgcctgtcaatgatggacgtgatctgaatccagaaatagggaaggaaaggacttacatagtgactaatctagtgcgttttctccaactctatgatggatccctgtatgtactaaattaatgggatctgaaatgctgaaagtgattggaatgcttggctgtttgctgggataattgtgtgatcaaagacttaacttacgatcacttgcattgctacagatgtgttactcagtgtaggatgaaccgaccatttataattcataataatgacatgtccttctggtanaatatcaacgtaact

SEQ ID NO: 1975 - DNA, 727 bp, Triphysaria pusilla
tgggatttggctgctcgctgagggaagtaacagtaagaaccctagcgatccataatgattattccagttcgatgcttcacctgtgggaaggtgattgggaacaaatgggatacatatcttgatttgctccaggctgattacaccgaaggtgatgctcttgatgcgctgggcttggttcgttactgctgccggagaatgctgatgacccacgttgatctcatcgagaagctgctgaactataacagtctctttctactcctccctatctctatttgtgattttgtgtgtccagttttcattacttgtatgtttatgtgattgtctgttttttggcatccgtttttcttattattgtttcaatttggtgagattatttatgattatttagtaaactttgaaatagtcatgcttatgaattgacttaataataatcttctggatacaagggctaagaattacatataacaagtctgatttgttatttgtaaggcaactgtttgattattttaactcacctgctcttttttttacagctttggagaaatcggaaggcagctgattggaatctgtgtggaatgtcgtcaagttattccaaggcacctcgaatttgattttattgtatgtaaatgttaggaaaatgacattgttaaggataactaagagtctactttttgaaccatgatgccattagctatgactaatgtttcctttctactatcttttgtgt

SEQ ID NO: 1976 - DNA, 727 bp, Triphysaria pusilla
tgggatttggctgctcgctgagggaagtaacagtaagaaccctagcgatccataatgattattccagttcgatgcttcacctgtggaaaggtgattgggaacaaatgggatacatatcttgatttgctccaggctgattacaccgaaggtgatgctcttgatgcgctgggcttggttcgttactgctgccggagaatgctgatgacccacgttgatctcatcgagaaactgctgaactataacagtctctttctactcctccctatctctatttgtgattttgtgtgtccagttttcattacttgtatgtttatgtgattgtctgttttttggcatccgtttttcttattattgtttcaatttggtgagattatttatgattatttagtaaactttgaaatagtcatgcttatgaattgacttaataataatcttctggatacaagggctaagaattacatataacaagtctgatttgttatttgtaaggcaactgtttgattattttaactcacctgctcttttttttacagctttggagaaatcggaaggcagctgattggaatctgtgtggaatgtcgtcaagttattccaaggcacctcgaatttgattttattgtatgtaaatgttaggaaaatgacattgttaaggataactaagagtctactttttgaaccatgatgccattagctatgactaatgtttcctttctactatcttttgtgt

SEQ ID NO: 1977 - DNA, 547 bp, Cajanus cajan
gaaatacccagttcgtgaatcagagactgcaaagcaagcacaccagaagaagaggacacatatagcgttagaggaagatgatcatccccgttcgctgtttcacctgtggcaaggtcattggaaacaaatgggatgcctatttggaccttctgcaggcagattatagtgaaggagatgcactggatgcattgggactggttcgatattgttgtaggcgcatgcttatgacccacgttgatctcattgagaagttactgaattacaacgctctggacaagtctgatccaagttaagaaggcttaaggaataacacatgaccaggatgtttcagtcgcattccatgccctatggccatatatcttttttctttttttgaatggttttgctacaggtcagggtatgtttgtgtgctggggatgagtttacgtaaaagctttaacgatggaaatttcgactttcaaatttttagtagtcttcaaactctcttaaaagccagagcacaaaccccatttattatcatctattaatcatatattataattataaa

SEQ ID NO: 1978 - DNA, 775 bp, Sciadopitys verticillata
cagagcctgcaaatcgtggtagatcttgcaattcgtgggataagaaacagaaacagagcttgaatatcgcggtaggcgtgcaaatcgtgggagagccgaataaaaacgccgaacatatataaatttgaacgcgtggtttaaaaaccgcgaattttcgaacattaagctgaaagttcggtgaacctggtaacacgatccgcactacactctgcaagaatgattattcccgtgcgatgcttcacctgtggaaaggtgattgggaacaaatgggatcaatacctcgaccttcttcaggctgattatcctgaaggagatgctcttgatgcactgggtttggtgagatactgctgcaggcgtatgctgatgactcatgttgacctcattgagaagcttctgagttacaacacattggaaaggaatgatgcgaattagtcaccaagcttttatagccatgacggatacaattttgctactgatattaggattgattatgatgcctagagctgccatgtaagatgttatgtatatcgcatgagttttagtggtcagtgttgaacctttagttcctgtgtgcaactcaattgtaggtctgtgatgattattggctatattgcttatggcagtgaagtggattgtactttatgtatgttttatcagaaagatcatataatacctatgataaacttttttatcataaaacatctataggaaaaatgggtataacctaatcacctttctccaaaggagtgcacccaattacgagggctgaaatcag

SEQ ID NO: 1979 - DNA, 586 bp, Glycine max
cggcgttagttgatcagagtcacagtcactacggcaagcacattattagagtggaagggcgtggttttgttgtgagtactgagcagagaagaggaaaatgatcatcccagttcgttgcttcacctgtggaaaggtcattggaaacaaatgggacacctatttggaccttctgcaggcagattacagtgaaggagatgcattggatgcattggggctggttcgttattgttgtaggcgcatgctcatgacccatgttgatctcatcgagaagctactcaattacaacgctctggacaagtctgatcccaattaagaaggcttaaggaataacagatgatgtttcagttgcattccatggcctatggcaatgtatcgatttttgttttcttttttgaattgcatttttacaagcagttcatgtttgtgtgctggttcagagcaagtatgtttgttatcggttctttagaggagctatgacaagagacagtttatgttaatatctcatacaatggtattatatgacagaccaaactttagaaggatgccacatgcaaacaagttaattggcacataaaaattcacgatt

SEQ ID NO: 1980 - DNA, 561 bp, Quercus alba
cctcagaaattagaaccctctagaacccacggaaaccacatagacacggaagagaagagaagagaaagaggaacaacctaaggcaaccgctaagatgatcattccagttcgttgctttacctgcggcaaggtaattggaaacaaatgggacacatatcttgaccttctacagtcagattactctgaaggagatgcacttgatggattggggttggtccgatactgctgcaggcgaatgcttatgactcatgttgacctcattgagaagcttcttaattacaacactctggagaggaatgataacacttaatgaatgggggctgcaagtgagcagaagtttgttttaccaaatgtgaatgtctatctaggttaactgttttattttgtttggagcaagtactggtcaaataggatgtagccagacacaagtgaaaatattatgggatgtgttcaagacaattctgttgttgcttttatgaatattttaatgtgtatgaacctatccactaaattataatatgtttgttgctttagcataatgtttcttgtgaaataatttgt

SEQ ID NO: 1981 - DNA, 514 bp, Quercus alba
attagaaccctctagaacccacggaaaccacataggacagaagagaagagaaagaggaacaacctaaggcaaccgctaagatgatcattccagttcgttgctttacctgcggcaaggtaattggaaacaaatgggacacatatcttgaccttctacagtcagattactctgaaggagatgcacttgatggattggggttggtccgttactgctgcaggcgaatgcttatgactcatgttgacctcattgagaagcttctgaattacaatactctggagaggaatgataacacttaatgaatgggggctgcaagtgagcagaagtttgtttaccaatgtgaatgtttatctaggttaactgttttattttgtttggagcaagtactggtcaaataggatgtagctagacaagtgaaaatattatgggatgtgttcaagacaattctgttgttgcttttatgaatattttaatatgtatgaacctatccactaaattaaaatatgtttgttgcttg

SEQ ID NO: 1982 - DNA, 591 bp, Vigna unguiculata
ggaagaaaacctttaaaatcagtacgtccgtgaaaaacagtatcgattgagaaaagagggggtgtaggagcatcgatatcagaggaaaatgatcatcccagttcgttgcttcacctgtggaaaggtcattggaaacaaatgggacacctatttggaccttctgcaggcagattacagtgaaggagatgcattggatgcattggggctggttcgttattgttgtaggcgcatgctcatgacccatgttgatctcatcgagaagctactcaattacaacgcgctggacaagtctgatcccagttaaggaataccagataaccaaagatggttcagtgaattccatgccccgtggacatgtaccagtttttcttcttgtttttttttttttcttgaattaattgtttttgctacaagcagggtcatgtttttgtgtcggtttagatcaaatatgtttgttgtctgttcttaagaggggctttggcaagacaccgtttatgttaatttcatatgccttgttatgacagaccaaatttttgaagaatgtcgtaattgatgccaatgcatgtcctaaaaaaaattaaaagaaaaaaa

SEQ ID NO: 1983 - DNA, 825 bp, Selaginella moellendorffii
atagctaaaaagaatatttagggcaaacgagtcgagccaagaaccctaaaaccccaggatgatcattccagtgcgctgcttcacttgcggcaaggtgatcggcaacaaatgggacacctacttggatcttctccaggccgattacccagagagtgaagcgctcgatgctttgggacttgtgcgctactgctgccggcgaatgctcatgactcacgtcgatctcatcgaaaagctgctcaactacaacactctggagcgcaacgaaaacaatcagtgaagcttctgtgagtcttgtgacatagctagcctatacaaactttgcaaagaaactcttcgattattgtagaatctcaatgaattgagagagcttattgagatctttctctcgctcgatcactctcacaaggacccaagaacaaccatctgctggtttatggcgtggtacctccacacctccttgttcacaaaatcagcatccaaaaacttcgcgacgaactcccacactctataaacatcctcgaagctgctcacgtagctcaaagcgatggtcaccaccagaaactcttgctggctctccggcgaagaactctgggacgaaccgaatgcgttgctcttcctgggagatatgttctggaagtccggcaccaagtccacaaacttcacgttcttgatctgcgcaagtcccagcgatatgctgtttcgatccgcgagccgctggacgagcgtcggctggaagagaagcccatcccagtcgtagagattgaaagccatggacgcacctcgatcgtatttcctcccgctggggccgtaaatctggaccagcgg

SEQ ID NO: 1984 - DNA, 583 bp, Phaseolus coccineus
ttttcctattatggccgggacaaaaaccttcaaaatctttttttgttttgtgaaaaacaaatagaaagagaaaagaagggcgtggagtgtgagcatcgatacaggatctgaggaagatgatcatccccgttcgttgcttcacctgtggaaaggtcattggaaacaaatgggacacctatttggaccttctgcaggcagattacagtgaaggggatgcattggatgcattgggactggttcgatattgttgtaggcgcatgctcatgacccatgttgatctcattgagaagctactcaattacaacgctctggacaagtccgatcccagttaaggaatgacaaatgacatggttctgtgtattccgtgccccgtgaacatgtatcagttttatagtttttttgttttagttaattgttttgctacaagcaggtcatgttttcaggtcaagtatgtttgttatctgttcttaagaccggctatggcaagacccagtttatgtgaatttcttatatattgttatgacagaccaaatttttgaagaatgtcgaaatttaatgccaatgcatgttctaaatttgtttt

SEQ ID NO: 1985 - DNA, 594 bp, Arachis hypogaea
gagttgaaatcagatcggtttgaaagagaagaaagagaacccacgctctttctctcagagtcgcggttccatcaccgcattcctcttagagaagcttccagagtgttcagaggaaggagcaagatgattatcccagtccgttgcttcacctgcggaaaggtcatcggaaacaaatgggatgcctatttggaccttctccagtcagattactctgaaggagatgcgcttgatgctttggggctggttcgttattgttgtaggcgtatgcttatgacgcatgttgacctcatcgagaagctcctgaattacaacactcttgacaagtctgatcccagttagaaaaagttgtatggaatcggctgcgcatgcacatttcggtcgtcttaatcacgtctattattttggatcttccttctccgaactgttttaagggggatatatgaggcgcagtttgtgttaattacttatgagatgttatttttatgataatctggctgctttgctcctcttcatgttgcaacttatcttctattcatatattcatataacagtgtagtgtttttcataaaaggggtttaatgcaacttatcttct

SEQ ID NO: 1986 - DNA, 581 bp, Arachis hypogaea
gtttgaaagagaagaaagagaacccacgctctttctctcagagtcgcggttccatcaccgcattcctcttagagaagcttccagagtgttcagaggaaggagcaagatgattatcccagtccgttgcttcacctgcggaaaggtcatcggaaacaaatgggatgcctatttggaccttctccagtcagattactctgaaggagatgcgcttgatgctttggggctggttcgttattgttgtaggcgtatgcttatgacgcatgttgacctcatcgagaagctcctgaattacaacactcttgacaagtctgatcccagttagaaaaagttgtatggaatcggctgcgcatgcacatttcggtcgtcttaatcacgtctattattttggatcttccttctccgaactgttttaagggggatatatgaggcgcagtttgtgttaattacttatgagatgttatttttatgataatctggctgctttgctcctcttcatgttgcaacttatcttctattcatatattcatataacagtgtagtgtttttcataaaaggggtttaatgcaacttatcttctattc

SEQ ID NO: 1987 - DNA, 377 bp, Castanea mollissima
ttagaagcctctagagcccacggaaaccacatagacacagaagagaagagagaggaacaaccgaagccaaccgcgaagatgatcattccagttcgttgctttacctgcggcaaggtaattggaaacaaatgggatacatatcttgaccttctacagtcagattactctgaaggagatgcacttgatggattggggttggtccgctactgctgcaggcgaatgcttatgactcatgttgacctcattgagaagcttctgaattacaatactctggagaggaatgataacacctaatgaatgggggctcaagtgagcagaagttcgtttaccaaatgtgaatgtctatctaggtttactgttttattttgtttggagca

SEQ ID NO: 1988 - DNA, 1013 bp, Mesostigma viride
  misc_feature (407)..(407): n is a, c, g, or t
  misc_feature (655)..(655): n is a, c, g, or t
  misc_feature (745)..(745): n is a, c, g, or t
  misc_feature (858)..(858): n is a, c, g, or t
gaacgaggagcagccatagctaagggtattagccgtcggtgcaggaactgctcatcaccaagccatttccacgagacggtccgtagaaattgcggtcagggcaatcgaggcgtggccgggaaatcgagcctacagtgttcggaggtggtacagccgccggaatctagggtgctgttcatattagagaaacgacttcacgataacagtttccttccataacaaaaaaaaatgattattccagtccgctgttttacatgtgggaaggtcatcggcaataaatgggatacgtacctggaccttctgcaagccgactactcagaaggcgacgcgctagacgcgctgggcctggtgcgctactgctgccgccgcatgctgatgacgcacgtggacctgatcgagaagctgcncaactacaacacgctggagcgtgcacagggataaagctgtgatgcgggggggagctattcggtgccatgaatctggagacgaaggggaggctaaggggagttacccatctccagctggaggctgaggggagttacccatttgtatttattataacccagatggttcctgggtttggaccacctgcaggggggaactgccctggcctcagacagtcgcaaccgtgggatcagatgtagtgagcagtttncatgcaggtggccggcgctttatgctgacagaagcaaattcaaaacgtatcggcttggtcatcagagtcatcattcatgcgcacacaggnacagcttccgtgtgcgcatgactcatagccaggctgggctttccccaacaagtgagcaacccaggactgtaccaaaagtatgggatgagccagggctgcgcattgacttgcangtatgaggcgagccaagtcagcacaggacttctcatgtggacagatgccatgtgtgaatttggatgtacaggtccagaagttatgcagtatatggatcccgtataaagcatgaccactaggcgcggaaccatgaagccatgcgccggtacttgac

SEQ ID NO: 1989 - DNA, 648 bp, Glycine max
aaaaaccaatataaatatggtgaagaagggtttaggtgggttttgagcacttggcacagaagagcacgctgagagaaaggaagatgatcatccccgttcgttgtttcacctgcggaaaggtcattggaaacaaatgggatacctatttggaccttctgcagtcagattacagtgaaggagatgcactggatgctttgggactggttcgatattgctgtaggcgcatgcttatgacccatgtcgatctcattgagaagttactgaattacaacactctggacaagtctgatcccagttaagaaggcttaaggagcaaagaatgaccaagatgtttcagttgcattccatgctatctggccaatgaacaatcttttttccttttctgaattgttttgctacaagctggtcatggttgtgtgctgattcatgtgaattatggttatccgttctttaaaggggctatatgacaaagcgcagcttatgttaattacttcatttctagtcagtgtgatgcgaagctgtcttttgatattaatatctcatacacaattatatgtctaccatactttagaagactgacccgtacttttaaaaatctgattatttaagaatgtcctaaatttatatatttagaaatattgctacctg

SEQ ID NO: 1990 - DNA, 617 bp, Glycine max
aaaaaccaatataaatatggtgaagaagggtttaggtgggttttgagcacttggcacagaagagcacgctgagagaaaggaagatgatcatccccgttcgttgtttcacctgcggaaaggtcattggaaacaaatgggatacctatttggaccttctgcagtcagattacagtgaaggagatgcactggatgctttgggactggttcgatattgctgtaggcgcatgcttatgacccatgtcgatctcattgagaagttactgaattacaacactctggacaagtctgatcccagttaagaaggcttaaggagcaaagaatgaccaagatgtttcagttgcattccatgctatctggccaatgaacaatcttttttccttttctgaattgttttgctacaagctggtcatggttgtgtgctgattcatgtgaattatggttatccgttctttaaaggggctatatgacaaagcgcagcttatgttaattacttcatttctagtcagtgtgatgcgaagctgtcttttgatattaatatctcatacacaattatatgtctaccatactttagaagactgacccgtacttttaaaaatctgattatttaagaatgtcct

SEQ ID NO: 1991 - DNA, 602 bp, Glycine max
gtggtttgagactgtgagcacttagcagagaggaagaaagatgatcatccctgttcgttgtttcacctgcggaaaggtcattggaaacaaatgggatacctatttagaccttctgcagtcagattacagtgaaggagatgccctggatgctttgggactggttcgatattgctgtaggcgcatgcttatgacccatgtcgatctcattgagaagttattgaattacaacactctggacaagtctgatcccagttaagaaggccttagggagcaaaggatgaccaagatgtttcagttgaattccatgctatctggccaatgaacaatcttttttccttttctgaattgttttgctacaagctggtcatggttgtgtgctggttcatgcgaattatggttatccgttcgttaaaggggctatgacaaggcccaacttatgttaattactctttttttagtctttctgatgcaaagttgtcttttgatattaatatctcatacacaattatatgtctgaccaaacattaggagactgactcgaagatctgattatttaagaatgtccaaattgatacaaatgcatgtcctaaatttatatgctt

SEQ ID NO: 1992 - DNA, 793 bp, Arachis hypogaea
aggggggggttattgaaatattgaacaccccttactgtgagcaaagcaacggggtttcgggtttagaaaagaaaaaccaagcaaaataagaccgacgagaaccctaaatcctaccctcttctcccagtagcggttccttcttcccttcgtcctacgcaacgcattccccttcgctgtcgtcgtctccttccggtcgccggcgtcgcctccgttccgttgaaacaagaagctgcctcttagagaagcttccagagtgtgcagagaaggagcaagatgattatcccagtccgttgcttcacctgtggaaaggttatcggaaacaaatgggatgcatatttggaccttcttcagtcagattactctgaaggagatgcgctggatgctttggggctggttcgttattgttgtaggcgtatgcttatgacgcatgttgacctcattgagaagctcctgaattacaacactcttgacaagtctgatcccagttaaaaatgatgtatggaattgggtgcgcatgtcattcttccgaatcacatgtctactattttagattttacttcttgaacatatctgttctttctttttgttgttgttgtcattggcatataaacttctctgtagatttgcacagtggcctaaagttctatgcctcttttgcagactagcttaagtgcttttgtttcatctattgttttctctcttattacacagtcctacatttctctctctaacatgaaaagtgaaaagtgcataaaaattttccacaattgatggaaggggaagtttccaacag

SEQ ID NO: 1993 - DNA, 719 bp, Arachis hypogaea
ttgaaatattgaacaacccatactgtgagcaaagcaacggggtttcgggtttagaaaaggaaaacgaagcaaaataagaccgacgagaaccctaaatcctaccctcttctcccagtagcggttccttcttcccttcgtcctacgcaacgcattccccttcgctgtcgtcgtctccttccggtcgccggcgtcgcctccgttccgttcaaacaagaagctgcctcttagagaagcttccagagtgtgcagagaaggagcaagatgattatcccagtccgttgcttcacctgtggaaaggttatcggaaacaaatgggatgcatatttggaccttcttcagtcagattactctgaaggagatgcgctggatgctttggggctggttcgttattgttgtaggcgtatgcttatgacgcatgttgacctcattgagaagctcctgaattacaacactcttgacaagtctgatcccagttaaaaatgatgtatggaattgggtgcgcatgtcattcttccgaatcacatgtctactattttagattttacttcttgaacatatctgttctttctttttgttgttgttgtcattggcatataaacttctctgtagatttgcacagtggcctaaagttctatgcctcttttgcagactagcttaagtgctttttttgtttcatctattgttttctctcttattacacagtcctacctttctctctc

SEQ ID NO: 1994 - DNA, 773 bp, Arachis hypogaea
atgaatgagttgaaatcagatcggtttgaaagagaagaaagagaagccacgctctttctctccgagtggcggttccatcaccgcattcctcttagagaagcttcgagagtgttcagagaaggagcaagatgattatcccagtccgttgcttcacctgcggaaaggtcatcggaaacaaatgggatgcctatttggaccttctccagtcagattactctgaaggagatgcgcttgatgctttggggctggttcgttattgttgtaggcgtatgcttatgacgcatgttgacctcattgagaagctcctgaattacaacactcttgacaagtctgatcccagttagaaaaggttgtatggaatcggctgcgcatgcacatgtcggtcgtcgtcttaatcacatgtctattattttagatcttccttctccgaactgttttaagggggatatgaggcgcagtttgtgttaattaccttctaactctgccaatgtggtcttttgatagttgtgccctacaaagatatgaaaaactaaattttagaggacttatgagatgttatttttatgataatctggctgctttgctcctcgtcatgttgcaacttatcttctattcatatcactgtgtagatattatcaaataccaacctgtttcctatagtagtttaattcatgcatagttatgttactaggagagattgatatcatagttatcttataaattatgatattggttagaatgttaatttatcgataatggaagtgttttacatg

SEQ ID NO: 1995 - DNA, 623 bp, Arachis hypogaea
ggtatgaatgagttgaaatcagatcggtttgaaagagaagaaagagaagccacgctctttctctccgagtggcggttccatcaccgcattcctcttagagaagcttcgagagtgttcagagaaggagcaagatgattatcccagtccgttgcttcacctgcggaaaggtcatcggaaacaaatgggatgcctatttggaccttctccagtcagattactctgaaggagatgcgcttgatgctttggggctggttcgttattgttgtaggcgtatgcttatgacgcatgttgacctcattgagaagctcctgaattacaacactcttgacaagtctgatcccagttagaaaaggttgtatggaatcggctgcgcatgcacatgtcggtcgtcgtcttaatcacatgtctattattttagatcttccttctccgaactgttttaagggggatatgaggcgcagtttgtgttaattaccttctaactctgccaatgtggtcttttgatagttgtgccctacaaagatatgaaaaactaaattttagaggacttatgagatgttatttttatgataatctggctgctttgctcctcgtcatgttgcaacttatcttctattcatata

SEQ ID NO: 1996 - DNA, 466 bp, Raphanus sativus
  misc_feature (72)..(72): n is a, c, g, or t
  misc_feature (174)..(174): n is a, c, g, or t
  misc_feature (296)..(296): n is a, c, g, or t
  misc_feature (355)..(355): n is a, c, g, or t
agaggtttcagtgcttagctcaagatgatcatccctgttcgctgctttacctgtggaaaggtgattggaaanaagtgggatgcctatcttgatcttctccagcttgactacactgaaggggatgcacttgatgcgctcaacttggtgagatactgctgcaggcgtatgcttatnactcacgttgatcttattgagaagcttctcaactataacactctggaaaaatcagacaacagttgaaaaagagaggatgcaaatctgttgaaagagtgttgttactcgtcagagggctatanattatggaatatgtatgaatctcttgtgtgtttggtgtagaaaattaaatcaatctgantcatgttggttttagactacgtcagggattttgtcatatgcatgtcgggtgtctctacgtgttatgattttctgagctgaaagatttgtacttctaagtaattcgtctttc

SEQ ID NO: 1997 - DNA, 527 bp, Pennisetum glaucum
ggctaaccggcgaccccatccttccggcggcgacggcgaagatgatcatcccggtgcgctgcttcacctgcggcaaggtgataggtgacaagtgggacgcgtatcttgacctcatccaggcggactacaacgagggggacgctatggatgctttgggcttgatccgctactgctgtaggcgaatgctgatgacccatgtcgacctcatcgagaagctctcaactacaacacgctggagaagaagcccgaagacgaagctgccaattaagcgaacatggcatgctcgaatgctggtccgtcacacctagtaccctacgctggagtgttactctgtgtttagtacatgtctggacaaactcaatgctattctccatttctccctgttccatgttgtgtctgctgatgaccgtaatcggtaggtcatcataacttcagttttaccagggatctgcctaagtaacgatttgtgaacagctggaagagccatgggcgtactaattgactagcagtttaattacccttgatgc

SEQ ID NO: 1998 - DNA, 595 bp, Gnetum gnemon
tcatttcttcattcaaacaaacatcaaacgccttggtcggtaaatttgttgatcagttacttctaacgttgagcgcgcaggaagtaaggttggttttttgtgtatagtgggagcctgcatttttcgctagtccgacaagatgatcatccccgtcagatgcttcacctgcggcaaggttattggcaacaaatgggactcgtaccttgatcttctgcaggctgactactctgaaagtgatgctctggatgcacttgggctgatcagatattgctgccggcggatgctcatgacacatgttgaccttattgagaagctattaaattacaacacattggagcgaagtgatgcaaattaatggagttcaaattaatatgtggaaatcattgatgtacattttgaaaaatacgaaaaatgttaccatgtatatgccgaatcggtatctgctaactggcagtctctgatctaaggctattgtcgtgcatggctgttgggcttgatttgctttggatatgtgaattttgaacagcaagcaacatctaagacatcttatttgttatgtgatgagttataatagtgcacagaccctgagaccctg

SEQ ID NO: 1999 - DNA, 530 bp, Arabidopsis thaliana
atttttgctttgagacgagaacgaagttagaaagagacaagccctaaagatcgctttgagacgataaactcttaaagtttcgattcgttcacgatgatcgtccctgttcgttgttttacttgtggaaaggtgattgggaacaaatgggacacataccttgaacttctccaggctgattacgctgaaggggatgctcttgacgcgcttggattagtccgttactgctgcaggcgtatgcttatgactcatgtcgatctaatcgaaaagcttctaaactacaacactatggagaaatccgaccccaattaaaaaaagatgctataatgaataacaaatcatcaagagctgaagtgaaggagtgatgcatctcatccatgtgggcgtcttaataaaaccacaatgtttcagaaattttggtttaatttataactaggaatgttgatatttcaatgttttctgatgttcttgttcggttttagaaatctagacaatttttcgagccaaaaataaagctcaagcctgtagagtca

SEQ ID NO: 2000 - DNA, 390 bp, Arabidopsis lyrata
ttttgctttgagacgacgaaacgaagtgagaaatagaaaaccctaaaaattgcttatagacgataaactctgaaaatctcaatttgttcacgatgatcgtaccagtccgttgttttacttgtggaaaggtgattgggaacaaatgggatacataccttgaacttctccaggctgattacgctgaaggggatgctcttgatgcgcttgggttagtccgttactgctgtagacgtatgcttatgactcatgtcgatctaatcgaaaagcttctaaactacaacactatggagaaatctgaccccaattaaagaaagatgctatgatgacgaataacaaatcgtcaagagcaaaagtgaaggagtgatgcatctcattcatgtggaagtctta

SEQ ID NO: 2001 - DNA, 651 bp, Zea mays
  misc_feature (147)..(148): n is a, c, g, or t
gttcacaacctcctccacgaccaaacgatccgggttccagcggcggcggcggcggcgaagatgatcataccggtgcgctgcttcacctgcggcaaggtgattgggaacaagtggacctctacctcgacctcctccaggccgactacnntcggaaggggatgctctggatgccttggaattgttccactactgctgcaggcgaatgctcatgacccaggttgacctcattgttttatttgctcaactacaacacacttggagaagaccgagacaagttaagtgagcaagcatgtcatgctctgaaagcactactgtttcgtagtatcaccaatattgtaagcggtatgtgtgtttcttctctaccaggagaggattgttgtgagtgtagaacttgcttttgctctctagcattcaagggactgacaagggcatggttgcatctatgctacggaggtgggaggattttatcgataatcacggcttaggaaaaagaaaaaaaaaaagacctcaaggtgggggccctggtaccctatttccccctatagtggggtggtattacgccccccttccctgggcgttcctttctaacaacggcctggactgggagaaaacccctgggcgttacccaaatttaaagcggcctttgaagcc

SEQ ID NO: 2002 - DNA, 500 bp, Lactuca sativa
gggggggggaaacaaggatgattattcctgttcgttgtttcacttgcggcaaggtcattggaaacaaatgggacacgtatcttgatcttctccagtctgattacacggaaggagatgctcttgatgctttgggacttgtccgttattgttgcagaagaatgctaatgactcatgttgatctcatcgagaagcttctgaactacaacacattggagaaatctgatacgagctgaggccttgtgaagaatgttttggataaacctaaatagcttccctaatatatgataaattgtattgattaaacaaaatggattgatgtttgggttgtgttcgtctactgtgggaatattattttggtttgatggatttgtaaacttgtatctttttacaagggttgtagatccatttgaagagcattgagttctagtttatagctgcatttatttggatgttttgaaaacactatattcaaaataaacatttgaacacttcttcagaaa

SEQ ID NO: 2003 - DNA, 683 bp, Papaver somniferum
gcaatattatattagtctattccaaggggaacagttctttgactaacagttctaagacataatataaggatgagtagttaggtgcacaagttcttcggacatcaaaagaaaaagaagagacatttttacaaaaaaaaagcatgcccaactggccctcccaagtctctttctcccttgacatttaactggcatcagttttctccaaggtgttatagttgagcagtttctcaataaggtccacatgagtcatcagcattcgtctgcagcagtatctcaccaaccctagtgcatcaagagcatctccttctgtgtaatcagcctgcagaaaatcgagatacatatcccatttgtttccgatcacctttccacaagtgaaacaacgcactggaataatcatcttttcctgagaggagagagcaaaaggttaacgagcagcttctcgaaccctaatttctccaaaaagaaaaaaaagagtggtaccacaggcgagtccaagagtgagagtgagtacaaaaagggtttgagaccggttttgtggttgacgcctgactttcctttaaaaacagaagagctcttgccattactcgacatcttagcaaacaaggttaaggctgttaggagacttagagagcttttgaccaccaaactaccacatggcacattccctgtcaagattgccattc

SEQ ID NO: 2004 - DNA, 228 bp, Aquilegia formosa
atgattattcccgttcgatgtttcacctgtggaaaggtaattggtaacaaatgggatacttacctcgatcttcttcaagctgattacactgaaggagatgctcttgatgcactgggattggttcggtattgctgtagacgaatgctcatgacccatgttgacctcattgaaaagctcctcaactacaacagtataactcttttgctctctctctttctttctgtgtag

SEQ ID NO: 2005 - DNA, 429 bp, Lactuca sativa
  misc_feature (374)..(374): n is a, c, g, or t
gcgggggagggaaacaaagatgattattcctgttcgttgtttcacttgcggcaaggtcattggaaacaaatgggacacgtatcttgatcttctccagtctgattacacggaaggagatgctcttgatgctttgggacttgtccgttattgttgcagaagaatgctaatgactcatgttgatctcatcgagaagcttctgaactacaacacattggagaaatctgatacgagctgaggccttgtgaagaatgatttggataatcctaaatagcttccctaatatatgataagttgtattgataaaacaaaatggattgatgtttgggttgtgttctactgtgggaatattattttggttttgaaggatttgtaancttgtatctttttacaagggttgtagatccattagaagagcattgtgttcttgtt

SEQ ID NO: 2006 - DNA, 492 bp, Artemisia annua
gacccttcactttcttttataaacaagtccaccttttttgtctacttatttcccacagaacgaagaccagggtttataacttaagaagaaccaaagatgattattcccgttcgttgtttcacttgcggttattggaaacaaatgggacacgtatcttgatcttcttcagtctgattacactgaaggagatgctcttgatgctttgggacttgttcgttattgttgtagaagaatgctgatgactcacgtggagagaagcttctgaactacaacacgttggagaaatctgatacgagttgaggccttgtgaagttgaaattagttctgtggagaatgttccaatccccttcctaaatatgctatctagtattgtagtgattaaacagaattgaatgaacattcggctgtgtgtctatgaactgtgggaatcttatcttgatttgaaccaaaaaaaaaaaaaaaaaacatgtcggatctagaatcgtgtctgat

SEQ ID NO: 2007 - DNA, 780 bp, Solanum melongena
acagacaaatttctaagccgcagatcaattgcagtgacgacccaattgattagccacggggagaaattttgggaagcttgaaagagagttcaaattagggtttcgacgagatgatcattccagtgcgctgttttacatgcggaaaagtcattggaaacaaatgggatgaatatcttgatcttctccaagctgattactctgaaggagatgcacttgatgctctgaatttggttcgatattgctgtcgaagaatgctgatgacacatgttgacctcattgagaagcttcttaactataacagtaaacttcctctcctctcccctccatgcttatataattacgaacaagtattgattttttctttggatgaaatagataaatgttatgtacaagtattattaacatagtatacttgaaaaactcatataacctttcaattgaatcctttttggtcttttgtctttttattaaggtgaaaggtttcactgataacataaatctaaatgtgaacttgaagagttcatttcaaaaagtaaaaataaatcttcatgtgaactcgaagagttacactcacattatattctgatgtcattgatgttgaataatctacttgtttgtgttttccatagtcgtgtattcagccagtgttatcaaaagcgcacctcgaagcgaagcgaagcgaggcccttgcgctttttagatctgaagcgtgaggcgtttgaaaaagcgcgcgcttcacccttcgaagttttaatttttttttaatgtttaatagttttg

SEQ ID NO: 2008 - DNA, 659 bp, Gossypium hirsutum
gagaaagaggtaattgcaaattcgaagtcgaggcgagaccaagaagtagcggagcaagatgataattccagttcgctgcttcacctgcggaaaggtcattggtaacaaatgggacacttatcttgatcttctccaggccgattataccgaatggtttctcactacctcactgcctttatcttaatagagatgctcttgatgctttgggattggttcggtactgctgtaggagaatgcttatgactcatgttgacctcattgagaagcttctgaactacaacacattggagaagtcggagaccagttgagggaacatgtagaatctaagggtttgttgcagtttgtgtgagtgcctgtcaatgatggccgtgatctgaatccagaaaaagggaaggaaaggacttaaatagtactagtctagtttgttttctttagctctatgatggatccctgtatgtacgaaattagtgggatttgaaatgctgaaagtgattgcaatgctttgctgtatgctgggataattgtgtgatcaaagacttaacttttgttaaaaaaaacaacaaacacaacaaacaaaaccgagggggggccggtaccaaatcccccataagagacccttacaaccacggcccacttaaacccctcgactgaaaccctta

SEQ ID NO: 2009 - DNA, 496 bp, Fragaria vesca
caagaagaaagaagaagaaagatgatcatcccagtgcgttgcttcacctgcgggaaggtgattggaaacaaatgggacacttatcttgacctcctgcaagcagattacaccgaaggggatgcacttgatgccttggggttggttcgatactgctgcaggcgcatgcttatgactcatgttgatctcattgagaagcttctcaactacaatactttggagaagtcggacaacagttagaggaagcttagtatggtgtaaaaaactacgaaacaaggtgctggaagttgttgttattactttcttggttagtgtccgagtgtgtgagtacatgctttgtcttgactggagctgtattattccttagtttcatgcttggattaagtctaataggatatttcggattaatggagtatgttcctactccattttgggcttatgttataatctgtatgaccctcttaattagaatgaaagactgaatgcttgtgtgttgcgt

SEQ ID NO: 2010 - DNA, 513 bp, Gossypium hirsutum
gtcgaggcgagaccaagaagtagcggagcaagatgataattccagttcgctgcttcacctgcggaaagatcattggtaacaaatgggacacttatcttgatcttctccaggccgattataccgaagggtttctcactacctcaccgcctttatcttaatagagatgctcttgatgctttgggattggttcggtactgctgtaggagaatgcttatgactcatgttgacctcattgagaagcttctgaactacaacacattggagaagtcggagaccagttgagggaacatgtagaatctaagggtttgttgcagtttgtgtgagtgcctgtcaatgattctcaattttgtataagtggggccgtggtctgaatccagaaaaagggaagtaaaggacttaaatagtactagtctagtttggtttctttagctctatgaaggatccctgtatgtacgaaattagtgggatttgaaatgctgaaagtgattggaatgctttgctgattgctgggat

SEQ ID NO: 2011 - DNA, 472 bp, Cynodon dactylon
cccttccccttcctctccactctccaggctcccgcggcggcggcggccaagatgatcctcccggtgcggtgcttcccctgcggcaaggtgattgggaaccagtgggacatgtacctggaccttctccaggcccactaccctgaaggggatgctctggatgccttgaatttggttcgctactgctgccggcggatgcttatgacccctgttgacctcctcgagaagttgcttaactaccacacgttggagaagaccgagaccagctaagtgaccctgtgctccagaactttgtcgtttgtcagtgtcgtccagtgtggataggttatcatgagtcgtgtgatgaggtgagacttgtttctcagtgtcggtggtatgtgctgatgctactgaatcaggaaactggttgtgcgatgattatgtgaactggttgttctttaatacccaagtgttgatgtggttgtacgcattgcag

SEQ ID NO: 2012 - DNA, 574 bp, Sorghum bicolor
gaaaagtaataaatagaggaaaacctcgcaaaaaccccaccccgtcccttccccttccccttccccttcctgcaaccggcgaacccatccttccggcggcggcgaagatgatcatcccggtgcgctgcttcacatgcggcaaggtgatcggggacaagtgggatgcatacctcgaactcgtccaggcggactatgacgaggaggatgctctgactgccttgaatttaaaccgttactgctgtaggcgaatgctgatgacccatgtcgacctcattgagaagctcctcaactacaacacgctggagaagacgactgggactgacagttaataagcgaacctggcatgctcgactgctagtccatcgcccctagtacccttcatcggacttttatgctgggtgtttcctaattcctatatgtccggacaaccttattgctgttctgtgtttctcgtattctactcatgttttgctatgtgactgtgactggtcctgaatgaacaacttaatacagcaaaatcagcaagagtcatgggcgcagtaattggcatgcatctgctctgttaattgttacc

SEQ ID NO: 2013 - DNA, 1200 bp, Chlamydomonas reinhardtii
ggctgccattaaattaacgccttcctgagccgacgacgagtgacaacactgctagttcagcccactcgtttaatccaagcgctttgtattgtccaattgcatttcctaaattgtgatagcaaatcatacttcactcacaatttggagataagcagctgagggacaagggagagagcgctgcgcgagggagagcgttcttggcggcctcgcggggcctcgcgggtccagcggctccagggagatagaaaatgattatcccagtgcggtgcttcacttgcgggaaggtgattgggaacaagtgggacacctacttggacttgctccaagcaggctacagcgaacaggaggcgttggacggccttggcctgagccggtactgctgtcggcgcatgctgatgacgcacgtggacctgattgagaagctgctcaactacaacaccctggagcgcgcagctcaggcccagggcgcgcagcgtaccggacagtgagctctagcacatgtggaattggcgcgccggcgtgtcgcagccgcagcaccttcatgcggccacgcgccagttatggcgttgccgccccggaacccacctgttgggcggtgctgtgcaggggcaatgggcgtaggtttggatgtgcatgcgctgctgttatcagagaggctccgcgtgtgcttggcaacgcaactaggacgcgcatctatgtcacgttcatccccagcggcatcgtctttgttacgactaagaaattgaccacggctgagggattgaccacagcatcatgttagctgttggtatacggtgcatgtgtacgtacggatatgacgtacgtgcggtgaagcatttgaggcctagtcgtggcatcctcagcggtgtctactggtctctgctgtttgatggttttgcagtggtgtctgaagcaaatatgtgcgcggttcagagcgggccgcgcagcgcggtggagccgatgcaggtcttgccacactgagtacccacgtctgggatagcctgcatccgctgggatgcttcaggaagtggcagataatggcaaccccgaacaccttttgccaaagggtaaaaggcgacaaatgactgtccactaaggactttcacacgccttagcctacttatataggactgtcgcaaggcggaccgatgtacatgtgctgcatgaactagccaggctcctgtaaatcgctgaaacgaa

SEQ ID NO: 2014 - DNA, 233 bp, Cucumis sativus
atgatcattccggtgcggtgcttcacttgcggcaaggtgatcggtaacaaatgggacacttatctcgaccttctacaagctgactatccagaaggggaggcattggatatgttagggttagtacggtactgttgcaggagaatgcttatgactcatgtggatctcattgagaagctcttgaactacaacagtataatatttatatcctctctttctctaatttattcattaca

SEQ ID NO: 2015 - DNA, 318 bp, Zinnia violacea
acgcggggacactagagcgtcgtcaaagagaagtaaactagggcaaacatgataattcctgtccgttgcttcacctgcggcaaggtcatcggaaacaaatgggacacgtatcttgaccttctccagtctgaattacacggaagagagatgctctcgatgctttggggctggttcgttattgttgcagaagaatgctgatgactcatgttgatctcattgaaaagcttctcaactacaacacattggagaaatctgacaacagttgacgcctgattgaggatgtttgtggacaggtctctcatggatatctgattttgt

SEQ ID NO: 2016 - DNA, 3512 bp, Zea mays
ccactccactcaccacaccatccatggcgatggcgccctccacggcggccgcatccacccttctccccgtcctcctcctcatcgccaccgccacccagtgcaccgcagccgattcattctcttctcaggacgctgccgccctcctcaacctctctgcggcggtagcagacccctcgggctacctctccacgcactggactccggacaccgcggtctgctcgtggccgcgcgtgtcctgcgacgccaccgacacacgagtcatctccctcgacctctccggcctcaatctatctggccccatccccgccgccgcgctctcctctttcccgtacctccagtcgctcaacctctccaacaacatactcaactccaccgccttccccgacgagatcatcgcgtcgctcaagagccttcgcgttctcgacctctacaacaacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacattgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgtcgctcaagaacctgaccctgctgaacctcttccggaatcgcctcgccggtgagattcccgagttcatcggcgacttgccgaacctcgaggttctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctattcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgttgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcagcctccgcatcctcaactacctcaacgtttcccacaacgcgctccaaggggagattccgcctgccatcgccggaatgcagagcctgacagccgtggacttctcgtacaacaacctctcgggcgaggtcccgtccaccggtcagtttggctacttcaacgccacttccttcgcaggcaacgctggcctctgcggggcgttcctctccccgtgccgctccgtgggcgtggcgacttcggccctgggctccctctcttcgacgtccaaactcctgctcgtgctcggcctcctcgcgctgtccgtcgtcttcgcgggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccggggcaacgctggcggttcggagtgcatgtccgctatcgccggctcgtacggctacattgctcctgagtacgcctacacgctgaaggtggacgagaagagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaaggaggaggacgggggcccggagaagaagcagcagcagcagcaggaagggccacacgactcgccgccgcagcaggatcttcttagtatctagaagcgcagttgcgagagttggtcgtactgatggtacttggtagcatccctgcctgccctgttctttgagtgaagcgttggaacgtggcgtgtgtgtagtgtaactgtgtatgcaggcggtgatttatatgcatgcttcctttaagtagattgccagtagtatttgcgtatggtgagctggtcggtccttaatgtctgtccccatgtacaaaaccagatcaagatgcttgggcttccggttgagtttacgccttaggtgctgtttgtttaccctcgacattatataatccagcttaaataaatcaagagttaaacaaacaacacagattatatattaggtggattatatagtctagatgtctagattatgataatttataagcatgtcattagatgcagatatggattagaattgctagtttgtttgtttgtttgttttcgagaaaaaagaagaatcgttcctttgaaaaaaaaaaactac

SEQ ID NO: 2017 - DNA, 3269 bp, Zea mays
ggccgcatccacccttctccccgtcctcctcctcatcgccaccgccacccagtgcaccgcagccgattcattctcttctcaggacgctgccgccctcctcaacctctctgcggcggtagcagacccctcgggctacctctccacgcactggactccggacaccgcggtctgctcgtggccgcgcgtgtcctgcgacgccaccgacacacgagtcatctccctcgacctctccggcctcaatctatctggccccatccccgccgccgcgctctcctctttcccgtacctccagtcgctcaacctctccaacaacatactcaactccaccgccttccccgacgagatcatcgcgtcgctcaagagccttcgcgttctcgacctctacaacaacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacattgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgtcgctcaagaacctgaccctgctgaacctcttccggaatcgcctcgccggtgagattcccgagttcatcggcgacttgccgaacctcgaggttctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctattcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgttgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcagcctccgcatcctcaactacctcaacgtttcccacaacgcgctccaaggggagattccgcctgccatcgccggaatgcagagcctgacagccgtggacttctcgtacaacaacctctcgggcgaggtcccgtccaccggtcagtttggctacttcaacgccacttccttcgcaggcaacgctggcctctgcggggcgttcctctccccgtgccgctccgtgggcgtggcgacttcggccctgggctccctctcttcgacgtccaaactcctgctcgtgctcggcctcctcgcgctgtccgtcgtcttcgcgggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccggggcaacgctggcggttcggagtgcatgtccgctatcgccggctcgtacggctacattgctcctgagtacgcctacacgctgaaggtggacgagaagagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaaggaggaggacgggggcccggagaagaagcagcagcagcagcaggaagggccacacgactcgccgccgcagcaggatcttcttagtatctagaagcgcagttgcgagagttggtcgtactgatggtacttggtagcatccctgcctgccctgttctttgagtgaagcgttggaacgtggcgtgtgtgtagtgtaactgtgtatgcaggcggtgatttatatgcatgcttcctttaagtagattgccagtagtatttgcgtatggtgagctggtcggtccttaatgtctgtccccatgtacaaaaccagatcaagatgcttgggcttccggttgagtttacgccttaggtgctgtttgtttaccctcgacattata

SEQ ID NO: 2018 - DNA, 3871 bp, Oryza sativa
tcacagtgaacaggctcttgtatttcacttttggcaccacaccacatacaccaccactccgtcctgttcggctgcacgacccggccaagacggtctgcaaccatgtcttcaccctcatgcgaggcaaatattactgcatgaagagctccactaactgacgcgcatacaggcaagattttctccaattaatcctgcttgactgctcttatctgatgaccacgcacaacacctgctagttgatccactcttcacgccatgcatccgtgcttcacttggccacagtgtcaagccaacgtgcacctacgggctgccggcatgcactctaatcaaactaacttatgcacacacgtacactacggaataactcacacagtaaacaacaagattaagtctaacaaccgaaacagaaagaacacgcccatatatcccacgccgcccaccgaaactcggacacccactccgccaccgccaccgcctcatccatggcactggctggctccatggccgccgccgccgccacctccacccttctcctcctcctcctcctcctcctcctcgccaccgccacccatggcgccgcggccgacacagtctcgtcccccgcctcccctgaagcggccgcactcctcaacctctccgccgcgctcggtgatccctcgggctacctctccacgcactggacgcacgacaccgcgttctgctcgtggccgcgcctctcctgcgacgccgacggctcccgcgtcctctcgctcgacctctccggcctcaacctctccggcccgatccccgccgcggcgctctcctccctctcgcacctccagtcactcaacctctccaacaacatcctcaactccaccttcccggagggcctcatcgccagcctcaagaaccttcgcgttctcgatttctacaacaacaacctcaccggcgctctcccggccgcgctccccaacctcaccaaccttgttcacctccacctcggcggcaatttcttcttcggcagcatccccaggtcgtacgggcagtggagccggatcaagtacctggctctctccggcaatgagctcaccggggagataccgccggagctcggcaacctgacgacgctcagggaactgtacctcggctacttcaacagcttcaccggcgggataccgccggagctcgggaggctgaaggagctcgtgcggctcgacatggcgaactgcgggatctccggtgtggtcccgccggaggtggcgaacctgacgtcgctcgacactctgtttcttcagatcaacgctctctccgggcggctgccgccggagattggcgcaatgggggcgctgaaatcgctcgacctgtcgaacaacctgttcgtcggggagatccccgcgagcttcgcgtcgctcaagaacctgacgctgctgaacctcttccggaatcgcctcgccggcgagattcccgagtttgtcggcgacctgccgaacctcgaggtgctgcagctgtgggagaacaacttcaccggtggagtgccggctcagctcggcgtggcagccaccaggctgaggatcgtcgatgtgagcacgaacaggctaaccggcgttctaccaacagagctctgcgccggcaagcggctggagacgttcattgcgctggggaactcactgttcggcagcattcccgacgggctcgccgggtgcccgtcgttgacgaggcttcgtcttggagagaattatctgaacgggacgataccggcgaagatgtttacattgcagaacctgacgcagatcgagctgcacgataatttgctctccggcgagctccggctggacgccggcgtggtgtcaccatcaataggagagctgagcttgtataacaatcggttgtccggtccggtgccggtggggatcggtggtctcgtcgggctgcagaagttgctggtcgccgggaaccggttgtccggcgaactccctcgtgagattgggaagctgcaacagctttcaaaggcggacttatctgggaacctgatctccggggagatacctccggcgatcgccggatgccggctgctcaccttcctcgacctctctggcaacaggctctccggcagaatcccgccggcgctcgccgggctacgaatcctcaactatctcaatctgtcccacaacgcgctcgacggggagattccacctgctatcgccggaatgcagagcctaacagccgtcgacttctccgacaacaatctctccggcgaggtcccggcgaccggccagttcgcctacttcaacgccacgtcgttcgccggtaacccaggcctctgcggcgccttcctctccccgtgccgctcccacggcgtcgccacgacgtcgaccttcggctccctctcgtcggcgtcgaagctgctcctcgtgctcggcctcctcgcgctgtccatcgtgttcgccggcgcggcggtgctgaaggcgcggtcgctgaagcggtccgccgaggcgcgcgcgtggcggctcacggcgttccagcgcctcgacttcgccgtggacgacgtgctggactgcctcaaggaggagaacgtgatcggcaagggcgggtcagggatcgtgtacaagggcgcgatgcccggcggcgcggtggtggccgtgaagcggctcccggccatggggcgctccggcgcggcgcacgacgactacggcttctcggcggagatacagacgctggggcgcatccggcaccgacacatcgtgcgcctgctcgggttcgccgccaaccgggagacgaacctgctggtgtacgagtacatgccgaacggcagcctcggcgaggtgctccacggcaagaagggcggccacctgcagtgggcgacgcggtacaagatcgccgtggaggccgccaagggcctctgctacctgcaccacgactgctcgccgccgatcctgcaccgcgacgtcaagtccaacaacatcctcctcgacgccgagttcgaggcgcacgtcgccgacttcggcctcgccaagttcctccgcggcaatgccggtggctccgagtgcatgtccgcgatcgccggctcctacggctacattgctcccgagtacgcctacacgctcaaggtggacgagaagagcgacgtgtacagcttcggggtagtgctactggagctcatcgctgggcggaagccggtgggagagttcggcgacggcgtggacatcgtgcactgggtgcggatggtgaccgggtcgagcaaggagggcgtcacgaagatcgccgacccacggctctcgacggtgcccctccacgagctgacgcacgtcttctacgtcgccatgctgtgcgtcgccgagcagagcgtcgagcggccgacgatgcgggaggtcgtgcagatcttgaccgacctgcccggtacggcggcggcgacggccatggacgcgccgtcgcacgggtcggggaaagagcaagaccggagcgcggagatgcagcagcaggacgggtcacgcgagtccccgccacagcaggatctccttagcatctagaagcgtgcgtgcatgtccccgttgtaccggtactccgtagcatcatcccctgtacgtcttggcgtactcctggactgtgctggtgtcctggactgtgctggtgtccgggtccgagtccaagtagaggcaaatctccaatatttgcggtagtattgttagctagattaagattatattgttacataatggtggttgataaaatctactactagtagtatgtaatctgtctcctctcgtgtacaaagcaactactcctactccagtccagtatatgcctctccaaccaattggattgagatcgtatcgatctcgcaacaaaaaaaacacggacacacatggcctattggccagtgcgtcatactgtc

SEQ ID NO: 2019 - DNA, 3273 bp, Brachypodium distachyon
atggcacgctccatggccatggccgccactcctacctttctcctcctcgtactcatcttcctcctggccaccgcgacctgctccaccgccgccggctcatccccctccaacgcctccttggaagccgccgccctcgccaacctctccgcggcgctcgccgatccatcgggctacctttccgcgcactggacgccggtcacgccgctctgctcgtggccgcgcctctcctgcgacgccgccggctcgcgcgtcatctccctcgacctctccgccctcaacctctccggccccatccccgccgccgccctctcctccctgacgcacctccagtccctcaacctctcaaacaatctcttcaattcgacattcccggaggcgctcatcgccagccttcccaacattcgcgttctcgacctctacaacaacaacctcaccggcccgctcccttcggcgctccccaatctcacgaacctcgtgcacctccacctcggcggcaatttcttctccggcagcatcccggggtcgtacggccagtggagccgtatccggtacctggccctctccggcaacgagctcacgggggcggtaccgcctgagctcggcaacctgaccacgctgagggagctgtacctcgggtacttcaacagcttcactggcgggataccccgggagctcgggaggctgcgggagctcgtgcggctggacatggcgagctgcgggatctccggaacgatccccccggaggtggcgaacctgacgtcgctcgacactctgtttcttcagatcaacgcgctgtccgggaggctgccgcctgagataggcgcaatgggggcactcaagtcgctcgacctgtccaacaacttgttcgtcggggagatccccgcgagcttcgtgtcactcaagaacatgacgctgctaaacctcttccggaaccgcctcgccggtgagattcccgggttcgtcggcgacctgccgagcctcgaggtgctgcagctgtgggagaacaacttcaccggcggagtgcccgcgcagctgggcgtggcggcgacgaggttgaggatcgtcgacgtgagcacaaataagctcacgggcgttctcccgaccgagctgtgcgccggcaagcggctggagacgttcatcgcgcttgggaattctctgtttggcggcattccggacgggctcgccgggtgcccatcgttgacgaggattcgtctgggagagaattatctcaatgggaccataccggccaaattgttctcgctgcagaacctgacgcagatagagctgcacgacaatttgctgtccggtgagctccgtctggaggccggcgaggtgtcgccatcgatcggggagctgagtctatataacaaccggttgtccggcccggtgccggcggggatcggcgggctctcggggctgcagaaactgctgatagccgggaacatattgtccggcgagctcccgccggcgatcgggaagctacagcagctctcgaaggtggacctctccgggaaccggatatccggggaggtgcctccggcgatcgccggatgcaggctgctcaccttcctcgacctgtccggcaacaagctctccggcagcatccccacagcgctggccagcctgcgaatcctcaactacctcaacctgtccaacaacgcgctcgacggggagatcccggcttcgatcgccggaatgcagagtttaacagccgtcgacttctcgtacaacgggctctctggcgaggtcccggccacgggccaattcgcctacttcaactccacttccttcgccggcaaccccggcctatgcggggcattcctttccccgtgccgcaccacccacggcgtcgccacgtcgtcggccttcgggtccctctcctcgacctcgaagctcctcctggtccttggcctcctcgcgctgtccatcgtcttcgcgggtgcggccgtgctgaaggcgcggtccctgaagcggtccgctgaggcgcgcgcgtggcggatcacggcgttccagcggctggacttcgccgtggacgacgtgctggactgcctcaaggacgagaacgtgatcggcaagggcgggtccggggtcgtgtacaagggcgccatgccggggggcgccgtggtggccgtgaagcggctgctctccgccgcgctcgggcgctcggcggggtccgcgcacgacgactacggcttctccgccgagatacagacgctggggcggatcaggcaccggcacatcgtgcggctgctcgggttcgcggccaaccgcgagaccaacctgctggtgtacgagtacatgcccaacggcagcctcggcgaggtgctccacggtaagaaggggggacacctgcagtgggcgacgcggtacaagatcgctgtcgaggccgccaaggggctctgctacctgcaccacgactgctcgccgccgatactgcaccgcgacgtcaagtccaacaacatcctcctcgacgccgacttcgaggcgcacgtcgccgacttcggcctcgccaagttcctccacggcagcaacgccgggggctccgagtgcatgtccgcgatcgccggctcctatggatacatcgctcctgagtacgcctacacgctgaaggtggacgagaagagtgacgtgtacagcttcggcgtcgtgttactagagctcattgccggccgcaagccggtcggtgagttcggcgacggcgtagacatcgtgcaatgggtgcggatggtggccggctcgaccaaggaaggcgtgatgaagatcgccgaccctcgcctctcgacggttcccatccaggagctcacgcacgtcttctatgtggcgatgctctgtgtcgcggagcagagcgtcgagcggcctacaatgcgggaagtcgtgcagatcctaactgacttgcctgggacgacgacgtccatgagcctgccgccgcccgacctcgaagaaggaagagaggagaaccagggacatgagcagcagcagggggagccacacgactctccggcacatcaggatctccttagcatctaggagtgttttgctcgtagtatagtagtggcagtaccttgtagcatcccatgtaccttgtggtgtactctttagaatgtggtagtgtgtccggaagcgtgtgcaaggggaggcaaagcatgtgctagattagtgttccagtatgataaatcgtggattggaaccgtgtaatcactgtattgtcttcttgtacaaagcagctagttggtctccaatggaaaaaaaaaaacaacggcaaaccgtgcacgt

SEQ ID NO: 2020 - DNA, 4185 bp, Zea mays
aaatgtaggtgtaactccaaaatcctacttactgctgggccccaagaattcgatgcagcccagcccaaccacctcccagcttatccttctcccggtctccctcggctccgctctgccgcagccgcgggaaatggtcgcgctccacctccacgccaagcaacccacgcctcgtctcctccccgttccaccgagccatgcccgtacccgtacgcccacggcggcggcggtcaacgtgagccacgctgcgcctccgcccgacgtcgtcctcgactgcaaacggctggacgggctgatgaagtccgggaggctgggggacgccctggacctgttcgatcggatgcctcgcaagaacgtcgtcgcgtggaccacggccatctccgggtgcacgcggaacgggcgccccgaggcggctgcgaccatgttcgcggacatgctggagtccggcgtcgcgcccaacgacttcgcgtgcaacgcggcgctggcggcgtgcgcggccgctggcgcgctcggcctcggcgagcaggtgcactcgctcgccgtgcgggcgggcttcgcggccgacgcctggatcggaagctgcctcatcgagctctactcgaggtgcggctccctgcgggcggccgaggaggtctttcgccggatggaggcgccggacgtcgtggggtacacctcgctcgtctcggcgctctgccggaacggagagctcgcacgggctgtggatgtgctctgccagatgacgaggcaggggttgcagccgaacgagcacacgatgacgagcatgctggcagagtgccctcgtggaattggtgagcagatacatggatatatgctcaaggtaatgggttcgcagagcgtctatgcatccactgcactgatcgacttctactcgaggtacggtgactttggcacggcgaaaacggtctttgaaaatcttgagtccaagaacgtggtgtcgtggtgctccatgatgcagctgtgcattagggatggaaggttggacgatgcgctgcgagtgttcagtgagatgatttcagagggcgtccagccaaatgaatttgcgttctcaatcgctcttagtgcctgtgggtctgtttgtctggggcgtcaaattcactgctcagccatcaagcgtgacttaatgactgacatccgagtatctaatgctttactctctatgtatggtaggagtggttttgtttcagaactcgaggctgtgcttggcaagattgaaaatcctgatcttgttagctggacagctgccatttctgcgaacttccagaatggtttcagtgagaaggctgtagcattgcttcttcagatgcattcagagggttttacaccgaatgactatgccttctctagtggtctgagttcttgtgcagacctggcattgctgcatcaaggaaggcagcttcattgcctggcactgaaactggggtgtgacttcaaagtttgtactgggaacgcactaattaacatgtattccaagtgtggtagaattggatctgcaaggcttgcatttgacgtcatggatactcatgatgtcatgtcttggaactcattgattcacggtctcgcacagcatggtgacgcaaacttggcactggagacattcagtgagatgtgctcaagcgattggcggccagacgattcaacatttctgtcagtcttggtagggtgcaatcatgcaggtctggtaaaggaaggggagacctttttcagacaaatgactgaccggtatggtctcacaccgaccccttctcactacgcatgcatgatcgacatgctgggtcgaaatggcaggttcgccgaggcgctacgcatgatcgagaatatgccattcgagcctgatgttttgatttggaagacactattagcatcatgcaagctgcacaggaatcttgacatcgggaagctcgcagcagataagctgatggagctttcagaaagagactccgcgagctacgtgctcatgtcaaacctctatgcgatgcatgaagaatggcgggatgccgagagggtgcgtcggaggatggatgaaattggggtgaagaaggatgccggttggagctggattgaggtcaagaacgaggtcaacacctttgttgcaggagacatgtctcatccagactccacatccatctatcagatgcttgcagagctccttgttgtgatgcaagatacagatttagatgttcatatgcagatttagatgtccaaaaagagaacataccacttgcagacattacatgtacagggtacaacagcacatagcgcctgattggttgctcatctgggtggagcctggtccaaacctggatgcaggctgagaccagcctatatgtgtggatgcaagtgccaagtttgcttgcatgtttggttggatgtaccaaagcagccatgatttaatgggcacatgtttggttaaacaacaccaagtcggcgaatgttttttacaagaggttgcggagcgggcgttatttttgtggaataatgaccatatcgagagtctgatcaaacagaatagtagggttatacatctaagtggcttttccttgccatctgggatggcctatggtggtgcaacaacagtcaaaatcttctatcaacggcgtcgaaaaaccactgctggaaataatattgctacaattaatgatgatgatattgcggaggctcatgcttgggattgggcttggatgttgatgtgacagcggttactccgtctgaccccccctcggacgtggaaggcgctgctgatactccgtctgagaccatctcaagatttcaggggccattattattagagtacaatggaacagcgaggagggctgacgcagactcaactgttccactcaggcatgaggtggtagcctttgatgacagttccaggcagaattttggggattcatgtgactcctcattggatccattatcttctatggaatctagaagaagatcattcatggctaagataacaatggcacattcacagctccttgctgctcctgtcctccccaagcggtcaaggggtgccacaaaacatggtactgcgctacgacggagccgacgggttgcaggggcaggggtggaatttaacatgcaggatctggagaacagagccacaaaacaagtaatgcggactctgagagtcatcacagagaatgcaagcatcaaccagcaagctgttaaggattatgagaatctttttcagcatcccttaactcaaagtcatgttgaagcgttagcggctctctttggatgggagactccggggaatctcttcccgtagtgtgtttttctttctgggttgtaatttataattgttgtaatggatcctagcaaaattatatgttggaatgtgagaggtttaaattcagctgatcgtcaaaattcagtccggaatctagttctgtcctctaaagctgatgtggtctgtctccaggaaactaaaatgactgtcatttctacaagaaccattcttgcagccttgggttcggatttctgccagttctcctttctaccatcttgtggtgctagtggtggtgtgctggttgcttggaagcgacatctgggagtgactgggttgtctaggattgacagatacagcatttcaatccaattctgcaatgcgcataatcgctgttggtggttaacttgtgtttatggtcctcaaagtaacagtgataagatgttgtttcttcaagaactgagagacatcagggctgcttgcactggaccctggttgattgctggtgacttcaatctcatctacagggcttcagataaaaataattcaaatattaacagagctatgatggggagatttaggaagttggttgaggacttgagtctcaatgaggttccactttttgggcgtaaatacacgtggtcaaatcagcaagacagtcctgttcttgttaagcttgacagggtcctctgttcagtggagtgggaagacaattttccaaatgtccttcttcaaagtgctgcctctgaaggctccgaccattgccccttgctgcttggcattagagataataaaatgggtaaaagacgtttctgttttgaagctttttggcccaaattggaaggattccaggatgtcatccaggaggtttgggattctgtggcagctgtaaactgccctttcatgactaatgaatttgaaactaaaagccacagcta

SEQ ID NO: 2021 - DNA, 1881 bp, Sorghum bicolor
atggtcgcgctccacgcgaagcagcccacgcttcgtctactccccgcgccaacgagccatgcccgcccgctcgcggcggcggcggcagtggccaatgtacgcctcggtgcgccgccgccgcctcacgtcgtcctcgactgcaaacggttggacgggttgatgaagtccgggaggctaggggacgcgctggacctgttcgaccgtatgcctcgcaagaacgtcgtcgcgtggaccacggccatctccgagtgcacgcggaacgggtggctcgaggcgaccgcggccatgttcgcggacatgctggagtccggcgtcgcggccaacgacttcgcgtgcaacgcggcgctggcggcgtgcgcggccgcgagcgcccacgcgctcagcctcgacgagcaggtgcactcgctcgccgtgcgggcgggcttcgccgccgacgcctggatcgggagttgcctcatcgagctctactcgaggtgcggctccctgcgggcggctgaggaggtaatgggttcacagagcgtctatgcatcgactgcactgattgacttctattcgaggcacggtgactttgacatggcggaaacagtgtttgaaaatcttgactccaagaacgtggtgtcgtggtgctccatgatgcagctgtgcattagggatggaaggttggaagatgcactgcgagtgttcagcgagatgatttcggaggccgttgagccaaatgagtttgcattttcaattgctctcggggcttgtgggtttgtttgtctggggcgtcaaattcactgctcagtcatcaagtgcaacttaatgactgacatccgagtatcaaatgctttgctctctatgtatggtaggagtggttttgtttcagaaatcgatgctgtgcttggcaagattgaaaatcctgatcttgttagctggacagctgccatttctgcgaacttccagaatggtttcagtgagaaggccgtggcattgcttcttcagatgcattcggaaggttttacaccgaatgactatgccttctctagtggtctgagttcttgtgcagacctggcattgttggatcaaggaaggcagcttcattgcctggcactgaaactggggtgtgacttcaaagtttgtactgggaatgcactaatcaacatgtactccaagtgtggtcaaattggatctgcaaggcttgcatttgatgtcatgaatcttcatgatgtcatgtcttggaactcactgatccatggtctcgcacagcatggagctgcaaacttggtactggaggcattcagtgagatgtgttcaagtggttggcagccagacgattcgacatttatagcagtcttggtagggtgcaatcatgcaggtctggtgaaggaaggggagacattcttcagactaatgactgatcggtatggtctcacaccgaccccttctcactatgcttgcatgatcgacatgctgggtcggaatggcagattcgatgaggcgctacacatgatcgagaatatgccattcgagcctgatgttttgatttggaagacactattagcatcttgcaagctgcacaagaatcttgacattggaaaactcgcaacagacaagctgatggagctttcagaaagagactccgcgagctacgtgctgatgtcaaacctctatgcgatgcatgaagaatggcaggatgcggagagggtgcgtcggaggatggatgaaattggggtgaagaaggatgccggttggagctggatcgaggtcaagaacgaggtttgcattgtttcgttcgtcagattcttctgcgctttcgagccgtcaatgaggccagcatgggccaaagagaattgtcgacctgctcagaccagatggggagcttattaccctcatgtaacc

SEQ ID NO: 2022 - DNA, 2402 bp, Zea mays
tttttttatgatggaaacatccgcctgagcctcctctttctgaggaaaaaatcacctccaaactccgaccgagcatcttccccgggccggtaggccttatccggtttcttcttgcacctctccagtgagccagtcaccgccagtccacgccatggcttgtcgcgccactctcctgcctctcttcctcttcctcctcgtggcgcccgagcctgcgctcgccacatccggcaccatcgtcttcaccacgctgggccggagccgctacgcctttgacgtcttcgcgctcacgatcgccccgctctccgccgcctccgcggagctgcgcctcacggacggcgcctccgtcaactacaacggcaacttcgcgccctcctcctccggaccgccctccctcctcttcgtctccgagcgcaacggctcgctcaacctctacctcacccccgtccccacatccgcctccgcccgtcgccgcgacgcgctggaggaggaggaggaggactcggcgccgcccacgccgctgctcccgtgggaccctatcgcgctcaaggaccggccttcgctcacccccgacggcgcccacctagtgtacgtctccacggcggagcccgcgggggcgccgcgccggagctgggcggccgtgtactccacgagcctggcccccggccgcgccacgcgccgcctcaccccgcggggagtcgccgacttcagccccgccgtgtcgccgtccggggtctggaccgccgccgcgtcacccggcccgcgcggctgggccggcgaggtggaggacctccgcaccgacatctacgtcttccggacctccgacgggtcgcgccgggcgctggccgtcccggacggcgggtggccgacctgggccgacgacaccaccgtcttcttccaccgccgggacgccgacggctggtacggcgtgtaccgcgccaggctcaccttcacggacgacgacgtcgcgtccgtcgtcgaccggatcaccccgccgggtttccacgcgttcacccccgccgcgtcgcccggcgcgccggggctcgtggccgtggccaccaggcgcccgggttccgactaccgccacatcgaggtcatcgacttgtccggcggcggcggcggcgccaacaacaggagcgcctactacgaggtgacccggcccgtggccccgcgcgcgcaccacttcaacccgttcatctcgccggacggcgagcgcgtcgggtaccaccggtgccggggcagcgggaacggggactcgccgctgctgctggagagcatcaagggccccgcgccggacacgttctcgctcttcaggatcgacgggtcgttcccctccttctcgcacgacggcaagaggatcgccttcgtcgggctgccggggctgtacgtggtcaactccgacggctccggtggccgccgccgggtcttctcgggcaacgcgttcccgacgacatgggactggaagaggaaaggggtcatctacaccagcgtcggcccagacttcgcgagcgagagcaccgaggtggacgtggtcgccgtgtcgctcggcgacggcgacggcgacgaccccagcgtctccatcaagaagctcaccgtgggcggcgagaacaacgcgttcccgtccccttcgcccgacggcaagtgggtggtgttccggtccgggcggtccgggcacaagaacctctacatcatggacgcggaggacggcgaggccggcggcatccggcgcctcaccgagggtccttggtccgacaccatgtgcaactggtcccccgacggcgagtggatcgcgttcgcctcggaccggcacaacccgggcggcggcagcttcgccatctacatggtgcacccgaacggcaccggcctgcggagggtggtgcacagcgccgacggcggccgcaccaaccacccctggttcagcccggactcgaagacgctggtgttcacgtcggactacgccgccgtgtccgcggagcccatctccaacccgcaccactaccagccctacggggagatcttcaccgtaaacatcgacgggtctggcatccgccggctcacgcacaactccttcgaggacgggacgccgtcgtggacgccgtaccacctcaaggcggaggacgtgggcgagacgctgcaggcctccgggacgtgcgcgttcgaggactgccactggctcaacatcgctgcccggcctgatggcctcatgtgtggcaagcacgcctagttatagtatctgtgggagaaatgggactcacgtatatatgtgtgctgtgtatatagtgcggtgatgccatcttgtttgcttgcatatgcatactactgaacatatgatgatgaataaggtcatgccaactttagggcaaaaaataaacatacttatgatgacgctttacatttatactggc

SEQ ID NO: 2023 - DNA, 2378 bp, Zea mays
tttttttatgatggaacatccgcctgagcctcctctttctgaggaaaaaatcacctccaaactccgaccgagcatcttccccgggccggtaggccttatccggtttcttcttgcacctctccagtgagccagtcaccgccagtccacgccatggcttgtcgcgccactctcctgcctctcttcctcttcctcctcgtggcgcccgagcctgcgctcgccacatccggcaccatcgtcttcaccacgctgggccggagccgctacgcctttgacgtcttcgcgctcacgatcgccccgctctccgccgcctccgcggagctgcgcctcacggacggcgcctccgtcaactacaacggcaacttcgcgccctcctcctccggaccgccctccctcctcttcgtctccgagcgcaacggctcgctcaacctctacctcacccccgtccccacatccgcctccgcccgtcgccgcgacgcgctggaggaggaggaggaggactcggcgccgcccacgccgctgctcccgtgggaccctatcgcgctcaaggaccggccttcgctcacccccgacggcgcccacctagtgtacgtctccacggcggagcccgcgggggcgccgcgccggagctgggcggccgtgtactccacgagcctggcccccggccgcgccacgcgccgcctcaccccgcggggagtcgccgacttcagccccgccgtgtcgccgtccggggtctggaccgccgccgcgtcacccggcccgcgcggctgggccggcgaggtggaggacctccgcaccgacatctacgtcttccggacctccgacgggtcgcgccgggcgctggccgtcccggacggcgggtggccgacctgggccgacgacaccaccgtcttcttccaccgccgggacgccgacggctggtacggcgtgtaccgcgccaggctcaccttcacggacgacgacgtcgcgtccgtcgtcgaccggatcaccccgccgggtttccacgcgttcacccccgccgcgtcgcccggcgcgccggggctcgtggccgtggccaccaggcgcccgggttccgactaccgccacatcgaggtcatcgacttgtccggcggcggcggcggcgccaacaacaggagcgcctactacgaggtgacccggcccgtggccccgcgcgcgcaccacttcaacccgttcatctcgccggacggcgagcgcgtcgggtaccaccggtgccggggcagcgggaacggggactcgccgctgctgctggagagcatcaagggccccgcgccggacacgttctcgctcttcaggatcgacgggtcgttcccctccttctcgcacgacggcaagaggatcgccttcgtcgggctgccggggctgtacgtggtcaactccgacggctccggtggccgccgccgggtcttctcgggcaacgcgttcccgacgacatgggactggaagaggaaaggggtcatctacaccagcgtcggcccagacttcgcgagcgagagcaccgaggtggacgtggtcgccgtgtcgctcggcgacggcgacggcgacgaccccagcgtctccatcaagaagctcaccgtgggcggcgagaacaacgcgttcccgtccccttcgcccgacggcaagtgggtggtgttccggtccgggcggtccgggcacaagaacctctacatcatggacgcggaggacggcgaggccggcggcatccggcgcctcaccgagggtccttggtccgacaccatgtgcaactggtcccccgacggcgagtggatcgcgttcgcctcggaccggcacaacccgggcggcggcagcttcgccatctacatggtgcacccgaacggcaccggcctgcggagggtggtgcacagcgccgacggcggccgcaccaaccacccctggttcagcccggactcgaagacgctggtgttcacgtcggactacgccgccgtgtccgcggagcccatctccaacccgcaccactaccagccctacggggagatcttcaccgtaaacatcgacgggtctggcatccgccggctcacgcacaactccttcgaggacgggacgccgtcgtggacgccgtaccacctcaaggcggaggacgtgggcgagacgctgcaggcctccgggacgtgcgcgttcgaggactgccactggctcaacatcgctgcccggcctgatggcctcatgtgtggcaagcacgcctagttatagtatctgtgggagaaatgggactcacgtatatatgtgtgctgtgtatatagtgcggtgatgccatcttgtttgcttgcatatgcatactactgaacatatgatgatgaataaggtcatgccaactttagggcaaaaaataaacatacttatga

SEQ ID NO: 2024 - DNA, 2344 bp, Panicum virgatum
ctagacctctagtgcccactggccgccacgccgtcccgctcgctcacctcggccgccatgactccccgcgccacccggctgctgctcttcctcctcgtcgggctactcgtcctcgccgcgccagcgccagcgctcgccgccgacggcaccatcgtcttcaccacgctgggccgcagccgctactccttcgacatcttcgcgctcccgatcgccccgctttcctcctcctcctcccctgccgccgaggctcgcctcaccgacggcgcctccgtcaactacaacggcaacttcgcgccgtccggggactccctcctcttcgtctccgagcgcaacggcaccctcaacctctacatctcccccgtcccctccgcctccggctcccgccgcgaggcgctggaggtgcccgaggcggcgccgctcacgccgctgctcccgtgggaccccatcgcgctcaaggaccgcccgtcgctgacacccgacggcgccaacctcgtgtacgtctccaccgccgatcccgcggaggccccgcgccggagctgggcggccgtctacaacacgcacctgccctccgggtccacgcgccggctcaccccgcgcggcgtcgcggatttcagccccgccgtgtcgccgtccggggagtggacggccgccgcgtcgccgggccccgacgggtggggcggcgaggtggaggatctcgacaccgacatctacgtcttccggacgcccgacgggtcgcggcggacgctggccatctgcgacggcggctggccgacctgggccgacgagacaaccctcttcttccaccgccgcgacagcgacggctggtacggcgtgtaccgcgccaagatctcgttcgcgggcgacgccggtgtgtccgcggcgtccgtcgagcgcgtcaccccgcctgggttccacgcgttcaccccggccgcgtcgcccggcgcgccggggctcgtggcggtggcgaccaggcgtcccggctcggactaccgccacatcgaggtcatcgacgtgagcggcggcggcgcgaacgcctacttcgaggtgaccaggcccgtggcgccgcgcgtgcaccacttcaacccgttcatctcaccggacggcgtgcgcgtcgggtaccaccggtgccgggggagcgggaacggggactcgccgctgctgctggagagcatcaagagccccgcgccggacacgttctcgctgttcagaatcgacgggtcgtacccctccttctcgcacgacggcaagaggatcgccttcgtcgggctaccggggctgttcgttgtcaactccgacggttccggtggtcgccggcgaatcttctctggcaacgccttccccacggcatggggctggaagaggaagggggtcatctacaccagcatcgggccagacttcgcgagcgagaggacagaggttgacgtggccgccgtgtcgcttggcgacgacgacgacgaggaggattcgaacatctcgatcaagaagctcaccgtgggtggcgggaacaacgcgttcccgtccccctcgccggacggcaagtggatagtgttccggtccgggaggtccgggcacaagaacctctacatcatggacgccgaggacggcgaggccggcggcatccggcgcctgaccgaggggccctggtcggacaccatgtgcaactggtcccccgacggcgagtggatcgcattcgcctccgaccggcacaacccgggcagcggcagcttcgccatctacatggtccacccgaacggcaccgggctgcggcgggtggtgcacagcgccgacggcgggcgggcgaaccacccctggttcagcccggactccaagtccctggtgttcacgacggactacgctgccgtgtccgcggagcccatctcgaacccgcaccactaccagccctacggcgagatcttcaccgtgaacatcgacggctcgggcatccggcggctcacgcacaactcgttcgaggacgggacgccggcgtggacaccctactacctgaagccggaggacgtcggcgagacgctgcaggcctccgggacgtgcgcgttcgaggattgccactggctcaacatcgatgcccagccacatggcctcatgtgtggcaggcacgcctaagttcatgcatgtatgttggtaactaggtaaatagcgaccagcgagagcagtatatctatgtttgctcgcctatgattctatgaataaggccatgtacagtcatgccagttttacggcgacaataacctgattagaacatagtactcattatgaagtttacttgccagtattatggccactcgtcgtgtattggttaacttgtcgtggttgtaacaatttaact

SEQ ID NO: 2025 - DNA, 2154 bp, Zea mays
atggaccacacctgtcagaaaagatagccggaagccggaaaaaccctcgtctcccgtctcggagcggcggagtacgcacctatcagtcccaagttcccgccacacacctctccattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggccaattgatgccaaaggcaagagagcatttaaagtccttgtgttaaatgaggtcgacaagctctcacgagaagcccagcattccctccgcaggactatggaaaagtatagctcatcatgtagactgatcctatgctgtaacagctcctcaaaagtgacagaagctgtaagatcccgttgcttaaatgtgcgagtaaatgcacccagcgaagatcagattgtccaagttctagagttcattgggaagaaagaaaatctgcatcttccagctggatttgctgctcgtatcgccgcacaatcaaaccgtaatcttaggcgggcaattctgttttttgagacttgcaaagtgcaacaatatccatttacatcaaatcaagtggcgcctcctcttgactgggagcaatatgtgtctgaaatagcaactgatatacttacagaacaaagccctaaaaggctatttgctgtacgccagaaattctatgaattactcgtcaattgtatcccacccgaaagtattttgaagaagttgttggcagaattactgaggaagttagatgcggatctgaaacatgagatctgtcactgggccgcacattatgaacacaagatgcgcctcggatcaaaggctatttttcatctagaagctttcgtggccaagttcatgagcgtttacaaggagttcctggtggcgacatttggttgagcaaaacctcaaggcattgggttgccacccgcgaagcgaagagaggatggcagcggctatcgcactgtatcaggcagtgtcttgcctgtgtagttttgtactgaagttgtgaacgattagcttcattgtgtctgtttaaaccaccgtcaactcgggtcgcccttctgtgagttcatcgcgtccgcctgcacgtggtcgttgatgacgacacgatcagaagttgtgaacgactagtagtttttgcttggttaagaaaaaacatcctgaaaagtaaaaaagtaacagtctgtgaacggaaccgtaacaagaaaaacgaaacaagcagatgccaatcatgctattgcaatttgcaagagtcgtcccagattaaaattcaaatagctgtatccattttacactaccacagtttgattacaaaggttagtgcttgcaggatcgcgtctcagacccttggcctcaccctgcgaccgctggtgtcgccgccgtcagagagctgcgcccatacgctctggcttttcacgccgctgctacattgttcctcacatccggcaactgtccgcagtatctctgactgcagggatgggcagttgtctttgagatagtcgaacccctcggtccggatcacagctgcagatacataagggcatctggaatgttatacagttcaaacttatttgggcaccaccaagcaacaaacgagcgatagatcaaggtacaaaatataccgaaaaaagctaaaatatggtacacagtacaatttactgaaggtaaggtaggagtgtacggtatgataatgttccaaccgtaagcaataaatgtctgaaatttacaaagttatcaccactcgtagtccagtaaccattaagtttataaccatgaat

SEQ ID NO: 2026 - DNA, 1422 bp, Zea mays
atggaccacacctgtcagaaaagatagccggaagccggaaaaaccctcgtctcccgtctcggagcggcggagtacgcacctatcagtcccaagttcccgccacacacctctccattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggccaattgatgccaaaggcaagagagcatttaaagtccttgtgttaaatgaggtcgacaagctctcacgagaagcccagcattccctccgcaggactatggaaaagtatagctcatcatgtagactgatcctatgctgtaacagctcctcaaaagtgacagaagctgtaagatcccgttgcttaaatgtgcgagtaaatgcacccagcgaagatcagattgtccaagttctagagttcattgggaagaaagaaaatctgcatcttccagctggatttgctgctcgtatcgccgcacaatcaaaccgtaatcttaggcgggcaattctgttttttgagacttgcaaagtgcaacaatatccatttacatcaaatcaagtggcgcctcctcttgactgggagcaatatgtgtctgaaatagcaactgatatacttacagaacaaagccctaaaaggctatttgctgtacgccagaaattctatgaattactcgtcaattgtatcccacccgaaagtattttgaagaagttgttggcagaattactgaggaagttagatgcggatctgaaacatgagatctgtcactgggccgcacattatgaacacaagatgcgcctcggatcaaaggctatttttcatctagaagctttcgtggccaagttcatgagcgtttacaaggagttcctggtggcgacatttggttgagcaaaacctcaaggcattgggttgccacccgcgaagcgaagagaggatggcagcggctatcgcactgtatcaggcagtgtcttgcctgtgtagttttgtactgaagttgtgaacgattagcttcattgtgtctgtttaaaccaccgtca

SEQ ID NO: 2027 - DNA, 1566 bp, Zea mays
ccggaaagcccgcaaaaacccttgtctgccaactgctgtctcgcaagtcgcaacggctgagtgcgcgcccatcagtcccgggttcccgccacacccctcccatccccctctcaatcctgtccccaaatctctctcttctctctagcggcgaggcgaggcggtgaagacgagcgagcggcgaggatgttgtgggtagacaagtaccggccgaaaaccctagacaaggtcaccgtccacgaccaggttgcgcggaacctcagaaagttcgtgtcggagcaggattgcccgcacctgctgttctatgggccgtcggggtccgggaagaaaaccctaatcctcgcgctcatcaagcagatgtttggcgccggcgcggagaaggttaagctggagaataagacatggaaaattgatactggaacaaggacacttgagatagaattggcgatgttgtcaagtgctcaccatgtagagatgaaccccagtgatgctggctttcaggacaggtatgttgtccaggagatcattaaagagatggccaagaacaggccaattgatgccaaaggaaggagagcatttaaagtccttgtgttaaatgaagttgacaagctctcaagagaagcccagcattccctccgtaggactatggagaagtatagctcatcatgcagactgatcctatgctgtaacagctcctcaaaagtgacagaggctgtaagatcccgttgcttaaatgtgcgagtaaacgcacccagtgaagatcagattgtccaagttctagaattcattgggaagaaagaaaacctgattcttccagctggatttgctgctcgtatcgcagcacaatcaaaccgtaatctgagacgtgctatactgttttttgagacttgcaaagttcaacaatacccatttacatcaaatcaagtggcgcctcctcttgattgggagcaatacgtgtctgaaatagccacggatatactgacagaacaaagccctaaaaggctatttgatgtacgccagaaattctatgaattactcgtcaattgtatcccacccgaaagtattttgaagaagttgctagcagagttactgaggaagttagatgctgatctgaaatatgaaatctgtcgctgggccgcacactacgagcacaagatgcgccttggatcaaaggctatttttcatctggaagctttcgtggccaagttcatgagcatttacaaggagttcctggtggctacatttggttgagcaaaacctcgagctacaattagggttgtcacgttctgtcaggggctatcgcattgtatcggtatagttttgtactaatctcgtcagcgactatccttctgtcaacccgggtgacccctctgacttcatcatagcgtctgcttgcacgttgacgttcgtgacgacattatcagacgtcattacgcttggttaacaaacagcctgaaagcgggacaggctcggaagttagaaataacagcctgtgaagacgtagacgttgatgacgacacgataagaaatcatttcgctcggttaaagagaatatccttaatgtgcggc

SEQ ID NO: 2028 - DNA, 1624 bp, Zea mays
ccggaaagcccgcaaaacccttgtctgccaacagctgtctcgcaagtcgcaacggctgagtgcgcgcccatcagtcccgggttcccgccacacccctcccatccccctctcaatcctgtccccaaatctctctcttctctctagcggcgaggcgaggcggtgaagacgagcgagcggcgaggatgttgtgggtagacaagtaccggccgaaaaccctagacaaggtcaccgtccacgaccaggttgcgcggaacctcagaaagttcgtgtcggagcaggattgcccgcacctgctgttctatgggccgtcggggtccgggaagaaaaccctaatcctcgcgctcatcaagcagatgtttggcgccggcgcggagaaggttaagctggagaataagacatggaaaattgatactggaacaaggacacttgagatagaattggcgatgttgtcaagtgctcaccatgtagagatgaaccccagtgatgctggctttcaggacaggtatgttgtccaggagatcattaaagagatggccaagaacaggccaattgatgccaaaggaaggagagcatttaaagtccttgtgttaaatgaagttgacaagctctcaagagaagcccagcattccctccgtaggactatggagaagtatagctcatcatgcagactgatcctatgctgtaacagctcctcaaaagtgacagaggctgtaagatcccgttgcttaaatgtgcgagtaaacgcacccagtgaagatcagattgtccaagttctagaattcattgggaagaaagaaaacctgattcttccagctggatttgctgctcgtatcgcagcacaatcaaaccgtaatctgagacgtgctatactgttttttgagacttgcaaagttcaacaatacccatttacatcaaatcaagtggcgcctcctcttgattgggagcaatacgtgtctgaaatagccacggatatactgacagaacaaagccctaaaaggctatttgatgtacgccagaaattctatgaattactcgtcaattgtatcccacccgaaagtattttgaagaagttgctagcagagttactgaggaagttagatgctgatctgaaatatgaaatctgtcgctgggccgcacactacgagcacaagatgcgccttggatcaaaggctatttttcatctggaagctttcgtggccaagttcatgagcatttacaaggagttcctggtggctacatttggttgagcaaaacctcgagctacaattagggttgtcacgttctgtcaggggctatcgcattgtatcggtatagttttgtactaatctcgtcagcgactatccttctgtcaacccgggtgacccctctgacttcatcatagcgtctgcttgcacgttgacgttcgtgacgacattatcagacgtcattacgattggttaacaaacagcctaagtgggacaggctcggaagttagaaataacagctgtgaagacgtagacgttgatgacgacacgatcagaaatcatttcgctcggttaaagagaatatccttactgtgcggcagactcagaattcagaaccaaataatgactgcgagcaccacaaacacgtcaatcatgttatt

SEQ ID NO: 2029 - DNA, 1571 bp, Panicum virgatum
ccccaccagtcccgagttcccgccactcccctccattcccctcccaatccaatccccaaatctctctacctctccaccctctctagcagcgaggcgaggcggggaagaagagggagcagcgaggatgctgtgggtggacaagtaccggcccaagaccctagacaaggtcaccgtccacgaccaggtcgcgcagaacctcaggaagctcgtttcggagcaggattgtccgcacttgctgttctatgggccgtcggggtccgggaagaaaaccctaatcctggcgcttatcaagcagatgttcggcgccggcgcggagaaggttaggatggagaacaaaacatggaagatcgataccggaacaagaacacttgagatagagttggcgatgttgtcgagtgctcatcatgtggaaatgaaccccagtgatgcaggctttcaggacaggtatgttgtccaggaggtcatcaaagagatggcgaagaataggccaatcgatgccaaaggcaagagagcatttaaagtccttgtgttaaatgaagttgacaaactctcacgagaagcccagcattccctccgtaggactatggagaagtatagcgcatcatgcagactgatcctgtgctgtaacagctcatcaaaagtcacagaggctgtaagatcccgttgcttaaatgtgcgagtgaatgctcctagtgaagatcagattatccaagttctagagtttattgggaagaaagaaaacctgcagcttccagctggatttgctgctcgtattgctgcacaatcaaaccgcaatctgagacgggcaatactgttttttgagacttgcaaagtgcaacaatacccatttacatcaaatcaagtcgcacctcctcttgactgggagcaatatgtgtctgaaatatcaactgatattctgacagaacaaagccctaaaaggctatatgctgtacgccagaaattctatgaattacttgtcaattgtatcccacctgaaagtattttgaagaagttactggcggaattacttaagaagttagacgctgatctgaagcacgaaatctgtcactgggctgcacactatgagcacaagatgcgccttgggtcaaaagccatttttcacctagaagctttcgtggcaaagttcatgagcatttacaaggagttcctggtggcttcatttggttgagcaaaatccgaagcgttaggttgtttccgacgaagccccatcgtctggggccttgtcggtgtagtttgttcgtaccaaactctggacgattagctacatccagtctgtttaaaccaccacgaatgtcattcaggttccgtggttacatctcttcagtatttacttgcacgttgagggatgacacgatggcatcgaagtctcaattcacttagctgccacatgttactcaacgcctgtacaccattatttgtccgtgtgccatgtgcgatactcagaagcaaaagcctgtcaaccgaaccaaagattgattatataaaaaggcacagacgtacgagggtggcaacaagcaagatgctaattatattatttcaagcgttgtcac

SEQ ID NO: 2030 - DNA, 1429 bp, Cenchrus ciliaris
tcccgacttcccgagttcccgccactcccctccattcccctcccaatccaacccaacccccaaatctccccacctcttcctccactgcagcggtgcggcgcggcgagcgcggggaagaagaggagggcggcgaggatgttgtgggtcgacaagtaccggccgaagacccttgacaaggtcaccgtccacgaccaggtcgcgcagaacctcaggaagctcgtgtcggagcaggattgcccgcacctgctgttctatgggccgtctgggtctgggaagaaaaccctaatcctggcgctcatcaagcagatgttcggcgccggcgcggagaaggttaagatggagaacaagacatggaagattgatactggaacaagaacacttgagatagagttggcgatgttgtcaagtgctcaccatgtggagatgaaccccagtgatgcaggctttcaggacaggtatgttgtccaggaggtcatcaaagagatggcgaagaataggccgattgacgccaaaggcaagagagcatttaaagtccttgtcttaaatgaagttgataagctttcacgagaagcccagcattccctccgtaggacaatggagaagtatagcgcatcatgcagactgatcctatgctgtaacagctcctcaaaagtgacagaagctgtaaggtctcgttgcttaaatgtgcgagtaaatgcgcctagtgaagatcagatcgtccaagttctagagttcattgggaagaaagaaaacctgcatcttccagctggatttgctgctcgtatcgcagcacaatcaaaccgtaatctgagacgggcaatactgttttttgagacatgcaaagtgcaacaatacccatttgcatcaaatcaagtggcacctcctcttgactgggagcaatacgtgtctgagatagcgactgatatcctgacagaacaaagccctaaaaggctatatgctgtacgccagaaattctatgaattgctagtcaattgtatcccacctgaaagtattttgaagaagttgttgactgaattactgaagaaactagatgctgatctgaaacatgaaatctgccgctgggctgcacactatgagcacaagatgcgcctagggtcaaaggccatttttcacctagaagcatttgtggccaagttcatgagcatttacaaggagttcctggtggctacatttagttgagcgaaacgggaagctgcaaagagaggatgctttcgactattgcatgtctgcatcatatgtagtttgtttgaaccaaatttagctgccacttgttattcaacgcctgtactgtaaaccattatttgtggcatgtgcgatggtgagaaacatggactgaaccggagaatgattaagtaacggcacaaccaaacaaggacgcaacaagcagattgctaatcatattattcca

SEQ ID NO: 2031 - DNA, 1995 bp, Oryza sativa
aatctctccccgctcccctctcgagccgaaccccaaatctctctctcctctctctctctctctagcagcggcggcggcggcggcgaggcgaggaagatgctgtgggtggacaagtacaggccgaaaaccctagacaaggtcaccgtccatgaccaggtcgcgcaaaacctcaagaagctggtggcggagcaggattgcccgcacctgctcttctatgggccgtcggggtccgggaagaaaaccctagtcatggccctcatcaagcagatgttcggcgcaggcgcggataaggtgaagatggagaacaagacatggaagatcgatactgggtcgaggaatattgagatagaactggcaatgttgtcgagcgcccaccatgtggagatgaaccccagcgatgctgggtttcaggacaggtatgttgttcaggaagtcattaaagagatggcgaagaataggccaattgatgccaagggcaagagagcatttaaagtccttgtccttaatgaagtcgacaagctctcacgagaagcccagcattcccttcgtaggacaatggagaagtacagtgcatcatgcaggctgatattgtgctgtaatagctcatcaaaggtgacagaggctgtaaggtctcgttgcttgaacgtgcgagtgaatgcacccagtgaagaccagatcgtccaagttctggagttcattgggaagaaagaaaatctgcagcttccatttggatttgctgctaggatagcagcacaatcgaaccgtaacctgagacgagcgatactgttttttgagacctgcaaagtccagcaatacccatttacatcaaatcaagtagcacctcctcttgactgggagcaatatgtgtcagaaatagcagctgatatcatgaaagaacaaagccctaaaaggctatttgctgtgcgccagaagttctacgaattacttgtgaattgtatcccacctgaaagcatcttaaagaagttgttggcggagttactgaagaaattagactctgacttgaaacatgaaatttgtcactgggctgcacactatgaacacaagatgcgtcttgggtccaaggccatttttcacctagaagctttcgtcgccaagttcatgagcatctacaaggaatttcttgtctctacatttggctgagcatctacaaggaagctgctgcatgtccatttccggcaacacaaggatgttgggaaactctccatgctagccatcttggccaatgtaatcggttcgatcaacgcaacgggatcaagtttgtagcaggtttatgtgagtgacattgagctggccttttgtgtttgtgcatctgctcgtttccgcaagatctgacgcaactactcgaaagccaaaaacatgcttaaatgattcggtcgaaatagaaagacatcggtaatcttggtacaagaaccacgctatccagttcgatgcaacaattcgatctttggatctgtgacgaaagctagcatacgatgcacgctattcagtcagatcagcaggctaaaaactgaagtttataaattgcaaatcgaaactagaatagctgactactgactacacatcactgtctcagatcactaaacataatcccttccatctgcggagctactgcccaaaccagctattgaaatttgaacgaatgtaggggtagtataacagactgatgctattattttaaatgtcgccacaaaccaattagccgtcccatttgtacagcagcaattcgcttacacagttacactttaaaacaagccgcttttggcatagcagtggctgggtgttcagacccttggcctcaccctgcgcccgctggtatcgccgccatccgagagctgcccccacacgctctggctcttccctccgctgctgcattcctcctcacacccggcgaccgtcctcagtatctccgattgcagcgcggggcagttgtctttgaggtaatcaaacccgtcggtccggattacagctgcagat

SEQ ID NO: 2032 - DNA, 1415 bp, Brachypodium distachyon
ccccttctctccgcccccagtccaatccccaatcccccgccccccttctcgtcggcggcgaggcgcaggagcaagatgctgtgggtggacaagcaccggccaaaagccctagacaaggtcaccgtccatgagcaagtcgcgcagaacctcaagaagctcgttgcggagcaggattgcccgcacctcctcttctacgggccgccggggtccggcaagaaaaccctaatcatggcgctcatcaagcagatgtttggcgcaggtgcagagaaggtgaagatggagaacaagacgtggaagattgatactgggacaaggacatttgacctagagttggtgatgttgtcaagttcccaccatgtcgagatgaaccccagcgatgcagggtttcaggacaggtatgttgtccaggaggtcatcaaagaaatggcgaagagcaggccaattgatgcgaaaggcaagagagcatttaaagtgctcatcctaaatgaagttgacaagctctcacgagaagcacagcattccctccgtaggacaatggagaagtacagtgcatcatgtaggttgatattatgctgtaatagctcctcaaaggtgacagaagccgtaaggtcccgttgcttgaatgtgcgagtgaatgcacctactgaagatcagattgtacaagttctggaattcattgggaagaaagaaaacttgcaacttccatttggatttgctgctcggatagcagctcagtcaaaccgcaacttgaggcgagcaatattatttttcgagacatgcaaagtccagcaatatccgtttacatcgaatcaagtgccgcctcctcttgactgggagaagtatgtgtctgaaatagcaactgatatcttgagcgaacaaagtccgaaaaggctctattctgtacgccagaaattctacgagttacttgtcaactgtatcccacctgaaagcatcttgaagaagttgttgtcggagttaatgaagaaattagactctgatttgaaacatgaaatttgtcactgggctgcacactatgaacacaagatgcgtcttgggtccaaggcaatttttcatctggaagcttttgtggccaagttcatgagcatttataaggagttcctggtggccacatttggttaagcaaacacgaagcatatggctgtttcccgtgccaacttgcaacaggatgcttacacttccctatctcggtcattgcaatcggctttatccatccgcgcagagtttccattttgtatgtacttcggcgtactctgtaaccaactcgtgtgagccaatctgttttcttttgaatcgttgaatattgaaacaatgagtcgtccttctattgttccatctgttttgccacgtactcagacttcagcagcattctatgttactccctccatacgaaaaca

SEQ ID NO: 2033 - DNA, 1435 bp, Triticum aestivum
ccaagttcccgccagtctcctccattcccctccccacctctcccaaatccaatccccaaatcctcatctccctccccatctctctcgtcggcggcgaggcggggaaggagggcgaagatgctgtgggtggacaagcaccggccgaaaaccctagacaaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggagaaggtgaagatggagaataagacgtggaagatcgatactgggacgagggcatttgatcttgagctggcgatgttgtcaagttcccaccatgtggagatgaaccccagcgatgctggctttcaggacaggtatgttgttcaggaggtcatcaaagagatggccaagagtaggccaattgatgccaagggcaagagagcatttaaagtgcttgtcctaaatgaagttgacaagctgtcacgagaagcacaacattccctccggaggacaatggagaaatacagtgcatcgtgtagactcatattatgctgtaatagctcctcaaaggtgacagaagctgtaaggtcccgttgcttgaatgtgcgagtgaatgcacctaccgaagaccagattgtacaagtactggaattcattgggaagaaagaaaatctgcaacttccatttggatttgctgctcggatagcagctcaatcaaaccgcaacttgaggcgagcaatattattctttgagacatgcaaagtccagcaatatccattttcagcaaatcaagtggcgcctcctcttgactgggagcagtatgtgtctgaaatagcaactgaaatcttgagtgaacaaagccctaaaaggctatattctgtacgccagaaattctatgagttacttgtgaattgcatcccacctgaaagcatcttgaagaagttgttaaccgagttaatgaagaagttagactctgatttgaagcacgaagtttgtcactgggctgcacactatgaacacaagatgcgacttgggtccaaggccatttttcatctggaagctttcgtggccaagttcatgagcatttacaaggagttcctttgcgccgcatttggttgagcaaaaccagagcatacggatgtttgccgctgcaagaagatgctcccagttcgcagtctctgtcgtcgcaatcgctttggtctgatgtgtgggcgctgacatcttgtatgttactcagtcagtgtagtttgtactgaattcatgtgagcaagtacttatttgctttgaatcatttgctattgaaaggtggagtcgcccatctatgattgtcttgattttgttctgccttgtgcttggacgtcaatcgaattca

SEQ ID NO: 2034 - DNA, 1557 bp, Triticum aestivum
gggacagggggagagagagagagagagatagagagagatagagagagagaggctcggtgaagccccaaaaccctgctcttcccctctggcgcgagaggccgcccccaatcccctccccactcccaagttcccgccagtctcctccattcccctccccacctctcccaaatccaatccccaaatcctcatctccctccccatctctctcgtcggcggcgaggcggggaaggagggcgaagatgctgtgggtggacaagcaccggccgaaaaccctagacaaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggagaaggtgaagatggagaataagacgtggaagatcgatactgggacgagggcatttgatcttgagctggcgatgttgtcaagttcccaccatgtggagatgaaccccagcgatgctggctttcaggacaggtatgttgttcaggaggtcatcaaagagatggccaagagtaggccaattgatgccaagggcaagagagcatttaaagtgcttgtcctaaatgaagttgacaagctgtcacgagaagcacaacattccctccggaggacaatggagaaatacagtgcatcgtgtagactcatattatgctgtaatagctcctcaaaggtgacagaagctgtaaggtcccgttgcttgaatgtgcgagtgaatgcacctaccgaagaccagattgtacaagtactggaattcattgggaagaaagaaaatctgcaacttccatttggatttgctgctcggatagcagctcaatcaaaccgcaacttgaggcgagcaatattattctttgagacatgcaaagtccagcaatatccattttcagcaaatcaagtggcgcctcctcttgactgggagcagtatgtgtctgaaatagcaactgaaatcttgagtgaacaaagccctaaaaggctatattctgtacgccagaaattctatgagttacttgtgaattgcatcccacctgaaagcatcttgaagaagttgttaaccgagttaatgaagaagttagactctgatttgaagcacgaagtttgtcactgggctgcacactatgaacacaagatgcgacttgggtccaaggccatttttcatctggaagctttcgtggccaagttcatgagcatttacaaggagttcctttgcgccgcatttggttgagcaaaaccagagcatacggatgtttgccgctgcaagaagatgctcccagttcgcagtctctgtcgtcgcaatcgctttggtctgatgtgtgggcgctgacatcttgtatgttactcagtcagtgtagtttgtactgaattcatgtgagcaagtacttatttgctttgaatcatttgctattgaaaggtggagtcgcccatctatgattgtcttgattttgttctgccttgtgcttggacgtcaatcgaattca

SEQ ID NO: 2035 - DNA, 1784 bp, Hordeum vulgare
aaccctcaaaaccctgctccccccctctggcgcgagaggccgccccaatcccctccccactccccaagttcccgccagtctcctccattcccatccccctcccccgccctctcccaaatccaatccccaaatcctcatctccctctccgtctctcccatcggcggcgagccggcgcaaggggggcaaggaggggccaagatgctgtgggtggacaagcaccggccgaaaaccctagacaaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggataaggtgaagatggagaataagacgtggaagatcgatactgggacgaggacatttgatcttgagctggcgatgttgtcgagttcccaccatgtggaaatgaaccccagcgatgctggctttcaggacaggtatgttgttcaggaggtcatcaaagagatggccaagagtaggccgattgatgccaagggcaagagagcatttaaagtgcttgtcctaaatgaagttgacaagctgtcacgagaagcacaacattctctccgtaggacaatggagaaatacagtgcatcctgcagactcatattatgctgtaatagctcctcaaaggtgacagaagctgtaaggtcccgttgcttgaatgtgcgagtgaatgcacctacagaagatcagattgtacaagtattggaattcattgggaagaaagagaatctgcaacttccatttggatttgctgctcggatagcagctcaatcaaaccgcaacttgaggcgagcaatattattctttgagacatgcaaagtccagcaatatccattttcagcaaatcaagtggcgcctcctcttgactgggagcagtatgtgtctgaaatagcaactgaaatcttgagtgaacaaagccctaaaaggctatattctgtacgccagaaattctacgagttacttgtgaattgtatcccacctgaaagcatcttgaagaagttgttaaccgagttaatgaagaagttagactctgatttgaagcatgaagtttgtcactgggctgcacactatgaacacaagatgcgacttgggtccaaggccatttttcatctggaagctttcgtggccaagttcatgagcatttacaaggagttcctttgtgctgcatttggttgaggaaaaccagagcatacggatgtttgctgctgcaagaagatgctcccagttctcagtctttgtcgtcgcaatcgctttggtctgatgtgtgggtgtttacattctgtatgttattcagtcagtgtagtttgtactgatttcatgtgagcaagtctttatttactttgaatcatttggtattcaaaggtggagtcgcccacctatgattctgttgattttgttttgccttgtgcttggacgtcgaaacgaatttgagcatctcatcctataaaagctaacagggtgctcaacaatatcgctacctcctttctggttatataaggcttacacgtacagtacatattattccctcttattttgggacgaagggagtataagttacattacctctgtcctaaagaactgtcttagatttgtctagctatgtatgtatctaacgctaaaatgtatttggatacatctgtgatgtatttagacaaatgtatgacagagctttttgggatggagtggagtatgttgt

SEQ ID NO: 2036 - DNA, 1784 bp, Hordeum vulgare
aaccctcaaaaccctgctccccccctctggcgcgagaggccgccccaatcccctccccactccccaagttcccgccagtctcctccattcccatccccctcccccgccctctcccaaatccaatccccaaatcctcatctccctctccgtctctcccatcggcggcgagccggcgcaaggggggcaaggaggggccaagatgctgtgggtggacaagcaccggccgaaaaccctagacaaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggataaggtgaagatggagaataagacgtggaagatcgatactgggacgaggacatttgatcttgagctggcgatgttgtcgagttcccaccatgtggaaatgaaccccagcgatgctggctttcaggacaggtatgttgttcaggaggtcatcaaagagatggccaagagtaggccgattgatgccaagggcaagagagcatttaaagtgcttgtcctaaatgaagttgacaagctgtcacgagaagcacaacattctctccgtaggacaatggagaaatacagtgcatcctgcagactcatattatgctgtaatagctcctcaaaggtgacagaagctgtaaggtcccgttgcttgaatgtgcgagtgaatgcacctacagaagatcagattgtacaagtattggaattcattgggaagaaagagaatctgcaacttccatttggatttgctgctcggatagcagctcaatcaaaccgcaacttgaggcgagcaatattattctttgagacatgcaaagtccagcaatatccattttcagcaaatcaagtggcgcctcctcttgactgggagcagtatgtgtctgaaatagcaactgaaatcttgagtgaacaaagccctaaaaggctatattctgtacgccagaaattctacgagttacttgtgaattgtatcccacctgaaagcatcttgaagaagttgttaaccgagttaatgaagaagttagactctgatttgaagcatgaagtttgtcactgggctgcacactatgaacacaagatgcgacttgggtccaaggccatttttcatctggaagctttcgtggccaagttcatgagcatttacaaggagttcctttgtgctgcatttggttgaggaaaaccagagcatacggatgtttgctgctgcaagaagatgctcccagttctcagtctttgtcgtcgcaatcgctttggtctgatgtgtgggtgtttacattctgtatgttattcagtcagtgtagcttgtactgatttcatgtgagcaagtctttatttactttgaatcatttggtattcaaaggtggagtcgcccacctatgattctgttgattttgttttgccttgtgcttggacgtcgaaacgaatttgagcatctcatcctataaaagctaacagggtgctcaacaatatcgctacctcctttctggttatataaggcttacacgtacagtacatattattccctcttattttgggacgaagggagtataagttacattacctctgtcctaaagaactgtcttagatttgtctagctatgtatgtatctaacgctaaaatgtatttggatacatctgtgatgtatttagacaaatgtatgacagagctttttgggatggagtggagtatgttgt

SEQ ID NO: 2037 - DNA, 2612 bp, Setaria italica
ctcgcacccccacccccaacatggaggacgaagacgccggccccggcggcgggggcgaggcctccccaccgcaccacgccgcggcgtcgggcgaccgggcgcgggacatggcggcgtccccgacgagctcgcggtccgtgacgcagacggtgaacgggtcgcacaggttcgtgatctcgccaagggtatgggcgtggggaggcacatcgccagcgagaccttcacggtgggcgggtaccagtgggcgatctacttctaccccgacgggaagaaccccgaggacaactccgcctacgtctccgtcttcatcgccctcgcgtccgagggcaccgacgtgcgcgcgctcttcgagctcacgctcctcgaccagagcggcaagggcaagcacaaggtgcactcccacttcgaccgctccctcgagtctgggccgtacaccctcaagtaccgcggatccatgtggggctataaaaggttctttcggcgtactgctcttgagacatcagattttcttaaagatgattgcttgaagataaactgtactgtgggtgttgtagtatcaactatggattattctagaccacactcgattgaggttccagagtctgacataggctatcattttggaacgcttttggacaatcaggaaggtgtagatgttatttttagtgtagcaggagagaagtttcatgcccataagttggtattggctgccttccttttttaggtctgaatttttcgatcatgaatcagatgaagaaaagaatgaagctgatacgaggaatgaaatcaaagagattgtcattgatgacatggatcctaaagtgttcaaggctgtgcttcattttatctacagggacaatcttgttaatgatgatgagttgtccgcatcaagctcccacggctctgtttttgatactttagctgggaagttaatggctgcagcagacaaatatgagttgccaaggctaagattgttgtgtgaatcttacttgtgcaaacatatttctgtaaactctgtgtcaactactctagcattggctgatcggcaccatgctatggagcttaaatctgtttgcctgaaatttgctgctgaaaacctttcagctgtgatccggagcgaggggtatgattacctcaaagacaactgcccagcgctgcagtcggagatactgcggacacttgccggatgcgaggagcaatgtagcagcggcgggaaaagccagagcgtgtgggcgcaactctctgacggtggcgacaccagcgggcgcagggtgaggccgagggtctgagacgtcaccagctcaccgccgtgagcactgacctgggtaatcgaagctgtagtgtacatgtggacaggcaccgtacagctatttgatttgtgacaacctttggaataatatgattagcatctgcttgttgcgtcctggttcggttgtgcttttttacataatcattctctggttcggttcacgggctcttgttgctcagtatcgcacatgccacaaataatggtgtacagtataggcgttgagtaacaagtggcaactaagcgaaatgacttggcttatcgttcacctgagtttggtacgaacaaaatacagacaagaagacctcatacagtgcaaatatgcaatagtcgagtgcgtcctctctttgcaggaaacaatcctacagcttcccgttttgctcaaccaaatgtagccaccaggaactccttgtaaatgctcatgaacttggccacaaatgcttctaggtgaaaaatggcctttgacccaaggcgcatcttgtgctcatagtgtgcagcccagtgacagatttcatgtttcagatcagcatctaatttcttcagtaattcagtcaacaacttcttcaaaatactttcaggtgggatacaattgactagcaattcatagaatttctggcgtacagcatatagccttttagggctttgttctgtcaggatatcagtcgctatctcagacacgtattgctcccagtcaagaggaggtgccacttgatttgatgcaaatgggtattgttgcactttgcaagtctcaaagaacagtattgcccgtctcagattacggtttgattgtgctgcaatacgagcagcaaatccagctggaagatgcaggttttctttcttcccaatgatctccagaacttggacgatctgatcttcactaggtgcgtttactcgcacatttaagcaacgggaccttacagcctctgtcacttttgaggagctgttacagcataggatcagcctgcatgatgcgctatacttctccatagtcctacggagggaatgctgggcttctcgtgagagcttgtcaacttcatttaagacaaggactttaaatgctctcttgcctttggcatcaatcggcctattcttcgccatctctttgatgacctcctggacaacatacctgtcctgaaagcctgcgtcactggggttcatctccacatggtgagcactcgacaacatcgccaactctatctcaagtgttcttgttccggtatcgatcttccacgtcttgttctccatcttaaccttctccgcgccggcgccgaacatctgcttgatgagcgccaggattagggttttc

SEQ ID NO: 2038 - DNA, 1065 bp, Aquilegia formosa
atgttgtgggtagataaatacagacccaaaaccctagataagatgattgttcatgatgacatagctcaacatctcaagaaactggttacagagcaagattgtcctcatcttctcttttatggtccatctggttctgggaaaaaaaccctaattatggctgtacttagacagatgtatggtgctagtgctgaaaaggtgaaaatagagaacaaaacgtggaaagttgatgcagggagtagaacacttgatcttgaactgactacattgtcgagcaccaaccatgtggaaataaatcccagtgaagcaggtttccaggataggtatgtcgttcaagaaataatcaaagaaatggcaaaaaataggccaattgatgccaaagggaagaagggttacaaagtgctagtgctaaatgaggttgacaagctctcaagagaagcccagcattcacttcgaagaacaatggaaaaatacagtgcatcatgtcgtttgattttatgttgcaatagttcgtcaaaagttactgaagccgttcggtctcgttgtttaaatgttcggataaatgcaccaacagaagaacagatcgtaaaagtattggagttcattggcaagaaggaaaatttgcaactaccccctggatttgcagctcgtatagccgttcaatcaaacaggagtttaagaagggccgttctattatttgagacgtgtcgagttcaacaatatcctttcaccagtattcaagcaataccacctatggattgggagcaatatgtttctgaaatagcatctgacataatgcaggagcagagtcctaaaaggctgtttatggttcgagggaagctatacgagctactaatcaattgtattcctcctgaaatcatcttgaagaggcttctgtcagagttactcaagaagttggatgctgaactaaagcacgaggtctgccattgggctgcatattatgagcatagaatgcgtcttgggcagaaagccatatttcacatagaagcatttgtggcgaagttcatgagtatatacaaggcctttctcattgcgacatttggatga

SEQ ID NO: 2039 - DNA, 1334 bp, Ipomoea nil
  misc_feature (35)..(35): n is a, c, g, or t
  misc_feature (52)..(52): n is a, c, g, or t
  misc_feature (54)..(54): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (64)..(65): n is a, c, g, or t
  misc_feature (93)..(93): n is a, c, g, or t
  misc_feature (156)..(156): n is a, c, g, or t
  misc_feature (241)..(241): n is a, c, g, or t
  misc_feature (250)..(250): n is a, c, g, or t
  misc_feature (321)..(321): n is a, c, g, or t
  misc_feature (587)..(587): n is a, c, g, or t
  misc_feature (645)..(645): n is a, c, g, or t
  misc_feature (681)..(681): n is a, c, g, or t
ggcacgaggctttaaggcttaagcatctctctctntctctctctctctctgncncncncncncnnacagtaggcggagatgttgtgggtcganaagtaccgcccgaaaaccctagacaagatcatcgtgcaccaagatgttgctcaaaatcttaanaaattggttacagaacaagattgcccgcatttgctgttttacgggccatcagggtcgggtaagaaaaccctaattatggcccttntccggcagntatttggggccagtgccgataaggtgaaagctgagaacaaagtctggaaaattgatgctggaactaggacnattgatgtagagctcactacattatcaagcactcatcatgtggaattgagtcctggtgatgctggatttcaagaccgatatgttgttcaagaggtaataaaagaaatggcaaagaatagacctattgacaccaaaggaaagaagagtttcaaagtattagtgctgaatgaagttgacaagctctcaagagaagcacagcattctcttcgaagaacaatggagaaatacagcacgtcatgccgtctgattctttgctgcaacagttnttcaaaagttacagaagctgttcgttctcgatgcctcaatgtgcgaataaatgcaccnaaggaagaagagatagtgaaggttttggaatttatngggaagaaagaaggacttcagctcccagcaggatttgctgcccgcatagcagaaaagtcaaacagaagcctcagaagggcgatattatcatttgagacttgtcgtgttcaacagtatccctttacaaacaaccaagcagtacctccaatggactgggaggaatatgttgcagagattgcatcagacataatgaaggaacagagccctaaaaggctgtttcaggttcgaggaaagctctatgaactactttctaattgtattcctcctgacattattttaaagcggcttctttttgagctcctgaagaaattggattctgagttgaagcatgaggtctgccattgggctgcatattatgaacataggatgcacttaggacagaaggcgatatttcaccttgaagcatttgtggccaagtttatgagcatttacaaaaatttcctcgttgcaacctttggatgaagtggagaatgcccgaggcggcgaggcctgcagatctaaactgtgaatgtagttggtacaatttttgccatcaacgatgcagttgcccaaatttctggatttctttcaactctttgttctttagttagttaaacaatctgattgagtgacagcaactagaaaattcactgtcttctcccttctgatctgtg

SEQ ID NO: 2040 - DNA, 1382 bp, Aristolochia fimbriata
gtacttttttccttattccttcgctttaaaacttagcttcccacccggtacttttttcccgccacttctgcagtccagtttctgggtgtgaactcaaaagttccattccctcaccatactgattcgcattcaagcgaattctgtgaaaatgttgtgggtggacaagtatcgcccaaagactctggacaaggtgattgtccatgaggacatagctcagaatctgaagaaactcgtgtcagaacaagattttcctcatcttctcttttatggaccgcctggttctggcaagaaaaccctaatcatgggcctccttaaacagatgtttggccctggcgctgataaggttaagatagagaacaaagtgtggaaaatcgatgccggatccagaaccattgatattgaactcacaacattgtcaagctcctaccacgtggaactgaatccaagtgatgcaggtttccaggatcgttatattgtccaagagatcattaaagaaatggcgaagagcagacctattgacaccaaaggaaagaagggctttaaagtgttggtgctcaatgaggtcgataaactgtcaagagaagctcagcattctcttcggcgaacaatggagaaatacagcgcatcttgtaggttaattttatgttgcaacagctcttctaaagtcactgaagcagttcgatctcgttgcttgaatgtgagagtaaatgcacctactgaggaacagattattaaagtactggagtttgttggcaaaaaggaaggacttcaacttcccgcaaactttgcagctcatattgcagcccactcaaaccgaagcttaagaagggctctgctgtcctttgaaacatgtcgtgttcaacaatatcccttttcagaaaaccaaacagtggcacccatggattgggagcaatatgtttcagaaatagcaacagatattgtgcaggagcagagccctaaaaggctatatttagttcgtgggaagttgtatgagctgctagttcactgtataccacctgaaataattttaaagaagttactctctgaattactgaagaaattagatgctgacctaaagcatgaagttacccattgggcagcatattacgaacacaggatgcgcctgggacagaaagcaatatttcatcttgaagcatttgtagccaagttcatgagcatctacaaggggtttcttattgctgcatttggctgacttctgctgcatatatggtcgattttttcatgatactttggcagctcccatctgtgtgagacgtctcctgttttacttacatggagggttcttttgaagttactgtttataaagaccaacccgaacttgtcttcaaatgttattgcaaatgatcaatgaccaggctatg

SEQ ID NO: 2041 - DNA, 1295 bp, Cichorium intybus
ggggatcagcaacaaagcgcacaccttccccctcaccttcaagatgctttgggtggacaatacagaccaaagtccctagacgaggttcttgtacacgaagatgtcgctcaaaatcttaagaaattggtcaccgagcaagattgcccacatttactgttctatggcccaccgggatccggcaagaaaaccctaatcatggcccttctcaggcagatgtttggggctggtgccgaaaaggtgaaagtggagaacaaaaactggaaagttgatgctggaagtagaactatcgatttggaactcacaactctatcaagcacccaccatgtggagctgaaccccagtgatgctggattccaggatcgttacattgttcaagaaatcatcaaagaaatggcaaagaacaggccaattgacactaaaggaaagaagggtttcaaagtattagtactcaatgaggttgataaactttcaagagaagcacaacactctctgagaagaacaatggagaagtacagtgcctcctgtcgtttgatcctgtgctgtgacagctcatcaaaggttactgaagctgttcgttctcgttgtcttaatgtgcgagtaagtgcaccaaaagaagaccagattgttaaagttctggagtttattggcaagaaggaggggttacaacttcctcctggatttgctgctcgcattgctgaaaaatctggtcggagtttaaggagggcgatattgtcatttgagacgtgtcgtgtacaacagtacccttttacaaataatcaagtaattcccccaatggactgggaagaatatgtaactgagattgcagctgacataatgaaagaacagagccctaaaaggctgttccaggttcgaggaaagttgtatgagttacttgtgaattgtattcctcctgaagttatattgaagaggctgcttcatgaactgctgaagaaattagattctgaattgaagcatgaggtctgtcattgggctgcatattatgaacataggatgcgccttggacagaaagccatatttcacattgaagcatttgtagccaagttcatgagcatttacaaaggcttcctaattgcaacatttggctgagctcaaccaacgagctctataaaactctttatgtgtttctggcctctgatgcctgggtttcggttgacttgttaagaaggcctcctcccttgtcttggtatgctgttttctacttaaaccatattttgaggttagaggatagattttgtaatggaatgtaaaacccttctatatgtcaatttcaagtt

SEQ ID NO: 2042 - DNA, 1246 bp, Glycine max
agaggtgtattttgtgctgtgccccttctcagcactcagcagcgataacagttgaagacacagaaaacaagcaagagaggcagctgaagatgttgtgggtggacaaatatcgtcccaaaaccctcgaccaggttatggtccacaccgacatcgctcataatctcaagaaattggtaacggaacaggattccccccatttactcttctatggcccatctggctctggcaagaaaaccctaatcatggctcttctccgccaaatgtttggacctggtgctgaaaaggtgaaggtggaaaataggacctggaaaatcgacgctgggagtagatctcttgatttagagctgacaacattatcaagtgccaatcacattgaaatgagtccgagtgatgcagggtttcaggatagatacattgttcaggaagtaatcaaagaaatggctaagaatagacccattgatactaaggggaagaaaggatttaaagtacttgtgctcaatgatgttgacaaactctctagagaagcccaacactctctccgcagaacaatggagaaatacagtgcttattgcagattaattctatgttgcaatagttcttctagagtcacagaagcaatccgctctcgatgtctcaatgtgcgaataaatgcaccaagtgaagaacagattgttcaagttttagaattcattggtaagaaagaaggactgcaacttcctcctggttttgctgctcgcattgcagagaaatcaaatcggaatttaaggagggccatattgtcgtttgagacttgtcgtgtcctacagtatcctttcactaacaaacaagcaattcctccaatggactgggaagagtatatttctgagattgcatctgacataatgaaggaacagagcccaaaaaggttgtttcaagttcgaggaaagctctatgagctgctaatcaattgcattcctccggagatcattttaaagaggcttctttatgagctattgaggaaactggatgcagaactaaagcatgaagtatgtcattgggctgcatattatgaatacaggatgcgtctcggacagaaggcgatctttcacattgaagcatttgtggccaagttcatgagcatttataaatccttccttattgcaacattcggctgaaggtcagatgatggcagtttgcttttccatgattcaacgtgttaaatgaattatgtactggaaattaattctaaaataaatggagttttttc

SEQ ID NO: 2043 - DNA, 1307 bp, Glycine max
agaggtgtattttgtgctgtgccccttctcagcactcagcagcgataacagttgaagacacagaaaacaagcaagagaggcagctgaagatgttgtgggtggacaaatatcgtcccaaaaccctcgaccaggttatggtccacaccgacatcgctcataatctcaagaaattggtaacggaacaggattccccccatttactcttctatggcccatctggctctggcaagaaaaccctaatcatggctcttctccgccaaatgtttggacctggtgctgaaaaggtgaaggtggaaaataggacctggaaaatcgacgctgggagtagatctcttgatttagagctgacaacattatcaagtgccaatcacattgaaatgagtccgagtgatgcagggtttcaggatagatacattgttcaggaagtaatcaaagaaatggctaagaatagacccattgatactaaggggaagaaaggatttaaagtacttgtgctcaatgatgttgacaaactctctagagaagcccaacactctctccgcagaacaatggagaaatacagtgcttattgcagattaattctatgttgcaatagttcttctagagtcacagaagcaatccgctctcgatgtctcaatgtgcgaataaatgcaccaagtgaagaacagattgttcaagttttagaattcattggtaagaaagaaggactgcaacttcctcctggttttgctgctcgcattgcagagaaatcaaatcggaatttaaggagggccatattgtcgtttgagacttgtcgtgtcctacagtatcctttcactaacaaacaagcaattcctccaatggactgggaagagtatatttctgagattgcatctgacataatgaaggaacagagcccaaaaaggttgtttcaagttcgaggaaagctctatgagctgctaatcaattgcattcctccggagatcattttaaagaggcttctttatgagctattgaggaaactggatgcagaactaaagcatgaagtatgtcattgggctgcatattatgaatacaggatgcgtctcggacagaaggcgatctttcacattgaagcatttgtggccaagttcatgagcatttataaatccttccttattgcaacattcggctgaaggtcagaggatgggtttacttttccatgattcaacgtgttaaatgaattgtgtactggaaattaattctaaaataaatggagttttttcatgttggttttctcttcatgtatgcatcaattgcgacagaatgatgtttcgtttgtaaaggtg

SEQ ID NO: 2044 - DNA, 967 bp, Avena sativa
actccctctcccagcggcgacgcagggcgaagatgctgtgggtggacaagcaccggccgaaaaccctagacaaggtcctcgtccatgagcaggtcgcgcagaacctcaagaaactcgtggcggagcaggactgcccgcacctgctcttctatgggccgccggggtccgggaagaaaaccctaatcatggcgctcatcaagcagatgttcggcgccggtgcggagaaggtcaagatggagaacaagacctggaaaattgatactggaaccaggacatttgatctggagctggccatgttgtcaagctcccaccatgtcgaaatgaaccccagcgatgcgggttttcaggacaggtatgttgttcaggaggtcataaaagagatggccaagagcaggccaattgatgccaaaggcaagagagcatttaaagtgcttgtcctaaatgaggttgataagctctcacgagaagcacagcattctctccgtaggacaatggagaagtacagtgcatcgtgtagactgatactatgctctaatagctcctcaaaggtgacagaagctgtaagatcgcggtgcctgaatgtgcgtgtgaatgcacctagtgaagatcagattgtacaagttctggaattcattgggaagaaagaaaacctgcaacttccatttggatttgctgctcggatagccactcagtcaaaccgtaacttgaggcgggcgatactattttttgagacatgcaaagtccagcaatatccattttcaccgaatcaagtggcacctcctcttgactgggagcagtatgtgtctgaaatagcgactgacatcttgagtgaacaaagccctaaaaggctatattctgtacgccagaaattctacgagctacttgtcaattgtatcccacctgaaagcatcttaaagaaaattgttgactgagttaatgaagaagttagatgctgatctgaaacatg

SEQ ID NO: 2045 - DNA, 1458 bp, Solanum melongena
tgctataggtctggtgcttctcacaatctccattttgcatggccttcatcagatttggtcgtctctttttatgacactgtttctgtcacctacttccgctattgctcttcaactagtttggctcgaatttggaaatgttgtgggttgacaagtatcgtcctaaaacattagacaaagttattgtacaccaggatgttgctcaaaatcttcataaactggtctcagagggagattgtcctcatcttctcttttacggcccttctgggtcaggaaagaaaactctgattatggcacttcttaggcagatttttggtccaagtgctgacaaggttaaggttgagaacaagatttggaaagttgatgctggtacacggacaattgatgtggagctcacaacattgtcaagcactcaccatgtggaattaaatccaagtgatgccggatttcaggatagatacgttgttcaagagataatcaaagaaatggccaagaatagaccaattgacacaaaagggaaaaaggggtttaaagttttagtgttaaatgaagttgacaagctctcaagggaagcacaacattctcttcgaagaacaatggagaagtacagtgcatcatgtcgcttgattctatgctccaacagttcttcaaaggtaactgaagcagttcgctcacgatgccttaatgtgagaataaatgcaccaatggaggaagagatcattaatgttttggagtttattgccaaaaaggaaggacttcaatttccacagggatttgcggcccgcattgtggaaaggtcaaataggaatctgaggagggcaattttgacattcgagacttgtcgtgttcaacagtatccctttaccaacaaccaatctatacctccaatggactgggagcaatatgtttcagaaattgcatcagacataatgaaagagcagagtcctaaaaggctgtttgaggttagagggaagttatatgagctactaaccaattgtattccccctgaaattattctgaagaagctgctttttgaactattaaagaaattggattcagagttgaagcatgaggtctccaactgtgctgctcattatgagcataggatgcgcctcggacagaaggctatatttcatcttgaagcatttgtggccaaattcatgagcatctacaagagtttccttatttcaacatttggctaggataggagatctgaagtactatggaactgtttggcagtaggaaaaagttctttgtccgttatgctaatatcctgtcgtgttttaatctaattggggctgtacaattgtgcctagacattattgtaccagaatcataactccaatttgatccatgttatttctctacaaaaaggattttctactgctaatactttgcaattgtcaagtgtaactggaaaagtaccaggtcacaatgggtacaaggtaaagtagacgtgct

SEQ ID NO: 2046 - DNA, 1516 bp, Solanum phureja
gtggacgtcgaccaagtatcacggttgcagacttgcagctcgcctctcgtcgacagttttcgactgttcagtctctcatcagtcatctttgtcaaggaccttttctcttcaactatagtggaaatgttgtgggttgacaagtaccgccctaaaacattagacaaagttactgtacaccaggatgttgctcaaaatcttcgtaaactggtctcagagggagattgtcctcatcttctcttttacggcccttccggttcaggaaaaaaaactctcattatggcacttcttagacagatttttggtccaagtgctgacaaggttaaggttgagaacaagatttggaaagttgatgctggttctcggacaattgatgtggagctcacaacattgtcaagcactcaccatgtggaattaaatccaagtgatgccggatttcaggacagatacgttgttcaagagataatcaaagaaatggccaagaatagaccaattgacacgaaagggaaaaaggggtttaaagttttagtgctaaatgaagttgacaagctctcaagagaagcacaacattctcttcgaagaacaatggagaagtacagtgcatcatgtcgcctgattctttgctccaacagttcttcaaaagtcactgaagcagttcgctcacgatgccttaatgtgcgaataaatgcaccaatggaggaagagattgttagtgttttggaatttattgccaaaaaggaagaacttcaatttccacagggttttgcagcccgcattgtggaaaagtcaaataggaatctgaggagggcagttttgacatttgagtcttgccgtgttcaacagtatccctttacaaacaaccaaactatacctccgatggactgggagcaatatgtttcagaaattgcatcagacataatgaaagagcagagccctaaaaggttatttgaggtaagaggaaagttatatgagctactaactaattgtattccccctgaaattattttgaagaggctgcttttcgaactattaaagaaattggattcagagttgaagcatgaggtgtccaactgggctgctcattatgagcataggatgcgccttggacagaaggctatatttcatcttgaagcatttgtggctaaattcatgagcatctacaagagtttccttatttcaacatttggctaagatagaagatctgaagttgtatggaactgtttggcagtaggaagaagttttctttgtccgttgtgctaatgtcctgtcgtgttttaatttaatttgggctgtacaattgtgcctagacattattgtacaagaatcataccccaatttgatctctatcagaaggattttctactgctagtatctttgcaattgccatgtcgcggtgggtacaaggtagtaatgggtacatgttgcagttattttttttctctagcccctttgatgaggaaagtaaatgaactaagaggagtaggtgtatgaaattgtgggtatgagttttggtggaaaa

SEQ ID NO: 2047 - DNA, 2051 bp, Zea mays
attcgcctctgcgcgcaatgcagtgatctccccccccctctctctctctctacctaactcttgtctgttgatgctgttcatcaggacctgtgctgagctttggagcagctagtaattaagcctagagcgctagcagtccttttggatttcggttcggaagcaaggcgtgccggactcccaaatcccaatcccaagcaagcagtgtgcagatggcaacgcagtggttctccaacatggtgatggacgagccgagctttttccaccagtggcagtccgacacgctgctggagcagtacacggagcagcagatcgcggtggcgttcggccagggggagccggtggaccacgccgtggcggcggccctggcgacggcgatgcccatgcagctgcagcagcccgcggcggccgagcagccgcaccaccgcccgcgcaaggcggccaaggtcaacaccagctgggactcgtgcatcacggagcagggctcccccgccgcggactcctcctcgccgaccatcctctccttcggcggccacaccgcgttcgccaaggcggagccgacgacgcaccagccgcccagctgcgccgggtactacggcgccgccgccgccgccgcgaaggcgccgaagcaggagatgatggacgccgccgcgatgccgccgttccagcaggcgcgcccggccaagcgttcctacgacgacatggccgcggtggccgaggccgccaacgcgccgtccgccaacacgcgcccggcctcccagaaccaggaccacatcttggccgagcggaagcgccgcgagaagctcagccagcgcttcatcgccctctccaagatcgtccctggcctcaagaagatggacaaggcatcggtgctcggcgacgcgatcaagtacgtgaagcagctgcaggaccaggtgaaggggctggaggacgacgcccggcggcgcccggtcgaggcggcggtgctggtcaagaagtcccagctgtcggccgacgacgacgagggctcctcctgcgacgagaacttcgttgccaccgaggcttccggcactctgccggagatcgaggcccgggtgtcggaccgcacagtgctggtcaggatccactgcgagaaccgcaagggggtgctcatcgccgccctctctgaggtcgagcgccttggcctctccatcatgaacaccaatgtgctccccttcacagcctcctccctcgacatcaccatcatggccatggctggtgacgacttctgctggtctgtcaaggatattgtcaagaagctaaatcaagcgttcaaatcatccttctgatgggtttagcttctgaccaaacttaatctaggccaacctttttttccattagccttaaggatttgaggctaatggtaatgttttcaggttcttccttgccttgcttccgaagagagttgcttgctgtcccccaacagtgcccccccaaagatagccatttccactgttttttgctgcatgggtgcagaggtttattacctagttacccaccatcctattttctctccctccagttttttacatggtttgatcctgtcactccatgtttttgggagggagcagattgtaaaaaaaaacaaaaagaagtgaccagcctttttctagggctttgctatataggccggggagttcctaattttcctctctcccctttgccagtatgtttgccctttcaccttgtttttccatgagaggattgtgtttgtcaaacacacaaaaaaaaccctacctttgccgtcctctcaatcttgatcacactgctcccaggaaagcttcaattgtggagaaaatggcaccatctttttttcagctctgagggggactttgcaagccttgatttggaagtactgtaggggtgccacttccttttttttttgagggtcctacaggttggccaccacttgatggaccctttgcttatagttccacatgtgagctttgttgtcacaggatcaatgtgtagttgttgctgtttactctcacacaagcataaaaataaataaatgtgctagtttgttacctttcatg

SEQ ID NO: 2048 - DNA, 2044 bp, Zea mays
attcgcctctgcgcgcaatgcagtgatctccccccccctctctctctctctacctaactcttgtctgttgatgctgttcatcaggacctgtgctgagctttggagcagctagtaattaagcctagagcgctagcagtccttttggatttcggttcggaagcaaggcgtgccggactcccaaatcccaatcccaagcaagcagtgtgcagatggcaacgcagtggttctccaacatggtgatggacgagccgagctttttccaccagtggcagtccgacacgctgctggagcagtacacggagcagcagatcgcggtggcgttcggccagggggagccggtggaccacgccgtggcggcggccctggcgacggcgatgcccatgcagctgcagcagcccgcggcggccgagcagccgcaccaccgcccgcgcaaggcggccaaggtcaacaccagctgggactcgtgcatcacggagcagggctcccccgccgcggactcctcctcgccgaccatcctctccttcggcggccacaccgcgttcgccaaggcggagccgacgacgcaccagccgcccagctgcgccgggtactacggcgccgccgccgccgccgcgaaggcgccgaagcaggagatgatggacgccgccgcgatgccgccgttccagcaggcgcgcccggccaagcgttcctacgacgacatggccgcggtggccgaggccgccaacgcgccgtccgccaacacgcgcccggcctcccagaaccaggaccacatcttggccgagcggaagcgccgcgagaagctcagccagcgcttcatcgccctctccaagatcgtccctggcctcaagaagatggacaaggcatcggtgctcggcgacgcgatcaagtacgtgaagcagctgcaggaccaggtgaaggggctggaggacgacgcccggcggcgcccggtcgaggcggcggtgctggtcaagaagtcccagctgtcggccgacgacgacgagggctcctcctgcgacgagaacttcgttgccaccgaggcttccggcactctgccggagatcgaggcccgggtgtcggaccgcacagtgctggtcaggatccactgcgagaaccgcaagggggtgctcatcgccgccctctctgaggtcgagcgccttggcctctccatcatgaacaccaatgtgctccccttcacagcctcctccctcgacatcaccatcatggccatggctggtgacgacttctgctggtctgtcaaggatattgtcaagaagctaaatcaagcgttcaaatcatccttctgatgggtttagcttctgaccaaacttaatctaggccaacctttttttccattagccttaaggatttgaggctaatggtaatgttttcaggttcttccttgccttgcttccgaagagagttgcttgctgtcccccaacagtgcccccccaaagatagccatttccactgttttttgctgcatgggtgcagaggtttattacctagttacccaccatcctattttctctccctccagttttttacatggtttgatcctgtcactccatgtttttgggagggagcagattgtaaaaaaaaacaaaaagaagtgaccagcctttttctagggctttgctatataggccggggagttcctaattttcctctctcccctttgccagtatgtttgccctttcaccttgtttttccatgagaggattgtgtttgtcaaacacaaaaaaaaccctacctttgccgtcctctcaatcttgatcacactgctcccaggaaagcttcaattgtggagaaaatggcaccatcttttttttttcagctctgagggggactttgcaagccttgatttggaagtactgtaggggtgccacttccttttttttttgagggtcctacaggttggccaccacttgatggaccctttgcttatagttccacatgtgagctttgttgtcacaggatcaatgtgtagttgttgctgtttactctcacacaagcataaaaataaataaatgtgcttgtttgttac

SEQ ID NO: 2049 - DNA, 1242 bp, Setaria italica
atggcgacgcagtggttctccaacatggtgatggacgagccgagcttcttccatcagtggcagtcggacgcgctgctggagcagtacacggagcagcagatcgccgtggcgttcggccagggggaggtggaccaggccgtggcggcggcgctgacgatgccgctgcagcagccggcgccggcggcggagcaccgtccgcgcaaggcggccaaggtcaacaccagctgggactcgtgcatcacggagcagggctcccccgcggactcatcctctccttcggcggccacgccgccgcggccgcgttcgccaaggccgaggcgcaccaggtgcccagcgccccctactacggcgcgcccgcgaaggcgcccaagcaggaggttgtggacgccggtgcgccgtcgttccaccaggagcgccaggccaagcggagctacgacgccatggtcgccgaggccgcgaaggtgccggtgccggcgaccacccggccggcctcccagaaccaggaccacatcttggccgagaggaagcgccgggagaagctcagcgagcgcttcatcgcgctctccaagatcgtgccgggcctcaagaagatggacaaggcgtcggtgctcagtgacgcgatcaagtacgtgaagcagctgcaggaccaggtgaagggcctggaggacgaggctcgccggcggccggtggaggcggcggtgctggtcaagaagtcccagctgtccgctgacgacgacgacggctcatcctgcgacgagaacttcgtgggcgctgaggccgcaggcacgctgccggagatcgaggcccgggtgtcggaccgcacggtgctggtcaggatccactgcgagaaccgtaagggcgcgctcatcgccgcgctgtcggaggtcgagcgcctcggccttaccatcatgaacaccaatgtgctccccttcaccacctcctccctcgacatcaccatcatggccatggctggtgacgacttctgcttgtctgccaaggatattgtcaagaagctaaatcaagcgttcaaatcatctttctgaagggtttagcttcctgatcagacaaagcttaatctaggccaacttttttcccatcagcctcgaggattcgaggctaatggttagtttctcaggttcttccttgccatgcttccgaagagagttgcttgcagtccccccacagtgcccccacaaagatagccatttccactggtttttgctgcatgggtgcagatgaatt

SEQ ID NO: 2050 - DNA, 2065 bp, Panicum virgatum
gctccggacaaaagggaccagacctcacccccatctctccaatctccacaggacttgttgagcttcaagcagctagtagcctacagcactagcagtcctttggatttcggtttggaagcaggggcgtcccaatcccaagcaagaactctgcagatggcgactcagtggttctccaacatggtgatagacgagccgagcttcttccaccagtggcagtcggatgggctgctggagcagtacacggagcagcagatcgccgtggcgttcggccagggggaggtggaggtggaccaggccttggcggcggcgctgatgccgctgcagcagcccacggcggcggcggcggagcaccgccctcgcaaggcggccaaggtcaacaccagctgggactcgtgcatcacggagcagggatcccccgcggactcctcatccccgaccatcctctccttcggcggccacgccttcgccaaggccgaaacgcaccagttgcccagcgccccctactgtggcgcgcctgcaaaggcgcccaagcaggaggtggtggacgccggcgcgacggcgttccaccaggagcgcccggccaaacggagctacgacgccatggtcgccgaggtcgccaaggtgccagccccggccaccacccggccggcctcccagaaccaggaccacatcttggccgagcggaagcgccgcgagaagctcagccagcgcttcatcgccctctccaagatcgtccctggcctcaagaagatggacaaggcgtcagtgctcggcgacgcgatcaagtatgtgaagcagctgcaggaccaggtgaagggcctggaggatgaggctcgccggcggccggtggaggcggcggtgctagtcaagaagtcccagctgtctgccgacgacgacgacggctcgtcctgcgacgagaacttcgtgggcactgaagctgcaggcacactgccggagatcgaggcccgggtgtcggaccgcacggtgctgatcaggatccactgcgagaaccgcaagggcgcgctcatctccgcgctgtccgaggtcgagcgcctcggcctcactatcatgaacaccaatgtgctccctttcaccacctccaccctcgacatcaccgtcatggccatggctggtgacgacttctgcttgtctgtcaaggatattgtcaagaagctaaatcaagcgtttaaatcatctttctgaagggttgagctcctgatcagacaaagcttaatctaggccaactttttcccatcagcctcgaggattcgaggctaatggttaggttcttccttgccatgcttccgaagagagttgcttgcagtcccccccacagtgccccccaaagatagccatttccactggtttttgctgcatgggtgcagatgaattacctagttacctaccctatcctattttctctccctccatttttacatggtttgatcttgtcactccatgtttttaggagggagtagagtgtaaaaaaaaatcagagacctgtcttttttctagggcttgttataggccggggagtttgacttttacaaaacctaatttttccacctttttctttctcccctttgccagtatgttgccctttcaccttgtttcttccatgagaggatagtgtttttcaaacacaaatacctacctttgccgtcctctcaatcctagtcacactgctcccaaaaaagcttcgattgtggagaaaatggtgccatcttttttcagctctgagggggactttgcaagccttgattcggaagtacagtaggggtgcctcttcctttgtttttttgagggtccaacaagttgggttagccgcaacttgatggaccctttgcttgtagtttttgacatgtgagttttgttgtcagttgtcacaggatcgagatgtagttgtgctctttgtttactcgcatacaagcataaaaataaataaatgtgctcggttgttacctttcgtggctttcttggttacatgtcatttaagcttactcaagacatgtcttttgttattgttgagaaactttgcaaattgttgatggacgcgattgtaagt

SEQ ID NO: 2051 - DNA, 2023 bp, Oryza sativa
attggtggaaacgaaagagacctgaccccccccccccccccccaatctccataggagtgtgatttgagctctcaagaccccccatctttggtttcgaggaattaatcgtcgagggaagaagggaagtagaaatggcgacgcagtggttctccaatatggtgatggatgagccgagcttttttcaccagtggcagtcggatgggctgctggagcagtacacggagcagcagatcgccgtcgcgttcgggcaggccggcgaggcggacgcggcggcggcggcggcggcgatgatggtgcagcagcagcagtacgcggcggcggcggcggcggagcaccggccgcggaaggcggcgaaggtgaacaccagctgggactcgtgcatcacggagcagggctccccggcggactcctcctcgccgaccatcctctccttcggcggccacgccgacgccgccgccgccgcggcgttcgccagcgcggggcaggcgcagagcgccccgtactacggcggcgcctccgccgcggccttgaagcccaagcaggagctggacgccgccgccgcgcccttctcccaggcgcgcccggtcaagcggagctacgacgccatggtcgccgccgacgtcgccaaggcccccgccgccgccgcctcccggcctgcctcccagaaccaggaacacatcctcgccgagcggaagcgccgcgagaagctcagccagcgcttcatcgccctctccaagatcgtccctggcctcaagaagatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggtttttaatcttcctactacatttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaacgtaaaaaagagacctgtctttttctagggcctgtttatcaaggggagtttgactttatcaaaaaaaccttattttcatttctccccttctgcaatgttgccctttgatttcaccctgtttttctatgagaggattgaggtttttcaaacccaaataccaacctttgctggcatctcatacactatcctatcacacactgttcccaaacccaaaaggcttcaaattgtggagaaaatggtgccttccttttttcagctctgaggtggacttttgcaagctcttgattcagaagtagtgtagggtgtgtgtctctcttctcttttttagggtcatacaagctggccccagcttgattgcaccctttgcttgtagtctcctttgtgggttttgttgtaacaggatcaagatgtagctgttccctcttgtttacacaagtataaaaataaataaatgtgcttgttgttaactttatggct

SEQ ID NO: 2052 - DNA, 1445 bp, Zea mays
atcctacccatcccattcccactccgccactcggccactcgacaccaccctccgcgctccgcatccgctcctccctctgctgccgtgccggtgccgctagccatccccacttctcacccgccccctctcctctactgccgccagccgcaacaaagatatggatagagcggccgcgacagccgcagacattatcgtcatgatcccatcgctctcgccttcgcctttgtagcactacctcctcgtccatccgcccccctatttcgtcccactcgggttgctagatcggactggatctctctgcccgtttcttggagcagagatggccgaaatgaccgtgactgtcgcggccgccaaaagcaccctccggacgtgccccggcgcccgccgtgctgcggttcttggtcggtggatgcctcttgcaccagcggcgcccgccaacttgaaattgttctctccagctgtgagggttccaagggctacttcccctgcggcggttgaggatgggagcaacactgatatagtccctatcccgaaagttataatagaccaagactcagatccggatgcaaccattgtagaaataaccttgggtgatcgtcttggcgatctccttgatacgatgagtgcgctaaagaacttggggctaaatgttgttaaagctagtgtctgtctcgattctactggcaagcatatcaagtttgctataactagagcgttcactggccgtaaaattgatgatccagagttgttagaagcagttcgactgacgatcattaacaacatgatacagtatcatccagagtccagcagtcaattggctatgggggcaacttttgggccagaagcccctacggaagaggttgatgtggatatagcaacccacatagatatctatgatgatggccctgaaagaagcttacttgtggtggaaacagcggatcgtccagggttactggttgaccttgttaagatcatctcggacatcagcattaatgtccaatctggagagtttgacactgaggggctcctggctaaagcaaaattccatgtcagctacaggggcagaacactgaccgaggctttacaacaggttctttgtaatagcttgcgctatttcttgaggcggccgacaacagaggacgccagcttctagccagatagatgatcatgaagcctcccaactttcttatgtggtggtattcacatgaattgaataccatcgtcaaagcatttgaaacacgcacaataatttgttaagatggggggaattgtacttgatgttatggcaccacaccaattcgaagtattttttgttccaaggcacgggaatctgttgtatccaagtgcagaagattgctattcttaatcatgtaataacacattattattttgctacttgggatacaccgtttggtggtaaataagatggaatattgtgggggccc

SEQ ID NO: 2053 - DNA, 1340 bp, Pennisetum glaucum
tgaggtgaggcgaagggaagagcagagaggagagcacaaggccacccacctccctcacattccggaacccgtcctatggatagagcggtcgcgacagccgcagacatcctcgtcatgatcccatcgccttcgccttcgcctttgtagcacgcctcctcatccacccgccccctgtttcttggccactgcttcctggactggatcggattggatctccgtccacccgccttttggaggagagatggccgaaatggccgtgaccatcgttgccgccgccgacggcaccctccggccgtgcaccggcgtgtcggtgcgcagtgctgcggttcttggccggtggcggcctcttgccccggcggcacccgctaagctgagattgtcctctccagctgtgagggttcctagggctgcttcccctgcggctgttgaggatgggagcaacactgatacagtccctatcccgaaagttataatagatcaagactcagatccggatgcaactattgttgaagtaaccttgggtgaccgtcttggcgatctactcgatacaatggatgccctgaagaacttagggctaaatgttgtcaaagctagtgtctcccttgattccacgggcaagcataacaagttttctataactaaaacgtctaccggccgcaaaattgatgacccagagttgttagaagcagtacgattgacgatcattaacaacatgatacaatatcatccggagtccagcagtcaattggctatgggggcaacatttgggcccgaagcccctgcagaacaggttgatgtggacatagcaacccacatagatatctatgccgatggccctgaaagaagcttacttgtggtggaagcagcggatcgtccagggttactggttgatcttgttaggatcatctctgacatcaacataactgtccaatctggagagtttgatactgaggggctattggcaaaagcaaaattccatgtcagttataggggcaaatctttgactgaggctttgaaacaggttctttctaatagcctgtgctattccttgagacggccgtcaacagaggatgccagtttctagccagataattatgaaggcccccacctgagatgggaatcacatgaatctgatagtattatcgaagttgttgaaatacgcacaataatttttaaaaagatggactgaggaggtatacttgatgttatggcatcacaccaatttatagttaggcaaggaatctgctatatgaagagcagaagactgcgattccaaaaacatgtaacacacgattatttcacctgtgatgcattatttggagataataagatggaacatt

SEQ ID NO: 2054 - DNA, 1496 bp, Oryza sativa
gagctgagggtgaagcacaagctgcccacctcccattcgcatctcgctatcctatggatagagccgccgcgacagccatagatatcgtcgtcatgatcccgtcctcgccttcgccttcgcctttgtagcaccacctccatctccacctcctccgtgcagctgagacccaaccaaaagctgcttccttttcttcttcttgggattgggatcccccccccctcccttcctcggctccgtttcttgccatggccgaaatggcagtcaccgccgccctccggccctgctccggcgtctcgccggcggtgtccgggaccagccaccgccgccgccgccccgccgcgtggcgggctctcgcgccgccgccgccgcacgctgggctgaggctgtcctctcctgctgtcagggttcctagagctgcttcctctgcggctgtcgaggatgggagctctagcaacactgacacagttcctaccccgaaagttataatagatcaagactcagatccggatgcgaccattgtagagataactttgggtgaccgtctcggtgatcttcttgataccatgaatgccctgaagaatttagggctaaatgttgtgaaagctagcgtctgcctcgattctactggcaagcatattaagttagctataacaaaattgtcgactggtcgcaaaattggtgaaccagagttgttagaagcagtacggctgacaattataaacaacatgattcagtaccacccagaagctagcagccaattggctctgggtgcaacttttggtccagagccccctacagaactggttgatgtggacatagcaacccacatagacatatatgatgatggccctgacagaagcttacttgtagtggaaacagctgaccgaccaggtttgttggttgaccttgttaagatcattgatgacatcaacatcaccgtccaatctggagaatttgacactgagggcctactggctaaagcaaaattccatgtcagttataggggtaaaccattgatcaaagccttgcagcaggttcttgctaatagcttgcgctatttcttgaggaggccgacgacagaggagggcagttactaggcagataaatacaggaagccccccaccttcagatactttgtgatacatggatttgataccatcatcaaaattattcttgaaatatgcaaacaatttatcaaaagcttggaggtatacttgatcttatggcttatacaaatttaagctgttcccatttgaaggtaggacatctgctgtattaactgcagaagccttccaagattacatgctagtgcgattctcaagcatgtgacacttgataattttggtatttaggatgcatgtttgatggtaaataagaaagcaagttggggggccatgcatcaactgttctggtgaaatgtagctgtattgttctctccattatctgattaataaagattaccaataaataaatgtggtgaaagatttgacaattta

SEQ ID NO: 2055 - DNA, 3751 bp, Oryza sativa
ggttactcctcttcctcgctcgctcgctcgctgccttagccttgacctccatcgatattgcaaccataaagaggaggaggaagaggaggcgagaaagagagagagatcgtcttcttctccagccagccagccagccgtgattgatctcaagggggaaggcagctgcagggatcaagaagaaggagaagaagtgatcaaggaaggaaggccacggaacaaccgacagggcaggagggcgctggccggatcgccggagaaggaaccactagctagctagctagctactcctattgaagatatcgccggccggacatatgcgcaggatgttcggggactgccaggtcctgtcgtccatggccgccatggccggggccgcctcctccgccgacgcgctcttcgcctcgccgctcatccccaaccccgctctcgccggcttcatgtcctcctccgccgccatgcccttccaccacttctccaacgccgccgccaccttaatacctaaggaggaggggttgatgggcggcctccatgtggccaaggacgaggggatggacctcgagatggacatggagctcagtggcggctccggcagcgcccacctcgacggcctcctcagcttcgccgacgtcgacgacgaccacaagccgcagcacagcggccatgaccagccgcccgacgccgcccagcccagcggcgccgcggggggcaacgccaagaagaagcgctaccaccgccacacggcgcaccagatccagcagatggaggcgctgttcaaggagtgcccgcatccggacgacaagcagcggctgaagctgagccaggaactgggcctcaaacctcgccaggtcaagttctggttccagaatcgccggacccagatgaaggcgcagcaggacagggcggacaacgtgattctgcgcgcggagaacgagaacctcaagagcgacaacttccgcctccaggccgccatccgcaacgtcgtctgccccaactgcggccacgccgccgtcctcgccgacatgtcctacgaggagcagcagctccgcatcgagaacgccaggctcaaagacgagcttgaccgcttggcctgcatcgccacccgctacggcggcggcggcggacggcagccggtgctgtcgacgtcggccctgagctgcatctcggcgccgccgccggtcctcatgccaccgctcgacctcgacatgaacgtctactcgcggcacttcgccgagcaggcgccggtcatgggctgcggcgacctcatcccgccacccgtcgtgccgcagcacgatggcgcggcggcgtacatgggcgccatgatggcgcccgtgcaggagcaggacaagcagctggtggtcgacctcgccgccacggcggcggaccagctcgccaggatgtgccgcgccggcgagccgctgtgggtgcggcagcgtggcgcggaggtgatggccgtggaggagcacgcgcggatgttcagctggccggtggacggcgcgaagcagggagacggcggcgcggtggcgagggcggaggggacgcgtgacaacgcggtggtcatcatgaacagcatcaacttggtggacgccttcctcgatgcgaacaaatggatggagctgttcccgtcgattgtttgcaaggcaagaacaatccagatcataaaccacggagctgcgtctggtcacctcggcagtggaactctcctcttgatgcaagcagaggtgcagttcttgtcgcctctggtggcggcgcgcgaggtggtgttcttccgttactgcgtgcacaacgccgacgaggggagctgggcgatcgtggatttcccggcggaagggtttgaggaggggctcctccaagcctcggtggtcaggtgccggcggcggccgtccggctgcatcatccaggacatgcccaatggatactccagggtggtgtgggtggagcacatggagatggtcggggaggagaagccgctgcagccggtgttcagggactacgtcgccagcggcgccgccttcggggccacgcgctggctctccatcctccagcgccagtgcgagcgcctcgccagtgagctcgcccgtaacatcgccgacctcggagtgatccgcacccctgaggcaagaacaaatatgatgaagctgtcgcagcggatgatcaccactttctgtgctaacatcagtgcttctggaacccaatcttggacggccctctcggattcaacccaggacactatcagggttacaactcggaagaacactgagcccggacagcccagcggtgtcatcctcaccgctgtctccacaagctggcttccttttacccatcagcaggtgtttgagcttcttgcagatgaacaacagcgctgccagcttgagattttgtcaaacggcggctcccttcatgaggtggcacatattgcaaatggatcacatccaaggaattgcatctctcttcttcgcattaacgctgcaagcaactcgtcacagaatgtggagctcctgctgcaggagagcagcacccaccctgatggtgggagcctggtggtgttcgcgacggtggacgtggacgcaattcaggtgacgatgagcggcgaggatccttcctacatccctctcctccccctgggcttcgccatcttccctgccaccagcccatcacctgctgctgcacccaccatcagctcaagcaccaccaccaccactggcaatggcaatggcgaaaccagtagcactcctccaagaaacagcagcagcaacaacaacaatgcagatgagctgctgcctcccaatggctgcctcctcaccgtcggcatgcaggtgctggccagcgccgtaccttctgccaagctcaacctctcgagtgtcactgcgatcaacagccatgtctgcaacgccattcaccagatcacagctgcactcaaaagttcagcaggtggtgctgggggtgagccggcgtccgatcagtagcaaaggagacctggaggagaggggatcggagcaacatgggatcagacaccaaaatgcctcccaatttatttcgctaacatcgcagtttgtttttctgttagctctcggtctggctggttcatcaggtgcaagggagggtttgacaagaagccaacactaacagctactcaaatctctcctctcttcccgccatatttctgcctctcaaaatgacgaaaatacccccaaccagccaacaagcaaagccatggggggcattttgatcattttgggaagctacttctgctgagaaagaaagaaagaaagaaagggtcttgtcaagctctcacttgcaccaaccagctgattcatgaatttgctgacatcagctctgcaggcattttggtcgtgcatcggtttcttgctactccatccatccctctttaggttcttcctccctttcctcatcaaaagtgagaactgcatgtgaagaaggttagctccttgttttgaatttttgtaataataagatggaagaagaagacttggtagcttgagtgtgtggtttgtgttaagatcgagctagactttgtgtaaggttgaagaagaagaagacattaagcagattgttattaggagatgagataagagaaaggaggagaggagaagtcaagagcgaaccagttgtgacccttcttcacactagaagggggtcttggttcgggaattgacttgttacctctctgcactctttgtctgtaacctttgccctatcttattattactactagtattgttcattttttacc

SEQ ID NO: 2056 - DNA, 801 bp, Saccharum officinarum
ctccatccatcccgtcagagagccacacgttgagcgaggacccaaattccatcaccacaacgcccacaaacttgatgcagggggtagcaatggcgaggagaagctaaaccgcgccaatcagagcggcagaggtagcagctagctgcacaaacttgagcacctacctctgtactgtgcctgtttcagttggtacacgatgctacacccattgctggcggcagtaactgctgccgcctcttcgtccttcgtctcaccgccgcggcgagtcccagcttctccgggacgacgacggcgtcctggtggcttcgcggtccggtgcgcgccgaacggaggtggcgtgacagcagacgacacgaaatcgaagctcaaggtgggctccccgatcgtcatcctcgaggcgcctgtgatgctcaagaccgccgcgtcggtgccgtcgctccggcacaacagcggtcaggtcaaggccggcgacgtcggaaggatcatggcgcggaagcccaaggacgtctgggtcgtgcggctcgccgtcggctcgtacctgctggacggcaagtttttcagtcccttggattctaacgacggagacgacgatgagccccaggcccaggatgaatgagtgatcgatggcctaacggttgaatcgcaaagttactcacaataatggttgtgcaaacatggtcatgcttatgcgtgattgcaattgcaatgtaagatcaccatgtgttacttctggccacagtagttagcgattactatttgtaattagaatcctgaacttatcttaaaaggaaaaccaagttc

SEQ ID NO: 2057 - DNA, 800 bp, Saccharum officinarum
  misc_feature (631)..(631): n is a, c, g, or t
  misc_feature (647)..(648): n is a, c, g, or t
ctccatccatcccgtcagagagccacacgttgagcgaggacccaaattccatcaccacaacgcccacaaacttgatgcagggggtagcaatggcgaggagaagctaaaccgcgccaatcagagcggcagaggtagcagctagctgcacaaacttgagcacctacctctgtactgtgcctgtttcagttggtacacgatgctacacccattgctggcggcagtaactgctgccgcctcttcgtccttcgtctcaccgccgcggcgagtcccagcttctccgggacgacgacggcgtcctggtggcttcgcggtccggtgcgcgccgaacggaggtggcgtgacagcagacgacacgaaatcgaagctcaaggtgggctccccgatcgtcatcctcgaggcgcctgtgatgctcaagaccgccgcgtcggtgccgtcgctccggcacaacagcggtcaggtcaaggccggcgacgtcggaaggatcatggcgcggaagcccaaggacgtctgggtcgtgcggctcgccgtcggctcgtacctgctggacggcaagtttttcagtcccttggattctaacgacggagacgacgatgagccccaggcccaggatgaatgagtgatcgatgccttnacggttgaatcgcaannttactcacaataatgttgtgcaaacatggtcatgcttatgcgtgattgcaattgcaatgtaagatcaccatgtgttacttctggccacagtagttagcgattactatttgtaattagaatcctgaacttatcttaaaaggaaaaccaagttc

SEQ ID NO: 2058 - DNA, 853 bp, Zea mays
ccagtcattggcgccaccgccactgcagcgcgcaagcacgcacgcacatttcaattcatccaaaaaaaaagtgagttccccatcatcttcatccatcccgtcggagccacacgttgattagagcggcagttgaagcgcctagctgcacaaacagtctgcacaatgcctgtttgttccatttggtatagcatgccgcacccgttgctcgcggcagtaagtgctgccgtctattcgtccttcatctcaccgccgcggcgtgtcccagcttctctgggacgacggcgtcctgccggcgtcgccgtccggtgcgcgccgaacggcggtggcgtgcccgcagcgggcgacacgaaagcgaagctcaaggtgggctccccgatcatcatcgtcgaggcgcctgtgatgctcaagaccgccgcgtcggtgccgtcgctccggcacaacagcggtcaggtcaagcccggcgacgtcggaaggatcatggcgcggaagcccaaggacgtctgggtcgtgcggctcgccgtcggctcgtacctgctggatggcaagtttttcagtcccttggattctgacaacggagatgatggtgagccccaggcccaggatgaatgagtgatcaatgccttaacggtatgattgaatcgcatgtttactcacatgtcgtgcagacatgtccatgcttatatgcatgattgcaatttgcaatgtaaggtccatgatgtgtaacttctgccgacagcgagtgattactatctgtcttattatcaacttatcatagaggggaaacacagcttcaatattctaattttgagtacaacctcactttttgcacaatcaaatagagattgttatcctc

SEQ ID NO: 2059 - DNA, 853 bp, Zea mays
ccagtcattggcgccaccgccactgcagcgcaaaagcacgcacgcacatttcaattcatccaaaaaaaaagtgagtaccccatcatcttcatccatcccgtcggagccacacgttgattagagcggcagttgaagcgcctagctgcacaaacagtctgcacagtgcctgtttgttccatttggtatagcatgccacacccattgctcgcggcagtaagtgctgccgtctattcgtccttcatctcaccgccgcggcgtgtcccagcttctctgggacgacggcgtcctgccggcgtcgccgtccggtgcgcgccgaacggcggtggcgtgcccgcagcgggcgacacgaaagcgaagctcaaggtgggctccccgatcatcatcgtcgaggcgcctgtgatgctcaagaccgccgcgtcggtgccgtcgctccggcacaacagcggtcaggtcaagcccggcgacgtcggaaggatcatggcgcggaagcccaaggacgtctgggtcgtgcggctcgccgtcggctcgtacctgctggatggcaagtttttcagtcccttggattctgacaacggagatgatggtgagccccaggcccaggatgaatgagtgatcaatgccttaacggtatgattgaatcgcatgtttactcacatgtcgtgcagacatgtccatgcttatatgcatgattgcaatttgcaatgtaaggtccatgatgtgtaacttctgccgacagcgagtgattactatctgtcttattatcaacttatcatagaggggaaacacagcttcaatattctaattttgagtacaacctcactttttgcacaatcaaatagagattgttatcctc

SEQ ID NO: 2060 - DNA, 750 bp, Sorghum bicolor
agagcctacgcgcgcggcgctcgcggcaggagctggctacccctcgaggtcgtcagggagcggcgtcgccgcgcccgcacgagacggcggagctggacgcggcggaggcgtcggcgttcgtcgccggggagtcggcggagcagcgcaaccgcttcctggtgctgtggctgtacgaggcgctcaacgcccgcgacgcgcgccgggcgcaggagctgctggcgcccgacctcgagtggtggttccatgggccccccacgcgccagcacatgatgcgcctcctcaccggcgcggaccagcgcgacaagagccgcggcggtgggggagtaggattcgtcttctccccgcgctccgtcgacgccttcgggtccaccgtcatcgccgagggcgcggacgacgcgcgccagctctactgggtgcacgcctggaccgtgggacccgatggggtgatcacgcagctcagggagtacttcaacaccgacctcaccgtcaccctcctctccggcgccgccgcctccgccaagaaagctgacattgcaggcgctccgcgtaagcagcaggacgctgcctcttcttctttctcgtccccctcggcagctgcagggcccaaatgcctgtggcagagccgccgcggcgacagcgcacacaagtcgctgccaggcctcgtcctcgccatctgagagtcgagacagcaagatccatctactacccagtctaccctccattataataagataataacagtataaagat

SEQ ID NO: 2061 - DNA, 1134 bp, Panicum virgatum
  misc_feature (992)..(992): n is a, c, g, or t
cgctctcgttttgccatcaccactctgcttgctcttcccctttgcagggtagtctccgcgttcccgagagaagaggtcgaggagcctgcgcgaggctcgcgtctggagctggctacccaccaccagggtcagggagcggcctcgccgcgcccgaacgaggcggcggagctggccgccctcgcggggacggaggagtcggaggagcagcgcaaccgcttcctggtgctgcgcctctacgaggcgctcaacgcccgcgacgcgcgccgggcgcaggagctgctggcgcccgacctcgagtggtggttccatggcccccccgcgcgccagcacatgatgcgcctcctcaccggcgccgagaaaggcagcggcggcttcgtcttctccccgcgctccgtcgacgcctttgggtccaccgtcatcgccgagggcgccgacgacgcgcggcagctctactgggtgcacgcctggaccgtgggacccgatggggtgatcacccagctcagggagtacttcaacaccgacctcaccgtcaccctcctctccggcgccgcctccgccaagaacgccgcaattgcagccgctcctccgaagcaggacgccgcatcttcctcctcctcctcggcgccttccgcgggcgcctcctcctccacaggccccaagtgcctgtggcagagccgccgcgccgaccgcgcgcacaagtcgctgccgggcctcgtcctcgccatctgatcggcagcagagacggcaagagtgacctgatcccctccataactaatccaataaaccaccggaaaattacatagtatttgcgcataaataatctgcaactggtctagccttttaccaggtaattaatgatcaaagccaatcagtcggtgaaggcgtatggtctgaactgaaactgctgcgagttgtggggttccgttaccggttgcattgctcagcgtgtgtgtgttggattagtagtgtgataagtccaagtcctcgtgtcnaaaaaaaaaagtccaagtcatggactatggtgtgtactgctgccattactactatcgtggtggtctattatggtctgatggaagtgatggtctgttgtggtcgaatgaaagttgcttgagttggagggttaagcaactggcc

SEQ ID NO: 2062 - DNA, 2306 bp, Zea mays
ccgagacaaccccggccatccccacacccgcatcgcacacacagacacaggcacatacacaggcggagaggccaccagcccagaccagagcaaaaacccaccgttcccacacccagcgctcaatttgaaccaacgcgaacgcgacgctctcaagccccaacctaatctacgatctccctccgaccgaaacgaaatctccgcctcccctgcgcccctgccctgcgcccctgcataggaggaaagaaacgcacgcacgcacgccccccgcggcaaagggaaccgtcgccgcgttgcgagagtccgggaaactgaagcggagcagcggaggagaggccgaggccaggaggagagggtaccggcggccatggagcggtaccatccctcagaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcggtggcggccctgtccgaccacggtgtctgcgtccgcaagggctacatctcctccgacgacggccgctggttcatggacgtgttccacgtgaccgacgccgcgggccgcaaggtggccgacgccgacgccgacgccctgctggcgcggctcgagtcctcgctctcggccgacgcattgccgcctcgcacgccgcccgccgctgcggctgggacgcccaccctgctcgagctcgtcggcgccgaccgcccgggcctcctctccgaggtcttcgccgtgctgcacgacctccgctgcgacatcgccgacgccagggcctggacgcacggcggccgcgtcgccgcgctcgtgttcgtgcgcgacgaggacacgggcgcgcccatcgacgacgcggcgcgggtccggcgcgtcgagtccaggctcaggcacgtcctccgcggcggcgcgctcggcgccaggatggtccgggcggacgccgcggccgtcaacatggaccggaggctccaccagctcctcaacgaggacggggaggccgagagccgcgccgaccaggccacggcggtcgccgtgcaggattggggggagagggggtactcggtgctcaccgtgagctgccgtgaccgccccaagctgctgttcgacgtcgtgtgcaccttgacggacttggattacgtggtgtaccacggcacgttcgatacggacggcgatcacgcccagcaggagttctacatcaggcggttggacgggcggccaattagctcggcggccgagaggcggcgcgtgatccaatgcttgcaagcggccatcgagaggcgcgcatccgagggcgtgaggctggagctgcgcatcaccgaccgccgcgggctgctcgcctacgtcacgcgcgtgttcagagagaacagcctctcggtgacgcacgccgagatcaccaccaggggcgacatggccatgaacgtgttccacgtcaccgacgtggccggccggcccgcggatcccaagaccatcgacgaggtgatccagaggatcggcacggagagcctccgggtggacgaggaacggtggccgcgcctgtgcttgacagagggtgacgcgggccgcggcggtgcggggatcttctcgctcggaagccttgtcaagaagaacctggccagccttggcctcataagatcctgctcgtgaggacgcacgcaaccaagtgggcacgtgctcgatggggtccttgtgtaaatatgggatggtgcatgggttagtttgtaaatggagtagggatttaatttgacgtttctaggtttagttgccacgtgtacatagtagcaagtggagatggaaggttttaagagttgctggtcggcaacagcctggagcttaaagggcctctttggtgggtcatgacataccatgtatccatatctagctttttattttacataaaaatagatggatggaagaattaagtataatacgagtcctatatgcctatacggttgtaactgaataattttgttgacctccgtccttggctcttgtggcatgcgctgcgaaagcgcgaaagttctgctccgagatctcgaggcattttttaaattaagcagagccggccagtgagaggttgtaaagaagcctcgtttccggcatcctgaatctcatatgggtcaataccctgattcggccctgaatcttaataacctgttagagttcatatctcatctactatttcatcatctattttaaacttttctctttaatcagtgtcaacttacagtttcatgtttcctattttaggcactctaccaaaaac

SEQ ID NO: 2063 - DNA, 1983 bp, Zea mays
agaccagagcaaaaacccaccgttcccacacccagcgctcaatttgaaccaacgcgaacgcgacgctctcaagccccaacctaatctacgatctccctccgaccgaaacgaaatctccgcctcccctgcgcccctgccctgcgcccctgcataggaggaaagaaacgcacgcacgcacgccccccgcggcaaagggaaccgtcgccgcgttgcgagagtccgggaaactgaagcggagcagcggaggagaggccgaggccaggaggagagggtaccggcggccatggagcggtaccatccctcagaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcggtggcggccctgtccgaccacggtgtctgcgtccgcaagggctacatctcctccgacgacggccgctggttcatggacgtgttccacgtgaccgacgccgcgggccgcaaggtggccgacgccgacgccgacgccctgctggcgcggctcgagtcctcgctctcggccgacgcattgccgcctcgcacgccgcccgccgctgcggctgggacgcccaccctgctcgagctcgtcggcgccgaccgcccgggcctcctctccgaggtcttcgccgtgctgcacgacctccgctgcgacatcgccgacgccagggcctggacgcacggcggccgcgtcgccgcgctcgtgttcgtgcgcgacgaggacacgggcgcgcccatcgacgacgcggcgcgggtccggcgcgtcgagtccaggctcaggcacgtcctccgcggcggcgcgctcggcgccaggatggtccgggcggacgccgcggccgtcaacatggaccggaggctccaccagctcctcaacgaggacggggaggccgagagccgcgccgaccaggccacggcggtcgccgtgcaggattggggggagagggggtactcggtgctcaccgtgagctgccgtgaccgccccaagctgctgttcgacgtcgtgtgcaccttgacggacttggattacgtggtgtaccacggcacgttcgatacggacggcgatcacgcccagcaggagttctacatcaggcggttggacgggcggccaattagctcggcggccgagaggcggcgcgtgatccaatgcttgcaagcggccatcgagaggcgcgcatccgagggcgtgaggctggagctgcgcatcaccgaccgccgcgggctgctcgcctacgtcacgcgcgtgttcagagagaacagcctctcggtgacgcacgccgagatcaccaccaggggcgacatggccatgaacgtgttccacgtcaccgacgtggccggccggcccgcggatcccaagaccatcgacgaggtgatccagaggatcggcacggagagcctccgggtggacgaggaacggtggccgcgcctgtgcttgacagagggtgacgcgggccgcggcggtgcggggatcttctcgctcggaagccttgtcaagaagaacctggccagccttggcctcataagatcctgctcgtgaggacgcacgcaaccaagtgggcacgtgctcgatggggtccttgtgtaaatatgggatggtgcatgggttagtttgtaaatggagtagggatttaatttgacgtttctaggtttagttgccacgtgtacatagtagcaagtggagatggaaggttttaagagttgctggtcggcaacagcctggagcttaaagggcctctttggtgggtcatgacataccatgtatccatatctagctttttattttacataaaaatagatggatggaagaattaagtataatacgagtcctatatgcctatacggttgtaactgaataattttgttgacctccgtccttggctcttgtggcatgcgctgcgaaagcgcgaaagttct

SEQ ID NO: 2064 - DNA, 1746 bp, Pennisetum glaucum
cacaggcaggccacagcgaggtcctctagcccgcaacgcagccaggagccacagcacggacgcagagccgagcgaaatcccaccgttcccgcacccaattttgaaccagcgcggacgctctccgtgccccccaatcccaaccaaatttacgattccccccgaccgaaccgaaatctccgcctgccctgccctgaaagaaacgcacaccccggacgcggcaaagggaaccgtcgtcgcgagcgagagccccggaaactgaagcggggagccgcggaggagaggctgaggggagggaggagggttccggcgatggagcggtgccatccctgcgaggtgtacgagctcttcgtgcgccacatgaacacgccgagggtggccgtggacaacggcgtgtgcgcgacggcgacgctggtgcaggtgcacagcgcgcgcaagcacggcgtcctgctggaggcggtggctgcgctgtcagaccacggcgtctgcgtccgcaagggttacatctcctccgacgacggccggtggttcatggacgtcttccacgtcaccgacgccgcgggacgcaaggtggccgacgccgacgcccttctggcgcgcctcgagtcctcgctctccgccgacgcattgccgccgcgcacgccgccagccgccgccgcgggggcgcacaccctgctcgagctcgtcggcgccgaccgcccgggcctactctccgaggtcttcgccgtgctgcacgacctccgctgcgacatcgtcgacgccagggcgtggacgcacggcggccgcgtcgccgcgctcgtgttcgtgcgcgacgaggagacgggcgcgccgatcgacgacgcggcgcgggtcaggcgggtcgagtccaggctcaggcacgtcctccgcggcggcgcgcgcggagccaggacggtcctcgccgacgccgaggccgtcaacatggaccggcggctccaccagctgctcaacgaggacggggaggccgggagccgcgccgaccaggcggaggcgcccacgacgacggcggtcgccgtgcaggattggggggagagggggtactcggtggtcaccgtgagctgccgcgaccggcccaagctgctcttcgacgtcgtctgcaccttgacggacctggattacgtggtgtaccacggcacgttcgacacggacggcgatcacgcgcagcaggagttctacatcaggcggttggacgggcggccaataagctcggcggccgagaggcggcgcgtgatccaatgcttgcaggcggccatcgagaggcgcgcatccgagggcgtgaggctggagctgcgcatcaccgaccgccgcggcctgctcgcctacgtcacgcgcgtgttccgggagaacagcctctccgtcacgcacgccgagatcgccaccaggggcgacatggccatgaacgtgttccacgtcaccgacgtcgccggccggcccgcggaccccaagaccatcgacgatgtgatccagaagatcggcacggagagcctccgggtggacgaggagcggtggccgcgactatgctccacggagggcgacgccggccgcggcggcggcgcggggatcttctcgttgggaagcctcgtgaagaagaaccttgtcagccttggcctcataagatcctgctcgtgaggacgtgatcgacggcgacgtgtgccccggcgggatccttgtgtaaatatgggatgatgcatggattagtttgtaaatgagtaggagtttattttgccgttt

SEQ ID NO: 2065 - DNA, 2169 bp, Zea mays
accagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaggaggagaggccgaggcagggagagggttccggcggcgatggagcggtacaacccctccgaggtgtacgagctcttcgtgcgccacatgaacaacccgagggtggtggtggacaacggcgcgtgcgcgacggcgacgctggtgcaggtgcacagcgcgaggaagcacggcgtgctgctcgacgcggtggcggccctgtccgaccacggcgtctgcgtccgcaaaggctacatctcctccgacgacggccgctggttcatggacgtcttccacgtcgtcgacgccgcgggcggcaaggtggccgacgccggcgccctgctggcgcgcctcgagtcctcgctctccgccgacgcattgccgccccgcccgccgcccgccgccgcgggggccgggacgcccaccctgctcgagctcgtcggcgccgaccgcccgggcctcctctccgaggtcttcgccgtgctgcacgacctccgctgcggcaccgtcgacgccagggcctggacgcacgccggccgcgtcgccgcgctcgtgttcgtgcgcgacgaggagaccggctcgccgatcgacgacgcggcgcgggtcaggcgcgtggagtccaggctccggcacgtcctccgcggcggcgcgctcggcgcgaggatggtccgggcagacgcctccgccgtcaacatggaccggaggctccaccagcttctcaacgaggacggggaggccgggagccgcgccgaccgggcggagtcggaggcggaggcgcccacgcccacagcggtcgccgtgcaggattgggtggagagggggtactcggtggtgacagtgagctgccgcgaccggcccaagctgctcttcgacgtcgtctgcaccttgacagacttggattacgtggtgtaccacggcacgttccacacagacgacgatcacgcccgccaggagttctacatcaggcggttggacgagcggccaattagctcggcgaccgagaggcggcgcgtgatccaatgcttggaagcggccatcgagaggcgcgcatccgagggagtgaggctggagctgcgcatcaccgaccgccgcgggctgctcgcctacgtcacgcgtgtgttcagggagaacagcctctcggtcacgcacgccgagatcaccaccagggggcgacatggccatgaacgtgttccacgtcaccgacgtggccggccgacccgcggaccccaagaccatcgacgaggtgatccagaggatcggcacggagagcctccgggtggacgaggagcggtggccgcgcctgtgctcgacggagggcgacgctggccgcggcggcggcggtgcggggatcttctcgctcgggagccttgtcaagaagaacctggtcagtcttggcctcataagatcctgctcgtgaggacgcgatcaatggggggcatgtgctccatgggatccttgtgtaaatatgggatggtgcatgggttagtttgtaaatggagtaggggtttaaatcgccgtttctagttctaggtttaagttgccacgtgtacatagtagcaagtggagatggaaggttttaaaagttgctggtcggcaacagcaaggataatggacctctctggtgggtcgtgccatgtgtctatctaacttttacgtaagaaaaagtattatacatggatcgctg

SEQ ID NO: 2066 - DNA, 2172 bp, Zea mays
accagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaggaggagaggccgaggcagggagagggttccggcggcgatggagcggtacaacccctccgaggtgtacgagctcttcgtgcgccacatgaacaacccgagggtggtggtggacaacggcgcgtgcgcgacggcgacgctggtgcaggtgcacagcgcgaggaagcacggcgtgctgctcgacgcggtggcggccctgtccgaccacggcgtctgcgtccgcaaaggctacatctcctccgacgacggccgctggttcatggacgtcttccacgtcgtcgacgccgcgggcggcaaggtggccgacgccggcgccctgctggcgcgcctcgagtcctcgctctccgccgacgcattgccgccccgcccgccgcccgccgccgcgggggccgggacgcccaccctgctcgagctcgtcggcgccgaccgcccgggcctcctctccgaggtcttcgccgtgctgcacgacctccgctgcggcaccgtcgacgccagggcctggacgcacgccggccgcgtcgccgcgctcgtgttcgtgcgcgacgaggagaccggctcgccgatcgacgacgcggcgcgggtcaggcgcgtggagtccaggctccggcacgtcctccgcggcggcgcgctcggcgcgaggatggtccgggcagacgcctccgccgtcaacatggaccggaggctccaccagcttctcaacgaggacggggaggccgggagccgcgccgaccgggcggagtcggaggcggaggcgcccacgcccacagcggtcgccgtgcaggattgggtggagagggggtactcggtggtgacagtgagctgccgcgaccggcccaagctgctcttcgacgtcgtctgcaccttgacagacttggattacgtggtgtaccacggcacgttccacacagacgacgatcacgcccgccaggagttctacatcaggcggttggacgagcggccaattagctcggcgaccgagaggcggcgcgtgatccaatgcttggaagcggccatcgagaggcgcgcatccgagggagtgaggctggagctgcgcatcaccgaccgccgcgggctgctcgcctacgtcacgcgtgtgttcagggagaacagcctctcggtcacgcacgccgagatcaccaccaggggcgacatggccatgaacgtgttccacgtcaccgacgtggccggccgacccgcggaccccaagaccatcgacgaggtgatccagaggatcggcacggagagcctccgggtggacgaggagcggtggccgcgcctgtgctcgacggagggcgacgctggccgcggcggcggcggtgcggggatcttctcgctcgggagccttgtcaagaagaacctggtcagtcttggcctcataagatcctgctcgtgaggacgcgatcaatggggggcatgtgctccatgggatccttgtgtaaatatgggatggtgcatgggttagtttgtaaatggagtaggggtttaaatcgccgtttctagttctaggtttaagttgccacgtgtacatagtagcaagtggagatggaaggttttaaaagttgctggtcggcaacagcaaggataatggacctctctggtgggtcgtgccatgtgtctatctaacttttacgtaagaaaaagtattatacatggatcgctgaaac

SEQ ID NO: 2067 - DNA, 1934 bp, Oryza sativa
gctgactgagccaaacccaacccaacccaacccccccgcccggcgcggccacctcacaagggagcatcggcacagccaaccgcagcgcagcggcagccaaaaacccaccgtttccaattcctcgcccgattttgaaccgctctccgcccgaccgaacctgttccactccgccgagcggaaaaaaaaaacttcttcgccgtctcgaaggaaatttattgggaagaaaccgttgcgggaggcgggcaaactgaagcggcagcggcagcggcagaggcgatggagcggtaccatccctccgaggtgtatgagctcttcgtgcggcacatgaacaccccgagggtggtggtggacagcggggtgtgcgcgacggcgacgctggtgcaggtgcacagcgcgcggaagcacgggatgctgctggaggcggtggcggcgctgtcggagcacggggtgtgcgtccgcaaggggtacatctcgtccgacgacgggcggtggttcatggacgtgttccacgtcacggacgccgcggggaggaaggtggccgacgcggacgcgctactggcgcgcctcgagtcgtcgctgtccgcggaagcattgccgcgggcggcggcgggcggccccgccgcggaggggctcaccctgctcgagctcgtcggcgccgaccgcccgggcctcctttcggaggtgttcgccgtgctgcacgacctccggtgtaacaccgtcgaggccagggcgtggacgcacggcggccgcgtcgcagcgctggtgttcgtccgcgacgaggagacgggcgcgccgatcgacgacgcggcccgggtcaggcgcatcgagtcccgcctcaggcacgtcctccgcggcggcgcgcgctgcgcgaggacggtcctggctgatccgtcggcggccggaaacctggaccggaggctccaccagctgctgaaagaggacggggaggccgacagccgcggcgccgcgccgatgacggcggtggcggtgcaggattggggggagagagggtactcggtggtgaccgtgagctgccgcgacaggccgaagctgctcttcgacgtggtctgcaccttgacggacttggattacgtggtgtaccacggcacgttcgacaccgacggcgatcacgcgcagcaggagttctacatacggcgttcggacgggcggccaatcagctcggaggccgagaggcagcatgtgatccgatgcttgcaagcggcaatcgagaggcgcgcatccgagggcgtgcggctcgagctccgcatctccgaccgccgcgggctgctcgcctacgtgacgcgcgtgttccgggagaacggcctctcggtgacgcacgccgagatcacgacaagggacgacatggccatgaacgtcttccacgtcaccgacgtggccggccgccccgccgatcccaagacgatcgacgaggtgatacagaggatcggcacggagagcctccgggtggacgaggagcggtggccgcgcctttgctcggcggaaggcgacgccgccggccgcggcggcggcggcgggctgttctcgctggggagcctcgtcaagaagaacctcttcagccttggcctcataagatcctgctcgtgagtacagatgacgtgtccgatccgatggcatgcttgtgtaaatatgggggcggtccatgggttagtttgtaaattgagtagatttttttatgctctttttttaggatttattagttgtcacgtgtatatagtagaaatgaaaaaggctgcttgtcggtaattaacagcttggaggtttaaagggacgcgttggtgggtcatgcatcttttacatggaaatagacagatagaagatgaatgtaaatagggtttgtacataagtgctacttaatgatgtttaactaaaaggaactatcatgtttgacctgcaaatgcaactagtgtcaattc

SEQ ID NO: 2068 - DNA, 1638 bp, Brachypodium distachyon
ggttccggcgatggagcggttccatccctccgaggtgtacgagcacttcgtgcggcatatgaacacgccgagggtcgtggtggacaacggggtgtgcgagacggcgacgctagtgcaggtgcacagcgcgcggaagaacggcgtgctgctggaggccgtggccgcgctgtccgaccacggcgtctgcgtccggaagggctacatctcgtccgacgacggccgctggttcatggacgtgttccacgtcacggacgccgcggggcgcaaggtcgccgatgccgacaagctgctcgcgcgcctcgagtcctcgctcgccgccgcggccgcgaccgccgacgcattgccgcggccggcggggtgcgattcctcgcccgcccagaacgaggggctctcccttctcgagctcatcggcgtcgaccgcccgggcctcctctcggaggtgttcgccgtgctgcacgacctgcgctgcagcatcgtcgacgccaaggcgtggacgcacggcggccgcgtcgccgctctggttttcgtccgggacgaggataccggcgcgccgatcgacgacgccgctcggaccaggcgcatcgagtcccgactcaggtacgtcctccgcggcggcgcgcgcggcgcaaggacgatcttggtcgacgcggcggctgttggtaacctggaccggaggctccaccagctgctgaacgaggaccgggaggccgatggccgccctgccgcggaccggcccacgacgacggcggtggctgtgcaggagtggggggagaggggttactcggtggtgacggtgagctgccgcgaccggccgaagctgctgttcgatgttgtctgcaccttgacggacttggattacgtggtgtaccacggcacgtttgacaccgacggcgatcacgcgcagcaggaattctacatcaggcgcttggacggccagccaatcagctcggcggccgaaaggcagcgagtgatccaacgcttgcaagcggcgatcgagaggcgcgcatccgagggcgtgaggctggagctgagcatcaaggaccggcgcgggctgctggcctacgtgacgcgcgtgttccgggagaacagcctctcggtcacgcacgcagagatcaccaccaggggcgacaaggcgctgaacgtcttccatgtcaccgacgtggccggccgcccggccgaccccaaggcgatcgacgaggtcatacacggcatcggcacggagagcctccgggtggacgaggagcggtggcctcgcttgtgctccacccaaggggacgccggccgagacggtggcgccggcgggggactgttctcgttaggcagtcttgtgaagaagaacctctacaaccttggcctcatcagatcctgctcgtaaggaccaggaacgaaatgtgttggatgagatacttgtgtaaatatgggatggtgcagggtgctagtttgtaaatcaagtaggttcttttatttttttctgcttttaggtttagtagcagcagttcgtgtacatagtagacatggagaagatgttggtcggcacgaggttggagctttgggtcgtgtatgtttcctttacgtgcaagtaggcaaacagatcgatgtaaatagggttgtacatacatgtacatacataatactact

SEQ ID NO: 2069 - DNA, 1724 bp, Zea mays
ttccatctccacttgctactatgtacacgtggcaacttaaacctagaactagaaacggcgatttaaacccctactccatttacaaactaacccatgcaccatcccatatttacacaaggatcccatggagcacatgccccccattgatcgcgtcctcacgagcaggatcttatgaggccaagactgaccaggttcttcttgacaaggctcccgagcgagaagatccccgcaccgccgccgccgcggccagcgtcgccctccgtcgagcacaggcgcggccaccgctcctcgtccacccggaggctctccgtgccgatcctctggatcacctcgtcgatggtcttggggtccgcgggtcggccggccacgtcggtgacgtggaacacgttcatggccatgtcgccccctggtggtgatctcggcgtgcgtgaccgagaggctgttctccctgaacacacgcgtgacgtaggcgagcagcccgcggcggtcggtgatgcgcagctccagcctcactccctgcgcacagccacagaggatcgctctggcggaaaggaagggagatactcagcgatcacgcacctcggatgcgcgcctctcgatggccgcttccaagcattggatcacgcgccgcctctcggtcgccgagctaattggccgctcgtccaaccgcctgataagcttcacctggcgggcgtgatcgtcgtctgtgtggaacgtgccgtggtacaccacgtaatccaagtctgtcaaggtgcagacgacgtcgaagagcagcttgggccggtcgcggcagctcactgtcaccaccgagtaccccctctccacccaatcctgcacggcgaccgctgtgggcgtgggcgcctccgcctccgactccgcccggtcggcgcggctcccggcctccccgtcctcgttgagaagctggtggagcctccggtccatgttgacggcggaggcgtctgcccggaccatcctcgcgccgagcgcgccgccgcggaggacgtgccggagcctggactccacgcgcctgacccgcgccgcgtcgtcgatcggcgagccggtctcctcgtcgcgcacgaacacgagcgcggcgacgcggccggcgtgcgtccaggccctggcgtcgacggtgccgcagcggaggtcgtgcagcacggcgaagacctcggagaggaggcccgggcggtcggcgccgacgagctcgagcagggtgggcgtcccggcccccgcggcggcgggcggcgggcggggcggcaatgcgtcggcggagagcgaggactcgaggcgcgccagcagggcgccggcgtcggccaccttgccgcccgcggcgtcgacgacgtggaagacgtccatgaaccagcggccgtcgtcggaggagatgtagcctttgcggacgcagacgccgtggtcggacagggccgccaccgcgtcgagcagcacgccgtgcttcctcgcgctgtgcacctgcaccagcgtcgccgtcgcgcacgcgccgttgtggaattggcctcccggcctcccttacctcgggttgttcatgtggcgcacgaagagctcgtacacctcggaggggttgtaccgctccatcgccgccggaaccctctccctgcctcggcctctcctcctcctgtgccccgcttcagttttccgcgacgcggcgacggttccctttgccccggggggagagcgtttctttcctttccgtgaggggaggcggagatctc

SEQ ID NO: 2070 - DNA, 833 bp, Zea mays
atgggtaacatgtatatccgcaaggcacccccgagcggctcatctcatcggcgactacctaagagcaatggtgggacggaagccgatgcgccggcgccgaagcgaccggcaaccgccgccgcaatccttcggcgccacggctcgcccgagttccccacgctcgttcgactccacaacctttgccacgactgcagtcgccaccgacctggacgagctgctgctgactgcgccgccgccgtccgcgtcggagccccggagcttctcctatgcggtgaaacagcagtgctgggagaaggcggagcgggtgcccggacgtgacccggagaggtggcgccgcgatgcgctcggcaacatcgtcttccgcaagctcgtgggttgccccggctgcctttgccacgactacgaccacatcgtcccctactccaagggcgggaagagcacattggagaattgccaagttttgcaggctacggtgaatcgatctaaaggcaacaagactgagatatccaaatctgagctcatacagaagagtgcatactgtagggtttcaggacgggacatggatcttgttgaactttctgcctatggaaatgtccggcgagggccagattcagggggctgcaaaatccaatgaagtagatatatctgaatggcgtcaaagttggaagtagttgcctcaaagttggaagtagttgcctgaggctcaatggagaaagcttgattcattgttctgtcaaatatctccaatcatgtttatactatgtagcttaacacttcaagtgatttatcccagaaaagaaatcgtgatatatttgaatcaatgattgtctgca

SEQ ID NO: 2071 - DNA, 648 bp, Setaria italica
atcgcagcctctcaaaaaaccccaaggacgctgaaccctgcacggctgcatcgccccacacagcggctcatcgacgagggcacgaggcagcgatggtggggcgaaagccgatgcgccgccgccgagatcggcagccgccgcctccgccgcagtccttcggcgcgacggctcgcccgacctccccgcgctcgtccgcctccgccgccgcggtcgccgccgacctggacgagctgctgctcacggcgccgccgtcgtcggcgtcggagccccggagcttcccgtacgcggtgaagcagcagtgctgggagaaggcggagcgggtgcccgggcgcgacccggagaggtggcgccgcgacgcgctcggcaacatcgtcttccgcaagctcgtcggctgccccggctgcctctgccacgactacgaccacatcgtcccctactccaagggcgggaagagcacattggagaattgccaggttttgcaggctacagtgaatcgatctaaaggcaacaagactgagatatccaaatccgagctcatacagaagagtgcatattgtagggtttcaggacgggatatggatcttgttgaactctccgcctatggaaatgttcggcgagggccagattcagggggctgtaaaatacaat

SEQ ID NO: 2072 - DNA, 886 bp, Brachypodium distachyon
cagcgacgaactcctcgagggctcgagataggaagataatggtgggccggaagccgatgcgccgccgccgagccgaccacccgccaccgccgccgtcgcagtcctttggagccacggcccggccaaactccccccgctcccccacctccgcctccgccgcctctgtctccgccgacctggacgggctgctcctcacggcccctccgccgtcggcgtcggagcctcggagtttctcgtacgcggtgaagcagcagtgctgggagaaggcggagaaggttcctgggcgcgacccggagaggtggcgccgcgacgcgctcggcaacatggtcttccgcaaactcgtcggctgccccggctgcctctgccatgactacgaccacattgtcccctactccaagggcgggaagagcacgttggagaactgccaggttttgcaggctaccgtgaatcgatctaaagggaacaaaactgagatatccaaatctgagctggcacagaggagtgcatattgtcgtgtttcaggacgtgatatggatctctttgaactctctgccttcggaaatgttcgacgaggcccagactcagggggctgcaaaatccaatgaagatagggaaaaaagaagaagatagggttgcgtgatattaaccagtttcaggcagttgcctcgaatctgagaaaagaaagcttggttgatgtctgtgtcaagtattttcagttatttgtctttaatttgacgctccgaatgaattatcgaagaaaaaaaatctgctactttgcagcccgatatcagttgtgttcagtgccttttcttgttactccagttctacagcatggagactttactatcatatgagttatgtggaaatataatgcgagtaaaactat

SEQ ID NO: 2073 - DNA, 739 bp, Zea mays
aaggcacccccgagcggctcatctcatcggcgactacctaagagcaatggtgggacggaagccgatgcgccggcgccgaagcgaccggcaaccgccgccgcaatcctttgccacgactgcagtcgccaccgacctggacgagctgctgctgactgcgccgccgccgtccgcgtcggagccccggagcttctcctatgcggtgaaacagcagtgctgggagaaggcggagcgggtgcccggacgtgacccggagaggtggcgccgcgatgcgctcggcaacatcgtcttccgcaagctcgtgggttgccccggctgcctttgccacgactacgaccacatcgtcccctactccaagggcgggaagagcacattggagaattgccaagttttgcaggctacggtgaatcgatctaaaggcaacaagactgagatatccaaatctgagctcatacagaagagtgcatactgtagggtttcaggacgggacatggatcttgttgaactttctgcctatggaaatgtccggcgagggccagattcagggggctgcaaaatccaatgaagtagatatatctgaatggcgtcaaattggaagtagttgcctgaggctcaatggagaaagcttgattcattgttctgtcaaatatctccaatcatgtttatactatgtagcttaacacttcaagtgatttatcccagaaaagaaatcgtgatatatttgaatcaatgattgtctgca

SEQ ID NO: 2074 - DNA, 701 bp, Avena sativa
agataggaaaacaatggtaggccggaaaccgatgcgccggcgccgtgccgaccacccgcccccgcagtccttcggcgccacggcccggccgacctccccccgctcctccacctccgcctcagccgtcgccgacctggacgacctgctccacacggcccctccgtcgtccgcgtcggagccccggagcttctcgcacgcggtgaagcagcagtgctgggagaaggcggagaaggttcctgggcgcgacccggagaggtggcgccgcgacgcgctgcaacatcgtcttccgcaagctcgtgggttgccctggctgcctctgccacgactacgaccatatcctcccctactccaagggcgggaagagcacattggagaattgccaggttttacaggctactgtgaatcgatctaaagggaacaatactgagatatccaaatctgagctggcgcagagaagtgcatattgtcgggtgtctggacgtgatatggatctttttgaactctctgcctttgggaatgttcgacgagggccagattcaggaggttgcaatatccaatgaagaacgggaatgtatccgatgtgtgatgttaacccagctttgagcagttgcctcgaatctgagaagggaaaacttggttgatgattgtgtcaaatatgtttagttatttatctgtaatttggtactttgaatgaattatcc

SEQ ID NO: 2075 - DNA, 887 bp, Hordeum vulgare
taatggtgggccggaagcctatgcgccggcgccgcgccgaccacccgcctccgccgcagtccttcggtgcgacggcacggccgacctccccccgctcctccacctccgcctccgcggtcgccgacctggacgagctgctccacacgccgtccgcgtcggagccccggagcttcccgcacgcggtgaagcagcagtgctgggagaaggccgagaaggtgcctgggcgcgacccggagaggtggcgccgcgacgcgctcggcaacatcgtcttccgcaagctcgtcggctgccccggctgcctctgccacgactacgaccacatcttgccctactccaagggagggaagagcacattggagaactgccaggttttacaggctactgtgaaccgatctaaagggaacaatactgagatatccaaatctgaactggcgcagagaagtgcatattgccgggtttcaggacgtgatatggatcttttcgaagtctctgcctttgggaatgttcgacgagggccagattcagggggctgcaaaatccagtgaagaaatgaacatatctgatgtgtgatgttaaccaactttcaccagttgcctcgaatcagtgaagacaaagcttggttgagattgtgtcaaatatgtttagttatttgtctgtaatttgacactttgagtgaattatccaagaaaaaagaatctgctattttgcagcctgatatatgttgtgtgcagtacggagtatatatctattactacaatttatctggaaatagtaatgcgagtgaaggccataggaataatgttcaatttgatttaatgttgggatccagataatctacagattcacacctgaactttgtgtgttttattttaatgtttgcgctattg

SEQ ID NO: 2076 - DNA, 916 bp, Hordeum vulgare
gcgcagcgactcctccagataggataatggtgggccggaagcctatgcgccggcgccgcgccgaccacccgcctccgccgcagtccttcggtgcgacggcacggccgacctccccccgctcctccacctccgcctccgcggtcgccgacctggacgagctgctccacacgccgtccgcgtcggagccccggagcttcccgcacgcggtgaagcagcagtgctgggagaaggccgagaaggtgcctgggcgcgacccggagaggtggcgccgcgacgcgctcggcaacatcgtcttccgcaagctcgtcggctgccccggctgcctctgccacgactacgaccacatcttgccctactccaagggagggaagagcacattggagaactgccaggttttacaggctactgtgaaccgatctaaagggaacaatactgagatatccaaatctgaactggcgcagagaagtgcatattgccgggtttcaggacgtgatatggatcttttcgaagtctctgcctttgggaatgttcgacgagggccagattcagggggctgcaaaatccagtgaagaaatgaacatatctgatgtgtgatgttaaccaactttcaccagttgcctcgaatcagtgaagacaaagcttggttgagattgtgtcaaatatgtttagttatttgtctgtaatttgacactttgagtgaattatccaagaaaaaagaatctgctattttgcagcctgatatatgttgtgtgcagtacggagtatatatctattactacaatttatctggaaatagtaatgcgagtgaaggccataggaataatgttcaatttgatttaatgttgggatccagataatctacagattcacacctgaactttgtgtgttttattttaatgtttgcgctattgtatat

SEQ ID NO: 2077 - DNA, 745 bp, Cynodon dactylon
gccgggggcgaggaggcaacatgggtgggccgaaagccgatgcgccgccgccggtccgagcggaccccgcctccacctcctccgccggcgtcttccttcggcgccacggcgcggccgacttccccccgctattccacctccgcggtcgccgccgacctggacgatctgctcctcactgcgccgccgccgtcggcatcggagccccggagcttcccttacgcggtcaagcagcagtgctgggagaaggcggagcgggttcctgggcgcgaccccgagagatggcgccgcgacgcgctcgggaacatcgtcttccgcaagctcgtcgggtgccccggctgcctctgccacgactacgaccatatcgtcccctattccaagggtggaaagagcacattggagaattgccaggttttgcaggctacggtgaatcgatccaaagggaacaagactgaggtctccaaatccgagctcatacagaagagcacatattgtagggtttcaggacgtgatatggatctagttgaactctccgcctatgggaatgttcggcgagggccagattcagggggctgcaaaatccaatgaaggaaatgtgtatttgaacaatgatgctaattggtttttaagtagttgcaaacagggaaagctagttaatggttatgttccagttatgtctgtattatgtatcatgatacttaaagatatcaagaaaataattctgtaccttggaatcaatgaccattaa

SEQ ID NO: 2078 - DNA, 898 bp, Oryza sativa
atcgaatccgaggagatagggagataatggtggggaggaagccgctgcgccggcggcggcacgacgcgccgccctcgccgccgttgttcggggccacgcctcggccgacctcccctcggtcctcctccgcctccgtggccgcggtcgcggaggagctggacggcctgctcctcacggcgccgcggccgtcggcgtcgtcgtcggagccgcggagcttcccctacgtggtgaagcagcggtgctgggagaaggcggagcgggtggccgggcgcgacccggagaggtggcgccgcgacgcgctcggcaacgtcgtcttccgcaagctcgtcggctgccccggatgcctctgccacgactacgaccacatcgtcccctactccaagggtgggaagagcacattggagaactgccaggttttgcaggctactgtaaaccggtctaaagggaacaaaacagagttatccaaatctgagctcatacagaagagtgcctattgtagggtctcaggacgtgatatggatcttcttgaactctctgcatatgggaatgttaggcgagggccagattcaggtggttgcagaatccaatgaagacgatgggtacgtctgaagagtgatgataatcagtttcaaaaggctgcctgcctacctcaaatctgataggaaaaatcccagctgatgtttgtgccaaatatgtatactcccagctttatgggcattcatcatccattttctaaggattgaccatcaggaatgttatgaattttgtcatcttagcatacttaacggatcctgatttaaggcatattttattttgtattacataccatagttccaagtgcggtcagtgtaaacatgtgtcgacgcatttgttttaaatgtgacatcacattcgtgcc

SEQ ID NO: 2079 - DNA, 702 bp, Triticum aestivum
ccacgcgtccggatgcgccggcgccgcgccgaccacccgtctccgccgccgccgcagtccttcggtgccacggcccggccgacctccccccgctcctccacctccgcctccgccgtcgccaacctggacgagctgctctacacgccgtccgcgtcggagccccggagcttcccgcacgcggtgaagcagcagtgctgggagaaggccgagaaggtgcctgggcgcgaccccgagaggtggcgccgcgacgcgctcggcaacatcgtcttccgcaagctcgttggctgccccggctgcctctgccacgactacgaccacatcgtgccctattccaagggcgggaagagcacattggagaactgccaggttttgcaggctactgtgaatcgatctaaagggaacaatactgagatatccaaatctgaactagcacagagaagcgcatattgtcgggtttcaggacgtgatatggatctttttgaactctctgcctttgggaatgttcgacgagggccagattcagggggctgcaaaatccaatgaagaaatgaacatatctgatgtgatgttagccagctttgagcagttgcctcgaatctgtgaagagaaagcttggttgatggctgtgtcaaatagtatcagttatttgtctgtaatttgacactttgactgaattatccaaggaaaaataatctgctattt

SEQ ID NO: 2080 - DNA, 741 bp, Triticum aestivum
  misc_feature (96)..(96): n is a, c, g, or t
  misc_feature (112)..(112): n is a, c, g, or t
agacactgtgacggaactcctccagataggaagataatggtgggccggaagccgatgcgccggcgccgcgccgaccacccgcctccgccgccgccncagtccttcggtgccncggcccggccgacctccccccgctcctccacctccgcctccgccgtcgccgacctggacgagctgctctacacgccgtccgcgtcggagccccggagcttcccgcacgcggtgaagcagcagtgctgggagaaggccgagaaggtgcctgggcgcgacccggagaggtggcgccgcgacgcgctcggcaacatcgtcttccgcaagctcgtcggctgccccggctgcctctgccacgactacgaccacatcgtgccctattccaagggcgggaagagcacattggagaactgccaggttttgcaggctactgtgaatcgatctaaagggaacaatactgagatatccaagtctgaactagcacagagaagcgcatattgtcgggtttcaggacgtgatatggatctttttgaactctctgcctttgggaatgttcgacgagggccagattcagggggctgcaaaatccaatgaagaaatgaacatatctgatgtgatgttaaccagctttgagcatttgtctcgaatctgtgaagaggaagcttggttgacggctgtgtcaaatattatcagttatttgtctgtaatttgacactttgcgtgaattatctgaggaaaaagaatctgcta

SEQ ID NO: 2081 - DNA, 1890 bp, Zea mays
tctttggagacactgaaccattcgtgcgcgccctctgccgcgcttccgacagctgatgctgcgcaagtcgggcacccagcgccagcagccggcgttgtggcggcggtgccgcagcctccggcagatcaagcaggtccacgcgctcatggtcctccagggcttcctctcggactcctcggcgcttcgcgagctcatcttcgcctccgctgtcggtgtccggggcggcaccgcgcacgcccgcctcgtgttcgaccgaatcccgcaccccgaccggttcatgtacaacaccctcatccgcggcgccgcgcacagtgatgcgccccgggacgccgtctcgatctacgcgcgcatggcccggcacagcgccgactgcgacctgatgacgctgaggccggacaagcgcaccttcccgttcgtgctccgcgcctgcgccgccatgggcgcgggcgaaaccggggcgcaggtccacgcgcacgtcgtcaaggccgggtgcgagtcggacgctttcgtcaggaacgcgctcatcggcatgcacgctaccctgggggacctaggtgccgcggctgcgcttttcgacggagaagcgcgcgaggacgccgtggcgtggtcggcgatgatctccggcttcgcgaggagaggggacattggtgccgcccgggagctgttcgacgagagccccgtgaaggacctcgtgtcgtggaacgtgatgatcacggcatatgcgaagctgggtgacatggccccggcgagggagctcttcgacggggctcctgatcgtgatgttgtgtcgtggaacgccatgatctctgggtacgtgaggtgcggctcgcgcaagcaagcgatggagctctttgagcagatgcaggccatgggagaaaagcccgatactgtgacaatgctcagcttattgtcagcctgtgccgactctggtgatctggatgctggccgcagactgcacgggtttctatcggggaggttttctagaattgggcctaccactgctcttggaaacgcgctgatcgacatgtatgcaaagtgtgggagcatgacgagtgcactggaggtgttctggttgatgcaagataagaatgtctcgacctggaactcgatcataggaggattagcgttgcatggccatgccacagagtccatagctgtgttccggaagatgctgcaggggaatgtcaagccagacgagatcacctttgttgctgtccttgctgcgtgcagccatggcggaatggttgacaaggggcacgagtacttcagtttgatgcaacaacggtacaggattgagcccaatatcaaacactacggttgcatggttgacatgctgagtcgtggcgggctgctcaaagaagcatttgagtttattggcacaatgaagatcgagcctaatcctgtcatatggaggaccctgcttggggcttgtaggatccatggtgagatcgaactggctgagcatgcgaatcgggaacttctaaaggcaaggagtgatgcaagtggggattttgtgcttctgtcgaacatttatgcatcggttggagaatggccggggtcagagaatatgagaaagttgatggatgacagtggtgtcaacaaggaagcaggccgtgcagttatagatagcagttcaaaggatctaatgcgatcttctagactattctaattgaattctgtatttaaaagattttttcacctgtttaccaaacttccatctacagggcaagaaatcgaacacctcgtcctgttcttctgtcaatgaagagaaaaatgtccattatcactcgttgtgctatcattggctccaatgagactttgctggattttttaagatatatccagctaaaaagggcatgtaagtctgatcaatacatgtgcattcatcta

SEQ ID NO: 2082 - DNA, 1614 bp, Zea mays
ctctgccgcgcttccgacagctgatgctgtgcaagtcgggcacccagcgccagcagccggcgttgtggcggcggtgccgcagcctccggcagatcaagcaggtccacgcgctcatggtcctccagggcttcctctcggactcctcggcgcttcgcgagctcatcttcgcctccgctgtcggtgtccggggcggcaccgcgcacgcccgcctcgtgttcgaccgaatcccgcaccccgaccggttcatgtacaacaccctcatccgcggcgccgcgcacagtgatgcgccccgggacgccgtctcgatctacgcgcgcatggcccggcacagcgccgactgcgacctgatgacgctgaggccggacaagcgcaccttcccgttcgtgctccgcgcctgcgccgccatgggcgcgggcgaaaccggggcgcaggtccacgcgcacgtcgtcaaggccgggtgcgagtcggacgctttcgtcaggaacgcgctcatcggcatgcacgctaccctgggggacctaggtgccgcggctgcgcttttcgacggagaagcgcgcgaggacgccgtggcgtggtcggcgatgatctccggcttcgcgaggagaggggacattggtgccgcccgggagctgttcgacgagagccccgtgaaggacctcgtgtcgtggaacgtgatgatcacggcatatgcgaagctgggtgacatggccccggcgagggagctcttcgacggggctcctgatcgtgatgttgtgtcgtggaacgccatgatctctgggtacgtgaggtgcggctcgcgcaagcaagcgatggagctctttgagcagatgcaggccatgggagaaaagcccgatactgtgacaatgctcagcttattgtcagcctgtgccgactctggtgatctggatgctggccgcagactgcacgggtttctatcggggaggttttctagaattgggcctaccactgctcttggaaacgcgctgatcgacatgtatgcaaagtgtgggagcatgacgagtgcactggaggtgttctggttgatgcaagataagaatgtctcgacctggaactcgatcataggaggattagcgttgcatggccatgccacagagtccatagctgtgttccggaagatgctgcaggggaatgtcaagccagacgagatcacctttgttgctgtccttgctgcgtgcagccatggcggaatggttgacaaggggcacgagtacttcagtttgatgcaacaacggtacaggattgagcccaatatcaaacactacggttgcatggttgacatgctgagtcgtggcgggctgctcaaagaagcatttgagtttattggcacaatgaagatcgagcctaatcctgtcatatggaggaccctgcttggggcttgtaggatccatggtgagatcgaactggctgagcatgcgaatcgggaacttctaaaggcaaggagtgatgcaagtggggattttgtgcttctgtcgaacatttatgcatcggttggagaatggccggggtcagagaatatgagaaagttgatggatgacagtggtgtcaacaaggaagcaggccgtgcagttatagatagcagttcaaaggatctaa

SEQ ID NO: 2083 - DNA, 1669 bp, Setaria italica
ctgccgcgcctgcgtccgcgatgctgcgaaagtcgggaacccagcgccggtctggcggcggtgccgcagcctccggcagatcaagcaggtccacgcactcatggtcctccggggcttcctctccgacccctccgcgctccgcgagctcatcttcgcctctgcggtcgctgtccgcggcggcgtcgcgcacgcccgcctcgtattcgaccgaatcccgaacccggaccggttcatgtacaacaccctcattcgcggcgccgcgcacagtgacgcgccccgcgacgccgtctccatctacgcgcgcatggcccggcgccgcggagactgctgcggcggcgtgaggccggacaaactcaccttcccgttcgtgctccgcgctgcgccgcgatgggcgcggggggcaccggggcgcaggtccacgcacacgtcgtgaaggctgggtgcgagtctgacgcttttgtcaggaacgcgctcatcggcatgcacgcgagctgcggggatctaggcgtggcggcttcgctgttcgacagcggagcgcgcggggacgccgtagcatggtcggcgatgatctccggctgcgcgaggagaggggacattggtgccgcccgggagctgttcgacgagagccctgtgaaggacctcgtgtcatggaacgtgatgatcacagcttacgccaagcggggtgagatggccctagcgagggaattgttcgaccgcgttcctgatcgtgatgtcgtgtcatggaatgccatgatttctgggtacgtgagaagtggctcacacaggcatgcgatagagctctttgagcagatgcagtgcgtgggagaaaagccagatactatcacggtgctcagcttgttgtcagcctgtgccgactctggtgatctcgatgttggccagaggctccattcctatttgtcagagaggttttcaagaactggtcttaccaccgttcttggaaatgcgctgattgacatgtatgcaaagtgtgggagcatgaagtgcgcacatgaagtgttctggtcgatgcgagataaggacgtctcaacttggaactccatcataggaggattggcattgcatggacatgtcaatgagtccatagatttgtttgagaagatgctaaaggggaatgtcaagccagacgaaatcacctttgttgctgtcctcgttgcttgcagccatggaggcatggttgacaaggggcataagtactttaacttaatgcagcaacagtacaggattgagcccaatgtcaagcactttggttgcatggttgacatgctaagtcgtgcaggactgctcaaagaagcatttgagttcattgacacaatgaaggtcgagcctaattctgtcatatggaggaccttgcttggggcttgtaggatccatggtgaagttgaactggctgagcatgcgaatctggaacttctaaaggcaaggagtgatgcaagtggggattatgtgcttctatcaaacatttatgcttcagttggagaatggctggggtcagagaaaatgagaaagttgatggacgacactggtgtcaacaaggaagcaggccgtgcagttattgatggcagttcaaaggatctaatgcaatcttctagacagttctaatcacgttctggattcaaaagatttttttggcctagctgccgggtcaaga

SEQ ID NO: 2084 - DNA, 3723 bp, Brachypodium distachyon
atgaacagccccatggaggaatctcatgacatgccggtgacggccttcttcccactagcagggctccacaagtacgttgccatcttcgtcatcgtcctctcatggatcttggtccacaggtggagcctgaggaaccagaaggggccaaagtcatggccagtcatcggcgcgacgttggagcagctgaggaactactataggatgcacgactggctcgtggagtacctgtccaagtacaggacggtgactgttgacatgccgttcacctcatacacctacattgcagacccggtgaacgtcgagcatgtcctcaagaccaacttcaacaactaccccaagggggaggtgtacaggtcctacatggatgttctgctcggcgacgggatattcaacgccgacggtgagttgtggaggaagcagaggaagacggcgagcttcgagtttgcctccaagaacttgagagatttcagtaccattgtgttcagggagtactccctgaagctgtcgagcatactgagccaagcctgcaagaccggcaaagttgtggacatgcaggaactgttcatgaggatgacgctggactcaatctgcaaggtcgggttcggggtggagatcggcacgctgtcgccggacctcccggagaacagcttcgcgcaggccttcgacgcggccaacatcatcgtgacgctgcggttcatcgacccgctgtggcgcctgaagaagctcctgcgcgtgggttccgaggccttgctggagcagagcatcaagctcgtggacgagttcacctacagcgtcatccgccggcgcaaggccgagatcgtgcaggcgcgagccagcggcaagcaggagaagatcaagcacgacatcctgtcgcggttcatcgagctaggcgaggccggcgtcgacaacgacaacggcggcggcatcagcttgttcggcgacgacaagggcctccgcgacgtggtgctcaacttcgtgatcgccgggcgcgacacgacggcgacgacactctcgtggttcacctacatggccatgacccacccgcccgtggccgagaagctccgccgcgagctggccgccttcgagtccgaccgcgcccgcgaagaaggcatctcgctgatccccttcttctccgactccgacgggccggaaaaccaatcctccttcgcggcccgcgtggcccagttcgcggccctcctgacctacgacgggctcgggaagctgacgtacctccacgcgtgcgtgacggagacgctccggctgtacccggcggtgccgcaggaccccaagggcgtggcggaggacgacgtgctcccggacggcaccaaggtgaaggccggcgggatggtgacgtacgtgccctactccatgggccggatggagtacaactggggccccgacgccggctgcttccggcccgagcggtggatcggggaagacggcgggttccgcaacgcgtcgccgttcaagttcacggcgttccaggccgggccaaggatctgcctcggcaaggactcggcgtacttacagatgaagatggccctggcgatcctgttcaggttctacaggtttgagatcctggaggggcaccctgtcaagtaccgcatgatgactatcctgtccatggcgcatgggctcaaggtccgcgtctccagggcgccagcgctcgtgtgaatgatggggtgatctcgtctggtcggggaagacggtgcatgatgctccggcgggcggcgcgacgtggctagctagctagctcgatctcggttttaacttagcaaggtaataatctggtatatgttgtagacagagctcgggagggtgtttgatcccgatgtgtgtccattgttaccgtgtatcgcacttttggcaccggagatgctgcggaagtctggcgcgcagcgccggcagccgccgctgtggcggcggtgccgtagcctccggcaaataaagcaggtacacgccctcatggtgctccggggcttcctatcggacccctccgcgctccgcgagctcctcttcgcctccgccgtcgccgtccgcggcgccatcgcccacgcctacctcgtgttcgaccaaatcccgcgcccggacctcttcatgtacaacaccctcatccgtggcgccgcgcacaccgccgcgccccgggacgccgtctccctgtacgcgcgcatggcgcggcgcggcagctgcggcggcgtgaggcccgataagatcaccttcccgttcgtgctccgagcgtgcaccgcgatgggcgcgggcggcaccggggcgcaggtgcacgcccacgtcgtcaaggctggatgcgagtccgacgcgttcgtcaggaacgcgctcatcggcatgcacgcgagctgcggggagctgggcgtcgcgagtgctctgtttgacggcagggcgcgtgaggatgccgtggcgtggtcggccatgatcaccgggtgtgcaaggagaggggacattgttgccgcacggaagctgttcgacgagtgtcctgtgaaggaccacgtgtcttggaacgtgatgatcacggcttatgcaaagcggggagagatggcaccagcaagggtgttgttcaaccggatacctgagcgtgacgttgtgtcctggaacgccatgatttctgggcatgtgagatgcggctcacatgtgtatgcaatggagctgttcgagcagatgcaacgtatgggacaaaagccagatgttgtcacaatgctcagcttgctgtcagcttgtgctgattccggtgatatagatgttggacgaaggttgcattcctctctctcagagatgttcttgagaactggttttactgtcatcctgggcaacgcactgatcgacatgtacgcgaaatgtggaagcatgaagagtgcacttcaggtgttctgggtgatgcgagataaggatgtctcaacttggaactcaatcataggaggattggcactgcatgggcatgtcctggagtccatagatgtgttcaagaaaatgttgaaagagaaagtcaggcctgatgagatcaccttcgttgctgtcctcatcgcatgcagccacggcgggatggttgacaaaggacgtgagtacttcaacttgatgcaacatcattacaggattgagcccaatgtcaagcactatggttgcatggttgacatgctgggtcgtgcagggctcctgaaagaagcattcgagttcattgacaccatgaaggtcgagcctaattctgtcatctggaggacgcttcttggggcttgcagggtccatggtgagatcgaactggctgagcatgcaaacagacaactactaaaggcgaggaatgatgaaagtggggattatgtgctcctctcgaacatctatgcttcagctggggaatggtctgagtcagagaaaatgagaaagttgatggatgatagtggtgtcaacaaacaagcaggtcgcacggttgtagatggcagcgcgaaggatctaatgcagtctttcggatagtcaacatcacatcctggagtgaaagggtctattaattatgtcaactttgtgctcccatttcgtgggtcagaaactgaacatccagcactggtaaaattgagatatggatgtatctgcgggcgaagagcaaaaggctgctttgaatgctgcttctcatgctaatttagctgactggctctattctatgcttgccagacattattgctgaagattgtgttggcctatatgcagctgaaaaggctagataag

SEQ ID NO: 2085 - DNA, 1247 bp, Zea mays
aagctcttcctcggaccctttaatgcactacggaccaccaccaccaccccaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggacctccccggctggctcgtgcactggggccacccgggtaacatggctgtggtgctcttcgcaatgggtggttacgggacatacctgggcttcaggatcaaactatcagacgaccttgaagagaaggccaaggccaaagatctccacccgaaactcctcgccgggatgttctttttcttcgccctgggcgcgaccggtgggatcacagctcttctcacctcagacaaacccatctttgaaagccctcatgccgtgactggagtcatcggccttgcgctcctgaccattcagtctgtcctgccaaaactgttcgagggaaacccagggcttaggactacacatggtctgctcggcagtggcatcatgactctgtttctaatccacgcggcactaggcctgcagcttgggatcagtttctaacttgtggctacaatatcttggggtttgcttctctttttctttaactcactctaagtattatcacacgaagcatccccttaaatgaaaataatgtaagagaaagcaaaattattttccttggctttgttggcaactgcagtccatgttatatgataatatgatattgccatacgacactagaatatccatgtagagacaactagacatggatacatgtctgtcacctaaacgaagaacagatcacacaaaaagaagaggaaagagcaagaaaatgttgtgatcttaaacgcagaaagtaacatgctgttatcaatcacttgtttctatgtcaccattctgaagaatcagacaattgagttctggtgtgctaa

SEQ ID NO: 2086 - DNA, 1154 bp, Zea mays
aagctcttcctcggaccctttaatgcactacggaccaccaccaccaccccaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggatctccccggctggctcgtgcactggggccacccgggtaacatggctgtggtgctcttcgcaatgggtggttacgggacatacctgggcttcaggatcaaactatcagacgaccttgaagagaaggccaaggctaaagatctccacccgaaactcctcgccgggatgttctttttcttcgccctgggcgcgaccggtgggatcacagctcttctcacctcagacaaacccatctttgaaagccctcatgccgtgactggagtcatcggccttgcgctcctgaccattcagtctgtcctgccaaaactgttcgagggaaacccagggcttaggactacacatggtctgctcggcagtggcatcatgactctgtttctaatccacgcggcactaggcctgcagcttgggatcagtttctaacttgtggctacaatatcttggggtttgcttctctttttctttaactcactctaagtattatcacacgaagcatccccttaaatgaaaataatgtaagagaaagcaaaattattttccttggctttgttggcaactgcagtccatgttatatgataatatgatattgccatacgacactagaatatccatgtagagacaactagacatggatacatgtctgtcacctaaacgaagaacagatcacacaaaaagaagaggaaagagcaagaaaatgttgt

SEQ ID NO: 2087 - DNA, 1044 bp, Panicum virgatum
cccttttcctcctctcccctcgtgaacctgctctagctctataggactatccctccgcgtcgacgggcatctcgccacctccaggtccaagagaccaagatcgagtgattgcagtaggcagattgcacgagggatggtcgccgtgtctaccgcggcgatggcgagctcgcttctcctccggccgcgcgcctccttccggcgggcgctcccgccaccgccaccttccagccgccgggcattgccagcgccgcgggttcaagcagctagcaccaaacaggagcaaccaggccggccggccgggacgcggctctactcgctggcaccctaccctctgctgctcgccgcgctgttgccgggagctgagcctgtgacggccgtgttcgcgccgttcgtggagctggtgaagacgtgggacctccctggctggctcgtgcactggggccaccccggcaacatggctgtggtgctttttgcgatgggtggctacgggacatacctcggcttcaggatcaaactatcagatgatccggaagagaaggctaaggccaaagatctccacccaaagctccttgccggcatgttcttcttcttcgccctcggtgccacaggtggtgtcaccgctcttcttacctcagacaaaccaatctttgaaagtcctcatgcagtaacaggagtcatcggcctggcactcctgaccattcagtctattcttccaaaattgtttgaggggaacccagggcttaggactacacatggtctactcggcagtggcatcatgactctgtttctaatccatgcagcactcggcctgcagcttgggatcagtttctaacttttggctagaatatcttggggtttgcttctttctgattgcgtttttggagatttaactcactcttattattattcacacgaggcatccctttataaagcaaaacaatgtaagagaaagcaaatttactatccttctctttgtgcgcaattatagtaaatggtatcatatgctaaattgctaatatgatatcgcagatgcatattcttatg

SEQ ID NO: 2088 - DNA, 764 bp, Saccharum officinarum
cggactcaatactagcacgcgcgtgttcgcctcacttcacttggcccggctgtctgcacgccacgctccccacatcccctttcccctcgtctccactctgcatctgcagtaggtagaatggcaagaaggatggtggcgacgatggcgagctcgctgctgctccggccgcgcgcggtcctgccaccccatccttctagttctagctccggccgccggccatttccagccccacgtgcacaactgcaagcgaacatccagcacaagccgggccttacggcaagaagcgacggcgagcggaggcagccggctgggacgcggctctactcgctggcgccctaccctctactgctcgccgcgctgctgccgggagctgagccggtgacggccgtgttcgcgccgttcgtggagctggtgaagacgtgggacctccccggctggctcgtgcactggggccaccccggcaacatggctgtggtgctcttcgcaatgggtggctacgggacatacctgggcttcaggatcaaactatcagacgatcttgaagagaaggccaaggccaaagatctccacccaaaactcctcgcagggatgttctttttcttcgccctgggtgcgaccggtgggatcacagctcttcttacctcagacaaacccatctttgaaagccctcatgccgtgactggagtcatcgggcttgcactccttaccattcagtctatcctgccaaagttgttcgagggaaacccagggcttaggactacaca

SEQ ID NO: 2089 - DNA, 767 bp, Saccharum officinarum
cggactcaatactagcacgcgcgtgttcgcctcacttcacttggcccggctgtctgcacgccacgctccccacatcccctttcccctcgtctccactctgcatctgcagtaggtagaatggcaagaaggatggtggcgacgatggcgagctcgctgctgctccggccgcgcgcggtcctgccaccccatccttctagttctagctccggccgccggccatttccagccccacgtgcacaactgcaagcgaacatccagcacaagccgggccgccttacggcaagaagcgacggcgagcggaggcagccggctgggacgcggctctactcgctggcgccctaccctctactgctcgccgcgctgctgccgggagctgagccggtgacggccgtgttcgcgccgttcgtggagctggtgaagacgtgggacctccccggctggctcgtgcactggggccaccccggcaacatggctgtggtgctcttcgcaatgggtggctacgggacatacctgggcttcaggatcaaactatcagacgatcttgaagagaaggccaaggccaaagatctccacccaaaactcctcgcagggatgttctttttcttcgccctgggtgcgaccggtgggatcacagctcttcttacctcagacaaacccatctttgaaagccctcatgccgtgactggagtcatcggccttgcactccttaccattcagtctatcctgccaaagttgttcgagggaaacccagggcttaggactacaca

SEQ ID NO: 2090 - DNA, 1851 bp, Zea mays
aaagagcatttcagcaaccacctccctcctctacaaacgataataaagccctacctctcacatcggcaacaggacgaggccagggcatccacgaccacgacacggacacagggagccgcccgccatgccaccgcacggcggcatgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggcccagtgcgggtgcgacggcgcagagaacccgctgttccgcaaggtcgccgcgtacgtggcggcgctgccgtcgctggaggacgccgacgctgcgtgcgtggtgtcgtcggcgtcaaggaccaacggcgggctgtccctgcagctcggcccgggccacaccgcgagggacacgtaccttggcgcgcgcctcgcgtggaccagcgcgggcggcgagcgcctggtgctgcgcgtgcgccgccacgaccgctcccgcgtgctgcgaccttacctgcagcacgtggagtccgtggcagaggagatggagcagcgccgccgcgagctgcgcctcttcgccaacaccgccgtggacgcgaccacgggcgcgccgcgctgggcgtcggcgcccttcacccacccggccacgctcgacgccgtggccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtctcgcgccgacgccgccggcgacgacctccgcgcgctgctcctgcacaccaccccgcgctcgctcgtcctcgtcgaggacctggaccggtacctgcagggcggcggcggggacgcggaggcgcgcgcggccagggtgctgagcttcatggacggcatcgcgtcgtgctgcggcgaggagcgtgtcatggtgttcaccatgcgcgggggcaaggacgccgtggacgccgcggtggtgcgcccgggccggctggacgtgcacatccagttcacgctctgcgacttcgaggccttcaaggcgctggccagcaactacctggggctcaaggaccacaagctgtacccgcaggtggaggaggggttccacgccgccggcgcccgcctcagcccggccgagcttggcgagatcatgctggccaaccgcgcgtccccgagccgcgcgctccgcagcgtgatcaccaagctccagcgcgtcgcgtccggaggcgccgcgccgccgcggaacccggcgcacaggcggaacacgagctggtccggcgcctggaccggacagcagtgggaggaccaggcccagccggcgcgagccagcgcggtctccgtggaggtcgacgagacggccgccggggcaccggcgacgtgcggcggggtgttcggaaaggaggcgcccatgagggagttcaagaagctgtacgggctgatcaaggtcaggagccggagggagggcgccggcgccgtgccactggaaggcgacgcgcacgggccgccgacgccgggcaaccatgacagggagcggtgatcgccgtggatggtagaattgtagtggtgtgcaaaaagaaagcatttttatttctttctctttttttttcttgttattgttacagtttatcacactactctactaatgtgtcagtgactgcaagtaggaatggcaatagatgaattggatggatc

SEQ ID NO: 2091 - DNA, 1814 bp, Zea mays
cgataataaagccctacctctcacatcggcaacaggacgaggccagggcatccacgaccacgacacggacacagggagccgcccgccatgccaccgcacggcggcatgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggcccagtgcgggtgcgacggcgcagagaacccgctgttccgcaaggtcgccgcgtacgtggcggcgctgccgtcgctggaggacgccgacgctgcgtgcgtggtgtcgtcggcgtcaaggaccaacggcgggctgtccctgcagctcggcccgggccacaccgcgagggacacgtaccttggcgcgcgcctcgcgtggaccagcgcgggcggcgagcgcctggtgctgcgcgtgcgccgccacgaccgctcccgcgtgctgcgaccttacctgcagcacgtggagtccgtggcagaggagatggagcagcgccgccgcgagctgcgcctcttcgccaacaccgccgtggacgcgaccacgggcgcgccgcgctgggcgtcggcgcccttcacccacccggccacgctcgacgccgtggccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtctcgcgccgacgccgccggcgacgacctccgcgcgctgctcctgcacaccaccccgcgctcgctcgtcctcgtcgaggacctggaccggtacctgcagggcggcggcggggacgcggaggcgcgcgcggccagggtgctgagcttcatggacggcatcgcgtcgtgctgcggcgaggagcgtgtcatggtgttcaccatgcgcgggggcaaggacgccgtggacgccgcggtggtgcgcccgggccggctggacgtgcacatccagttcacgctctgcgacttcgaggccttcaaggcgctggccagcaactacctggggctcaaggaccacaagctgtacccgcaggtggaggaggggttccacgccgccggcgcccgcctcagcccggccgagcttggcgagatcatgctggccaaccgcgcgtccccgagccgcgcgctccgcagcgtgatcaccaagctccagcgcgtcgcgtccggaggcgccgcgccgccgcggaacccggcgcacaggcggaacacgagctggtccggcgcctggaccggacagcagtgggaggaccaggcccagccggcgcgagccagcgcggtctccgtggaggtcgacgagacggccgccggggcaccggcgacgtgcggcggggtgttcggaaaggaggcgcccatgagggagttcaagaagctgtacgggctgatcaaggtcaggagccggagggagggcgccggcgccgtgccactggaaggcgacgcgcacgggccgccgacgccgggcaaccatgacagggagcggtgatcgccgtggatggtagaattgtagtggtgtgcaaaaagaaagcatttttatttctttctctttttttttcttgttattgttacagtttatcacactactctactaatgtgtcagtgactgcaagtaggaatggcaatagatgaattggatggatc

SEQ ID NO: 2092 - DNA, 1904 bp, Oryza sativa
acgacgcgacgcgacgcgacacgggagcaagcagcgcgcgcgcgctactccgaaccgaaggcccacgcggcgccatgctgctgggtgccatgagcggcggcggcgtcgtcgtcgccgtcgccgtcgcctacgccgccctggccgtggtggcgctgcggatggcgctgtcgtacaagtcggcgctgtacgcggtgcggcggctgtggcggtgggccgacgagtgggcgcaggcgtaccagtaccacgaggtgccacgcttcgcgtgcgacggcggcggcgccgagaacccgctgttccgcaaggcggcgcagtacgtggcggtgctgccgtcgctcgaggacgccgacgccgcctccgtgctgtcgtccgcgtcgaggaccaacggcggcttctccctgcagcttgggccaggccacaccgcgcgcgacgccttcctcggcgcgcgcctcgcgtggacaaaccggggcgacgtgctggttctgcgcgtgcgccgccatgaccggacgcgcgtgctgcggccctacctgcagcacgtcgagtccgttgccgatgagatggagctccggcgacgcgagctgcggctgttcgccaacaccggcgtggacgggagcaccgggacgccgaggtgggcgtcggcgccgttcacccacccggcgacgcttgacacggtggccatggaccccgacctcaaggctcgcgtccgcgccgacctcgagaacttcctcaagggccgcgcctactaccaccgcctcgggcgggtgtggcgccggagctacctcctctacggcccgctgggcaccggcaagtcgaccttcgcggcggccatggctcggttcttgggctacgacatctacgacgtcgatctctcccgcgccggcagcgacgacctccgcgcgctgctcctgcacaccaccccgcggtccctcatcctcgtggaggacctcgaccggttcctccagggcggcggggccggggacgcggaggcgagggcggcgagggtgctgagcttcatggacggcgtcgcgtcgtgctgtggcgaggagcgggtgatggtgttcacgatgcgcggcggcaaggagggcgtggacgcggcggtggtgcggccggggaggctggacgtgcacatccacttcacgctctgcgacttcgaggcgttcaaggcgctggccagcaactacctcggcctcaaggaccacaagctgtacccgcaggtggaggagagcttccatggcggcgcgcgcctcagccccgccgagctcggcgagatcatgctcgccaaccgctcgtcgccgagccgcgcgctgcgcaacgtcatcacgaagctccagcacgtgtccggggcggcggcggcgccgcggccgccgcacaggcggaacacgagctggtccggcgcgggcgggccatgggaggagcaggccgcgcgcgccagcgcggacgcggcggacggcggcgaggaggcgatcacggcgacggcggcgtgcggggtgttcgcgaaggacgcgccgatgagggagttcaagaagctgtacgggctgatcaagatcaggagccggaaggagggctccagcgggttcatgcccttgcacggcggcgaagcgccgtcgccggcaaacgggcggggcagcgagcacgacaaggagcggtgattaattaggcgatggtagtagaccccgtcaaacaagaaaaatatttttgattttttgtccgtgcttttttacttcgtgttaggctagtaggagtactacgtagttgtagttagttcactttttaattgtggatggaagaaatcaaacacgaaatggaggatgataatgggattgggtgatgtacaattgtacatgaggattgtttggttttaacagggtataaaacaaaagagatgggcaagttgaaattcttgaaaa

SEQ ID NO: 2093 - DNA, 1909 bp, Zea mays
cttggtccccaccatcgcgaaactgaaaacgcaccacaccaccagccagccagccagcctttcctctccctctctggccattgcctcgccatcgcgtcggacgggaccgaggaggaggcctgccgtgccgtgccgcgggcgatggacccgtgcccgttcgtgcgggtgctggtcggcaacctggcgctgaagatgccagcatcggcgtcgccggcgaccccgcgcgcgtccggctccggcgtgcacccgaccgcggcgcgctgccactgccgcatccgcctcaacaagatgccctaccagacggcgtccgcgccgctgctgccggccacggaggacggcccggcgtcgtgcacggccgccttcgccgccgccttccacgtctccaaggccgacctggaccgggccgccgccaggccggccgcggcgctgctcctcgccgcgcgccgccgccgcaccgcgcgcctcaaggtggccgtgtacgccggccgcggcgggggcgtgagcgcgtcctgcggcggcggcggcgccacgtcgggtaggctgctcggcaaggtcgtcctcccgctcgacctcagggctgccatggccaagcccgtcgtattccacagcggctgggtcgccgtcggcagccgccgcggcaaggcggcggcggcggcctcctcctccgcgcgcgcgcagctcagcatcaccgtccgcgccgagcctgaccccaggttcgtgttccagttcgacggcgagcccgagtgcagcccgcaggtgctccaggtgaagggcagcatgaagcagcccatgttcacgtgcaggttctcctgccgcagcagcagcgacctgcgctcgcggtccgtgcagtctgatccgggcgcgcgcaactggctggcgaagctggggtcggagcgcgagcgcgcggggaaggagcgcaaggggtggtcggtgacggtgcacgacctgtcggggtcgccggtggcgctggcgtcgatggtgacgccgttcgtggcgtccccgggtacggaccacgtgagccggtccagcccgggcgcctggctcatcctgcgccccgcggacgggacctgggcgccgtggggccgcctcgagtgctggcgcgggcgcggcgacaccctcggctaccgcttcgagctggtgcccggccacgccacggggggcgccggcgtctgcgtcgccgaggccagcgtcccggcctcccgcggcgggcgcttcgccatcgacctcacggcggcggcgcagccgttctggtgcagcagcagcggcgacatgggccacggcatctggcccttcggcggcttcgtgatgtcggcggcggtccagggggaaggccgctgcagcaggcccaccgtggaggtgggcgtcgcgcacgtcgggtgcgccgaggacgccgcggccttcgtcgccctcgccgccgccgtcgacctcagcatggacgcgtgccgcctcttctcgtgcaagctgcgcagggagctgtcgacggcgtcccgcgccgagtttctccggtgaccgggcttctaggtgctttttagagtctagaagcggtggaactcgggtttctgtgcctactgcggaaggattctcaagcgttctctggactctggtggaggagaaagaaacaccgctgatgtgaaccatgtgatgtcttcgtgttctgctcttgttttgttccttttgcgtggagcgaaggcttctgccggagctagctgctatatggaacgaagaagaggccggcatcctaatgtccgtccaccgtccatttcccggcccagcgtctcgttctcgacgacgaagggggagggggagtcagaaaagggtatggagagacggggtggagacccacaaagacagatcaaaatttacaaaataaccctttattaattcattttttttctatttgtatggacca

SEQ ID NO: 2094 - DNA, 1908 bp, Zea mays
cttggtccccaccatcgcgaaactgaaaacgcaccacaccaccagccagccagccagcctttcctctccctctctggccattgcctcgccatcgcgtcggacgggaccgaggaggaggcctgccgtgccgtgccgcgggcgatggacccgtgcccgttcgtgcgggtgctggtcggcaacctggcgctgaagatgccagcatcggcgtcgccggcgaccccgcgcgcgtccggctccggcgtgcacccgaccgcggcgcgctgccactgccgcatccgcctcaacaagatgccctaccagacggcgtccgcgccgctgctgccggccacggaggacggcccggcgtcgtgcacggccgccttcgccgccgccttccacgtctccaaggccgacctggaccgggccgccgccaggccggccgcggcgctgctcctcgccgcgcgccgccgccgcaccgcgcgcctcaaggtggccgtgtacgccggccgcggcgggggcgtgagcgcgtcctgcggcggcggcggcgccacgtcgggtaggctgctcggcaaggtcgtcctcccgctcgacctcagggctgccatggccaagcccgtcgtattccacagcggctgggtcgccgtcggcagccgccgcggcaaggcggcggcggcggcctcctcctccgcgcgcgcgcagctcagcatcaccgtccgcgccgagcctgaccccaggttcgtgttccagttcgacggcgagcccgagtgcagcccgcaggtgctccaggtgaagggcagcatgaagcagcccatgttcacgtgcaggttctcctgccgcagcagcagcgacctgcgctcgcggtccgtgcagtctgatccgggcgcgcgcaactggctggcgaagctggggtcggagcgcgagcgcgcggggaaggagcgcaaggggtggtcggtgacggtgcacgacctgtcggggtcgccggtggcgctggcgtcgatggtgacgccgttcgtggcgtccccgggtacggaccacgtgagccggtccagcccgggcgcctggctcatcctgcgccccgcggacgggacctgggcgccgtggggccgcctcgagtgctggcgcgggcgcggcgacaccctcggctaccgcttcgagctggtgcccggccacgccacggggggcgccggcgtctgcgtcgccgaggccagcgtcccggcctcccgcggcgggcgcttcgccatcgacctcacggcggcggcgcagccgttctggtgcagcagcagcggcgacatgggccacggcatctggcccttcggcggcttcgtgatgtcggcggcggtccagggggaaggccgctgcagcaggccccccgtggaggtgggcgtcgcgcacgtcgggtgcgccgaggacgccgcggccttcgtcgccctcgccgccgccgtcgacctcagcatggacgcgtgccgcctcttctcgtgcaagctgcgcagggagctgtcgacggcgtcccgcgccgagtttctccggtgaccgggcttctaggtgctttttagagtctagaagcggtggaactcgggtttctgtgcctactgcggaaggattctcaagcgttctctggactctggtggaggagaaagaaacaccgctgatgtgaaccatgtgatgtcttcgtgttctgctcttgttttgttccttttgcgtggagcgaaggcttctgccggagctagctgctatatggaacgaagaagaggccggcatcctaatgtccgtccaccgtccatttcccggcccagcgtctcgttctcgacgacgaagggggagggggagtcagaaaagggtatggagagacggggtggagacccacaaagacagatcaaaatttacaaaataaccctttattaattcattttttttctatttgtatggacc

SEQ ID NO: 2095 - DNA, 1868 bp, Zea mays
atttcttccctgaaacgtagccaaacctgccttgccctctgcttgctagtccatctcttctctcttctccatccatgtagataaatagacgccaagcgctctcggcaccggagcaggccggcgggttcagtggcccctgcaagtgcaagctaaggctcacagcatccgttcggttccggctccgagggactcgctcccgtcggggacggatatatatccatcatggaggcggcggcggcatcttctctgtggggcggcctcaactccggcatcatgctgagcctcctggccgtggtgtgggccatgctgtggcaggcgctgcagggcctccagctgcagcagtacttcgggcgccactcccgccgcctgtcgcgccgcctcgcgtccatcctggacccggacctcaccgtcaccgtcgccgagtacgacggcgggcgcatgcgccgcagcgacgcgttcaaggaggccaaggcgtacctggagcgcgccacgcgggaggcccgcggcggggtgcgccacctcaaggccgagcccgacaaggaccccgaccgcctcctgctcagcatggacgacgacgaggagatcaccgacgagttcaggggcgccaccgtcacgtggcgggcctgcacggcgccgccgcgcgaggacagcgcgccggcctacttctggggccgcgccccgcgcgccgaccgcaggttctaccgcctcttcttcgccgagcgccaccgggacctcgtcctgggagactacctcacccacgtccgccgcgaggggcgcgccgtcatggtcaagaaccgccagcgcaagctcttcaccaacatctccggcgacggctcctgggactcggacggtgtttggagccacgtggtgttcgagcaccccaagacgttcgcgacgctggccatggacccggacaagaagaaggaggtgatggacgacctggacgcgttccgcaacggcaaggactactacgcgcgcgtcggcaaggcgtggaagcgcggctacctcctgtacgggccgccggggaccggcaagtccaccatgatcgccgccatggccaaccacctcgactacgacgtgtacgacatcgagctcacgtccgtgcgcaccaacaccgaccttcgcaagctcttcatcgagaccaccagcaagtccatcatcgtcgtcgaggacatcgactgctcgctcgacctcactggcaagcgcaagaagaagaacaagaaggaggaggacggcgagaacaagaaggacggtactacgacgaagcagcaggaggaggacaaggagaaggaggacgagaaggcgggcggcagcaaggtgacgctctccggcgtgctcaacttcatcgacgggctgtggtccgcgtgcggcggtgagcgcatcatcgtgttcaccaccaaccacgtggagaagctggacccggcgctcatccggcggggccgcatggacaagcacatcgagatgtcctactgctgcgtccaggccttcaagttcctggccaaggtctacctcgacgtggacgaccacccgcgcttcgacgccgtggcggcgctcctgcgggaggtggacatgacgcctgcggacgtcgccgagaacttgacgcccaaggcacccggcgaggacgccgactcgtgcctcgccgcgcttgtcgaggcactggagaaggctaaggaggacgcgctggcgaagaaggccaaggggaaggaggaggccggctccgccgatgagctcgacgacgaggagtagctggtggctgctgttgacttcttgttagttgctagtgctacatatgtagggagcccctgatctggttgctggtctcatctcatgagcgaagaataatgctaactagacgacgatttgattat

SEQ ID NO: 2096 - DNA, 1883 bp, Zea mays
atttcttccctgaaacgtagccaaacctgccttgccctctgcttgctagtccatctcttctctcttctccatccatgtagataaatagacgccaagcgctctcggcaccggagcaggccggcgggttcagtggcccctgcaagtgcaagctaaggctcacagcatccgttcggttccggctccgagggactcgctcccgtcggggacggatatatatccatcatggaggcggcggcggcatcttctctgtggggcggcctcaactccggcatcatgctgagcctcctggccgtggtgtgggccatgctgtggcaggcgctgcagggcctccagctgcagcagtacttcgggcgccactcccgccgcctgtcgcgccgcctcgcgtccatcctggacccggacctcaccgtcaccgtcgccgagtacgacggcgggcgcatgcgccgcagcgacgcgttcaaggaggccaaggcgtacctggagcgcgccacgcgggaggcccgcggcggggtgcgccacctcaaggccgagcccgacaaggaccccgaccgcctcctgctcagcatggacgacgacgaggagatcaccgacgagttcaggggcgccaccgtcacgtggcgggcctgcacggcgccgccgcgcgaggacagcgcgccggcctacttctggggccgcgccccgcgcgccgaccgcaggttctaccgcctcttcttcgccgagcgccaccgggacctcgtcctgggagactacctcacccacgtccgccgcgaggggcgcgccgtcatggtcaagaaccgccagcgcaagctcttcaccaacatctccggcgacggctcctgggactcggacggcttgtggtccgacagtgtttggagccacgtggtgttcgagcaccccaagacgttcgcgacgctggccatggacccggacaagaagaaggaggtgatggacgacctggacgcgttccgcaacggcaaggactactacgcgcgcgtcggcaaggcgtggaagcgcggctacctcctgtacgggccgccggggaccggcaagtccaccatgatcgccgccatggccaaccacctcgactacgacgtgtacgacatcgagctcacgtccgtgcgcaccaacaccgaccttcgcaagctcttcatcgagaccaccagcaagtccatcatcgtcgtcgaggacatcgactgctcgctcgacctcactggcaagcgcaagaagaagaacaagaaggaggaggacggcgagaacaagaaggacggtactacgacgaagcagcaggaggaggacaaggagaaggaggacgagaaggcgggcggcagcaaggtgacgctctccggcgtgctcaacttcatcgacgggctgtggtccgcgtgcggcggtgagcgcatcatcgtgttcaccaccaaccacgtggagaagctggacccggcgctcatccggcggggccgcatggacaagcacatcgagatgtcctactgctgcgtccaggccttcaagttcctggccaaggtctacctcgacgtggacgaccacccgcgcttcgacgccgtggcggcgctcctgcgggaggtggacatgacgcctgcggacgtcgccgagaacttgacgcccaaggcacccggcgaggacgccgactcgtgcctcgccgcgcttgtcgaggcactggagaaggctaaggaggacgcgctggcgaagaaggccaaggggaaggaggaggccggctccgccgatgagctcgacgacgaggagtagctggtggctgctgttgacttcttgttagttgctagtgctacatatgtagggagcccctgatctggttgctggtctcatctcatgagcgaagaataatgctaactagacgacgatttgattat

SEQ ID NO: 2097 - DNA, 2421 bp, Zea mays
agagagaaatcacattccaaattggttcttaatgggagggcagattcttggcacatgatactaggaaacagtctttcccgtctaattgctctccctaaacaaacctaatctcgctggcaatgaggacattccactactagacgagaactctagacctgctgccggccaaggttgccatggtacaacaacgttgaaggttgaacgctgaacgggcgcaggaaatggcccaatcacccggcagcagatccgcccgaatcttcggtgctccaacctcgccggcaacaaccgctcccgacgcgtcatgggcccttcctcgctcccgcctccactccgtagctcccacctcacccccgctcctcgcaggctcgaccccacccgttcggtccgcgtgcccgcctcacgttggtccgccgcgcgcgcaccacaccacagtaccacaccacaccacaccgctacatacaaataagcgagccccccggcgcccaacgactttgcaaatcccgtgtgccgcactggccgagcccacattcgaaccaaagtccccccgggcccccccaaggaaaaccatgtgccgcgcccgccacgttcccacgcgccactaaatcagcagcgcccggccgcccggagctgccagtagcggcaacagcaaaacaagaagcagccagctaccggagcactagtaaacagtaagcagcagagagcatggcgagatcagggcgggaagcggagcccggagaggaggaacggaagctggtgctgggcaagtacgagctgggccgcctgctggggcagggcaccttcgccaaggtttactacgcgagggacctgagcgccggcgccggcacgggccacagctgcagcgtagccatcaaggtgatcgacaaggcgcggctgcggcgcacggaggggatggtggagcagctgcgccgggagatctccatcatgcggatggtgcggcaccccaacgtggtgggcatccgggaggtgctcgccagccgctcccgcgtcttcgtcgtcatggagtacgcgcgcggcggggagctcttcgccaaggtggcccggggccgcctcgacgaggaccacgcgcgccgctacttccagcagctggtcgccgccgtcggcttctgccaccgccgcggcgtcgcgcaccgggacctcaagcccgagaacctgctgctggacgaggcggggcggctcaaggtcaccgacttcgggctggccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctcctctgcggcttcctcccgttccagcacgacaactacgtcaagttgtaccagaagatcttcaaggccgactaccaggtgccgccctgggtctccggcgacgcgcgccgcctcatcgcgcgcctgctcgtcgtcgaccccgccaagcgcgcctccatcgccgagatcatgtgcacgccgtggttcaggaagggcttcgtgccgcccgtcctttcgcccccggtgacgcccaagaaacagcagctggacgaaggcgctgccctcttcgacaacgacgacgacgacaacagcaacagcaaccactctggcgccacctcccctcggtcgtgcaacgcgttccagctcatctcgtccatgtcctccgggttcgacctgtcggggctgttcgagagcgagcagaagaccgcgaccgtgttcacggcccgcgcgccggcggccaccgtggtggagaagctggagtccgtggcgcgcgccctaggattcgaggtcaccagggggaaaggctggaaggtgaggatggaggccaaggccgagggcacgaacggacggctcgcggccaccgccgaggtgctcgaggtggccgtggacgtgaccgtggtcgagttcgtgcacgacgccggggacgcgctggactttaacaagttctgcgccgtcgacgtccgcccggggctcacggagatcgtctgggcgtggcagggcgacagccccgccgccgccgtcggcaccgcgtgaacaagcgtccccgtctgtcacgtggaagttgtagcaactttgcgtaggagttaaacacggctgcactggcaccagctttttatagcatgtaaagtttcaagttctcgtcgttgcttcgagactgccatggtggctagttcgttgtgtgccatatgctgtacaggaaggaaagagtcgaatcgagccggggagttttcgatcgacttgccaagttttgtacgatcataacctgtattttctggagatgtgtgcatacaaaattttgcccgtgatcaaatttagttttggtccccatatattttttcccatcaggatgattctacc

SEQ ID NO: 2098 - DNA, 2419 bp, Zea mays
agagaaatcacattccaaattggttcttaatgggagggcagattcttggcacatgatactaggaaacagtctttcccgtctaattgctctccctaaacaaacctaatctcgctggcaatgaggacattccactactaaacgagaactctagacctgctgccggccaaggttgccatggtacaacaacgttgaaggttgaacgctgaacgggcgcaggaaatggcccaatcacccggcagcagatccgcccgaatcttcggtgctccaacctcgccggcaacaaccgctcccgacgcgtcatgggcccttcctcgctcccgcctccactccgtagctcccacctcacccccgctcctcgcaggctcgaccccacccgttcggtccgcgtgcccgcctcacgttggtccgccgcgcgcgcaccacaccacagtaccacaccacaccacaccgctacatacaaataagcgagccccccggcgcccaacgactttgcaaatcccgtgtgccgcactggccgagcccacattcgaaccaaagtccccccgggcccccccaaggaaaaccatgtgccgcgcccgccacgttcccacgcgccactaaatcagcagcgcccggccgcccggagctgccagtagcggcaacagcaaaacaagaagcagccagctaccggagcactagtaaacagtaagcagcagagagcatggcgagatcagggcgggaagcggagcccggagaggaggaacggaagctggtgctgggcaagtacgagctgggccgcctgctggggcagggcaccttcgccaaggtttactacgcgagggacctgagcgccggcgccggcacgggccacagctgcagcgtagccatcaaggtgatcgacaaggcgcggctgcggcgcacggaggggatggtggagcagctgcgccgggagatctccatcatgcggatggtgcggcaccccaacgtggtgggcatccgggaggtgctcgccagccgctcccgcgtcttcgtcgtcatggagtacgcgcgcggcggggagctcttcgccaaggtggcccggggccgcctcgacgaggaccacgcgcgccgctacttccagcagctggtcgccgccgtcggcttctgccaccgccgcggcgtcgcgcaccgggacctcaagcccgagaacctgctgctggacgaggcggggcggctcaaggtcaccgacttcgggctggccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctcctctgcggcttcctcccgttccagcacgacaactacgtcaagttgtaccagaagatcttcaaggccgactaccaggtgccgccctgggtctccggcgacgcgcgccgcctcatcgcgcgcctgctcgtcgtcgaccccgccaagcgcgcctccatcgccgagatcatgtgcacgccgtggttcaggaagggcttcgtgccgcccgtcctttcgcccccggtgacgcccaagaaacagcagctggacgaaggcgctgccctcttcgacaacgacgacgacgacaacagcaacagcaaccactctggcgccacctcccctcggtcgtgcaacgcgttccagctcatctcgtccatgtcctccgggttcgacctgtcggggctgttcgagagcgagcagaagaccgcgaccgtgttcacggcccgcgcgccggcggccaccgtggtggagaagctggagtccgtggcgcgcgccctaggattcgaggtcaccagggggaaaggctggaaggtgaggatggaggccaaggccgagggcacgaacggacggctcgcggccaccgccgaggtgctcgaggtggccgtggacgtgaccgtggtcgagttcgtgcacgacgccggggacgcgctggactttaacaagttttgcgccgtcgacgtccgcccggggctcacggagatcgtctgggcgtggcagggcgacagccccgccgccgccgtcggcaccgcgtgaacaagcgtccccgtctgtcacgtggaagttgtagcaactttgcgtaggagttaaacacggctgcactggcaccagctttttatagcatgtaaagtttcaagttctcgtcgttgcttcgagactgccatggtggctagttcgttgtgtgccatatgctgtacaggaaggaaagagtcgaatcgagccggggagttttcgatcgacttgccaagttttgtacgatcataacctgtattttctggagatgtgtgcatacaaaattttgcccgtgatcaaatttagttttggtccccatatattttttcccatcaggatgattctacc

SEQ ID NO: 2099 - DNA, 1886 bp, Zea mays
aaatcccgtgtgctggcgtgctcgagcccacatcccaaccatatacgagacgagccgacgttcccccggggcccccaaggaaaaccatgtgctgcgctcgccaggtgccactaaatcggtagcgcctggccgcacggagacggagctcctagtaacggcaacaagcagcagcagcaccagcacccagtagtaacacagtaaccggcagaggccatggcgagatcaaggcgggaaggggaggccggaggagaggagcggaagctggtcctgggcaagtacgagctgggccgcctgctggggcagggcaccttcgccaaggtgtactacgcgcgggacctgagcgccgccgccggcacgggcagcaccagcgtggccatcaaggtgatcgacaaggcgcggctgcggcgcatggaggggatggtggagcagctgcgccgggagatctccatcatgcggatggtgcgccaccccaacgtggtgggcatccgggaggtgctcgccagccgctcccgcgtcttcgtcgtcatggagtacgcgcgcggcggggagctcttcgccaaggtggcccggggccgcctcaccgaggaccacgcgcggcgctacttccagcagctcgtggccgccgtcggcttctgccaccgccgcggcgtcgcgcaccgggacctcaagcccgagaacctgctgctcgacgaggacggccgcctcaaggtcaccgacttcgggctcgccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctgctctgcggcttcctcccgttccagcacgacaactgcgccaagatgtaccagaggatcttcaaggccgagtaccaggtgccgccctgggtgtccggcgacgcgcgccgcctcatcgcgcgcctgctcgtcgtcgaccccgccaagcgcgcctctatcccggaggtcatgtgcacgccgtggttcaggaagggcttcgtgccgcccgtcctttcagtttcacccccgatgacgcccaagaaacggctggacggagatgacgacggcggcggtgcgctcttcgacagcagcagcaactctggcgccacctctcctcggtcgtgcaacgcgttccagctcatctcctccatgtcctccgggctcgacctgtcggggctgttcgagaacgaacagaaggccgcgaccgtgttcacggcccgcgcgccggcggccaccgtggtggagaagctcgagtccgcagcgcgcgccctgggattcgagaccaccagggggaagggctggaaggtgaggatggaggctaaggccgggggcacaaacggacggctcgctgtcaccgccgaggtgctcgaggtggccgtggacgtggccgtcgtcgagttcgcgcacgacgccggggacgcgctggacttcaacaagttctgcgctgtggacgtccgtccggggctcgcggaaatcgtctgggcgtggcagggcgacagcccggccgccgtcgttgggaccgcgtgaacctacggccgcccgttcgtcctggcgtccacgcctgttggagccagccttacacggctgcatcggcaccatgtaaagtttccgttgttgcttcgagacagccatggctagttcgttatgagtcgtatgttgtacaggaagagaacaagtgcaaaactgaagagaggtttctgtcgacacgagagccgaatcgagccgggagtgttcgatcggcttgcaaagttttgtagatcatataatcgctattttgtggagatgcgcacatacacaattttgttttggtcgcc

SEQ ID NO: 2100 - DNA, 2120 bp, Zea mays
gggaggggaggggaaggggggagcgctgcagtcagtctaaggggcccttccccgctcccgccgccaatagggggctcccacctcaccccctcctcgcggctccaccgcacggttcaactgagccgaccccacccgtcaggtccgcgtgcccgcctcccgttggtccgccgagcaccacatcacaccgctacatacaaataaataagcgagacaccggcgcccaacgacttcccaaatcccgtgtgctggcgtgctcgagcccacatcccaaccatatacgagacgagccgacgttcccccgggcccccaaggaaaaccatgtgctgtgcccgccaggtgccactaaatcggtagcgcatgctagcactgagacggagctcccagtaacggcaacaacaagcagcagcagccagacagccagtagtaacacagtaaccggcagaggccatggcgagatcaaggcaggaaggggaggccggaggagaggagcggaagctggtcctgggcaagtacgagctgggccgcctgctggggcagggcaccttcgccaaggtgtactacgcgcgggacctgagcgccgccgccggcacgggcagcaccagcgtggccatcaaggtgatcgacaaggcgcggctgcggcgcatggaggggatggtggagcagctgcgccgggagatctccatcatgcggatggtgcgccaccccaacgtggtgggcatccgggaggtgctcgccagccgctcccgcgtcttcgtggtcatggagtacgcgcgcggcggggagctcttcgccaaggtggcccggggccgcctcaccgaggaccacgcgcggcgctacttccagcagctcgtggccgccgtcggcttctgccaccgccgcggcgtcgcgcaccgggacctcaagcccgagaacctgctgctcgacggggacggccggctcaaggtcaccgacttcgggctcgccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctgctctgcggcttcctcccgttccagcacgacaactgcgccaagatgtaccagaggatcttcaaggccgagtaccaggtgccgccctgggtgtccggcgacgcgcgccgcctcatcgcgcgcctgctcgtcgtcgaccccgccaagcgcgcctctatcccggaggtcatgtgcacgccgtggttcaggaagggcttcgtgccgcccgtcctttcagtttcacccccgatgacgcccaagaaacggctggacggagatgacgacggcggcggtgcgctcttcgacagcagcagcaactctggcgccacctctcctcggtcgtgcaacgcgttccagctcatctcctccatgtcctccgggctcgacctgtcggggctgttcgagaacgaacagaaggccgcgaccgtgttcacggcccgcgcgccggcggccaccgtggtggagaagctcgagtccgcagcgcgcgccctgggattcgagaccaccagggggaagggctggaaggtgaggatggaggctaaggccgggggcacaaacggacggctcgctgtcaccgccgaggtgctcgaggtggccgtggacgtggccgtcgtcgagttcgcgcacgacgccggggacgcgctggacttcaacaagttctgcgctgtggacgtccgtccggggctcgcggaaatcgtctgggcgtggcagggcgacagcccggccgccgtcgttgggaccgcgtgaacctacggccgcccgttcgtcctggcgtccacgcctgttggagccagccttacacggctgcatcggcaccatgtaaagtttccgttgttgcttcgagacagccatggctagttcgttatgagtcgtatgttgtacaggaagagaacaagtgcaaaactgaagagaggtttctgtcgacacgagagccgaatcgagccgggagtgttcgatcggcttgcaaagttttgtagatcatataatcgctattttgtggagatgcgcacatacacaattttgttttggtcgcc

SEQ ID NO: 2101 - DNA, 3285 bp, Zea mays
ctttgttgccaatttccgctccaagcgtcgcggtcgtgaagtctcgttgcgatggattcgaggccccgcgagactgacgcccccggcgacccggccaacggcgccgcccctccgctggccgcggcggtgacggccgcgaccggggacgtcgagatcatcaggccccgcaacgacaagcgtgggtaccgccgcgtcgtgctccctaactcgctcgagtgcctgctcatcagcgaccccgacaccgataaggcggcggcgtcaatgaatgtttcggtggggtacttctgcgaccccgatgggctggaagggctcgcacacttcctcgagcatatgcttttctatgccagtgaaaaatatccagaagaagacagttactcaaagtacattgcagagcatggtggttcaacgaatgctttcacatcttctgaacacacaaacttctattttgatgtgaacagtgatagcctgcacgatgctttagataggtttgcccaattttttatcaagccattgatgtccccagatgctacacttagggaaataaaagctgttgactctgaaaatcagaaaaacctcttgtcagatccttggcgaatgagtcagcttcagaagcatctttgtgcagagaatcatccttatcataagtttagcactggaaattggaacacacttgaagttaaagcaaaggagaaaggattggacacaaggcttgagcttattaaattttatgattcacactactcagctaacttgatgcaactcgttgtgtatggaaaagatagccttgataacctgcagaaccttgttgaaaataagttttgcgatattagagatgttgggaggaagccattttcatttcctggtcatccatgtacacctgaacatctccaggtccttgtcaaagcagttcccattaaacaagggcacactttgagaatcttatttccaatcactcccaatatccgttgttacaaagaaggcccttgcaagtacattagccatctgattggtcatgaaggagaaggatctcttttttacgtacttaagaagttgggatgggctatgagtttggaagctggtgaaggggattggagtcatgatttttcattcttctgcgttgttattcagctcacagatgtaggccaggaacacatggaggatactctcggactattgttcagatatataaagttgctgcagaactctggaactcctaagtggatatttgatgagcttcaagctatctgtgagacaggattccactaccgagacaagagcccccctatcaattatgttgtaaatatttcttctaacatgcagatttttccaccaaaagattggttgattgcgtcatctgtgccatcaaagttttcaccagatgctattcagaatgttttaaatgaactgactcctgagactgtaagaatattctgggaatcgaaaaagtttgaagggaaaacaaaattagcagagccatggtatggtacatcatattctgtcgaagttgtccctccatcaatcatacagaaatgggtagggaaagcccctgaggaagatctacacctgccaaagcgtaacatcttcattccaagtgatctttcactgagaagtgtagaggaaaaggtaagttttcctgccatgctgaggaagacacaattttcgagactctggtacaagcccgatacaatgtttttcacacccaaggcttatatcaagatggattttcactgtccactatctcaaagctcacctgagtcggcagttcttactgatgtattcacaaggttgcttatggattatttgaatgattatgcttatgacgcccaagttgctggcctctattatgttgttaagccaaatgacactggttttcaggtaactatggttggcttcaatgacaaaatgagaacccttttggagactgttattggaaaaattgcagaatttgaagttaaggctgaccgtttttctgtgataaaggaagctatgacaaaggagtatgagaatttcaagtttcggcagccataccaacaagtcctatattattgttcgctaatactggaggaccaaacatggccatgggatgaggaattttctgcactttctcaccttgaagctagtgatctgggaatttttttgccccatttgctatcaaaaaccttcatcgagtgttattttgcaggtaatattgaacccaatgaagcaaacaatatcgttcaacatgttgaagatgtcttattcaatgcaccaattagtgcttgcaagccactatccccatcgcagcatcttgccaagaggattgtaaagcttgagaagggtttgagatactattatccagcaatgtgctcaaatcaccaagatgaaaattctgctcttctgcactatattcagactcatcaggataatgttaagcaaaatgttctacttcaactacttgctcttgttggcaagcagccagcttttcatcaattgcgatcagttgagcaacttggctacatagcgcttcttaggcaaagaaatgattcaggtgtccgtgggttgcaatttataatccagtcaacggtgaaggatcctgctaatctggatgccagagttgaaaattttctcaacatgtttgaaagcaatgtctacaatatgtctgatgcagagttcaagagtaatgtaagtgctcttattgatatgaaactggagaaatacaaaaacatacgcgaagaatcagctttcttctatggagagatttctgaaggaaccctcaaatttgatagaaaagaagcagaggttgctgcactgagggagctcaagaaggaagagttggtaggcttcttcaatgatcatgtcaaggtcaatgcaccacaaaagaagattcttagtatacaagtgtacggtggtctccattctgccgagtacgaaaccatagtgcaaaatgctccgccaccgccgtcgtgtgagataactgatatttatggcttcaggaggtcgaggcctttatatggatcattcaggggaggcgttggtcagatgaagctatagttcaacattttctcatcattctgtaaaattctgaaaaagagtcatctttctgttcaactgcatctacgttgattgttttttcattgcgaacactctagtaggccatttatctacggttttttcactatattcattaagatattatgagatttcacattgccttgtaaagacaaatctctagccatgtttggttggtctgagatacaccatatattagactaaaaaggaaaaaaaaagaaatattcggttaatcaa

SEQ ID NO: 2102 - DNA, 3460 bp, Panicum virgatum
gtcgtcagcgcccaccactccggcacttcgtccctcccctcaaatccaaccgcggcgagccaaagccaatccaaaccaaacctaacccgctgctccactgccaggtgccaacttcctctccaatcctcgctctcgcggactcctctcatcggggggccggcggcggcgactaagccgcgatggactcgaggccccgcgagaccgacgcccccggcgacccggccaacggcgccgcccctccgccggccgcggcggtggcggctgctgcgacggggggcgtcgagatcaccaagccccgcaacgacaagcgcgagtaccgccgcgtggtgctccccaacgcgctcgagtgcctgttcatcagcgaccccgacaccgacaaggcggcggcgtcgatgagtgtttcggtggggtacttctgcgatcccgatggtctggaggggctcgcccatttcctcgagcacatgcttttctatactagtgaaaaatatccaatagaagatagttactcaaagtacattgcagagcatggtggttcaaccaatgcgttcacaactactgaacgcacaaatttttattttgatgtgaacagtgatagccttcatgatgctttagataggtttgcacaattctttatcaagccattgatgtctccagatgctgtacatagggaaataaaagctgttgactctgaaaatcagaaaaaccttttatcagatccttggcgaatgagtcagcttcagaaccatctttgcgatgagaatcacccttatcataagtttggcactgggaattgggatactcttgaagttaaagcaaaggagaaaggattagacacaaggcttgagcttattaaattctatgattcacactactctgccaacttgatgaaacttgttgtttatggaaaagatagtctcgataacttgcagaaccttgttgaaaataagttctgtgatattagagacatcgggaggaagccattttcatttcctggtcatccatgttcaagtgaacatctccagatccttgtcaaagcagttcccataaaacaaggtcacacgttgagaatcctgtggccaatcactcccaatgtccggtgttacaaagaaggcccttgcaagtacattagccatctaattggccatgaaggagaagggtctcttttttacatacttaaaaagttaggatgggctataagtttggaagctggtgaaggggattggagttatgatttttctttcttctctgttgttatacggctcacagatgaaggccaggagcacatggaggatgctgtcggactactattcagatatataactctgctgcagacatctggaactccgaagtggatctttgatgagcttcaaactatctgtgagacaggattccactaccgagacaagggccctcctatccattatgttgtaaatatttcttcaaacatgcagatttttccaccagaagattggttgattgcagcatctatgccatcaaagttttcgccagatgctattcagaatattttaaatgaattgactcctgagaatgtaaaggatattctgggaatcgaaaaggtttgaaggacaaacaaacttaacagagccatggtatggtacatcgtattctgttgaagctgtccctccatccattatacagaaatggttagtgaaagcctctgaggaagatttacacctgccaaaacctaacatcttcattccacgtgacctctcattaaaaaatatagaggaaaaggtaagtgttcctttcatgctgaggaagacaccgttctccagattgtggtacaagcccgatacaatgtttttcacacccaaagcctatatcaagatggattttcactgtccactgtcccaaagctcacccgagtcagcagttcttactgatgtattcacaaggttgctaatggattatttaaatgattatgcttatgacgctcaagttgctggcctttattacgctgttaagccaaatgatactggttttcaggtaactatggttggatacaatgacaaaatgagaacccttctggagactgttattgacaaaattgcagagtttgaagttagggttgaccgtttttctgtgataaaggaagctatgacaaaggagtatgagaatttcaaatttcggcagccatatcagcaagtcttgtattattgttcactgatgctagatgaccaagcatggccatgggatgaggaattttctgcactcttctcaccttgaagctagtgatctgggaaaatttttgcctcatttgctggcaaagactttcattgagtgttattttgcaggtaacattgaacccaatgaagcaaagagtgtcatccagcatgtcgaagatgtcttgttcaatgcacccattagtgtttgcaagccattatccccatcacagcatcttgcaaagcggattgtaaagcttgaaaagggtttgagatactattatccagcaatgtgcttgaatcaccaagatgaaaattctgctcttctgcactatattcagactcatcaggataatgtcaagcaaaatgttctacttcatctacttgcacttattggcaagcagccagctttccatcaattgcgatcagttgagcaacttggctacatagcgctgcttaggcaaagaaatgattcaggtgtccgggggttgcaatttataatccagtcaactgtgaaggatcctgccaatctggatgctagagttgaaaattttcttaagatgtttgaaagcaccctttaccagatgtctgatgcagaattcaagagtaatgtcagagctcttattgatatgaaactggagaaatacaaaaacatacgcgaggaatcagcattcttctggggagagatttctgaaggaacccttaaatttgatagaaaagaagcggaggttgctgcactgagggagctcaagaaggaagagttgatagacttcttcaatgatcatgtgaaagtcaatgcaccacaaaagaagattcttagtatacaagtgtacggtggtctccatactgccgagtaccaaacgatagtgcaaaatgctccaccaccgcaatcatgtgagataactgatatatacagcttcaggaggtcacggcctttgtatggatcgttcaggggaggttttggccagatgaagttataggacaaccttttcttttcttttgcaaaaaactgaaaaataatctgtgtaattgccttatttgtaaaagaatgtttttctcatttggactaggttggcttgcatgtattttggcggtttatttgattaaggatagtactccaagatctagtgagttttcacaccgacaggtaaagaggaagtaggtcgcctgagttgcattgcgtcagccaagttatgacagcttggattattaaaggcggcatttctggtaagtacaattgcaggagttcgatttgtaaaagcaaaccctgtctttcc

SEQ ID NO: 2103 - DNA, 3198 bp, Oryza sativa
cgcagatccaccgcccccacctctctcgcggtctcgccgtgccaaagccaaagccaaacccaacccaaccgcaaccgcccggaggcctcgcggactcagccagtccacgccatcggcggcgagtcagcggcggcggacgcgatggattcgaggccccccgagaccgacgcccccgccgaggcggtcccaccggcggcggcggcggcggcggcggcggcgggcgatgtggagatcaccaggccacgcaacgacaagcgcgggtaccgccgcgtcgtgctccccaacgacctcgagtgcctcctcgtcagcgaccccgacaccgacaaggcggcggcgtcgatgaacgtctcggtgggctacttctgcgatcccgaggggctcgaggggctcgcgcacttccttgagcatatgcttttctatgctagtgagaaatatcctatagaagacagttactccaagtatattacagagcatggtggttcaaccaatgccttcacaacttgtgaacatacaaacttcttttttgatgtgaaccatgattgcctcaatgatgctttggacaggtttgcacaattcttcataaagccattactgtcagccgatgcaactcttagggagataaaagctgttgactctgaaaatcagaaaaacttattatcagatccttggcgaatgaaccagcttcaaaaccatatttccttggagagccatccatatcacaagtttggcactggaaattgggacactttggaggttaaaccaaaggagaaaggattggacacaaggcttgagcttattaaattttatgattcacactactcagccaacttgatgcagcttgttgtgtatgggaaagagagtcttgacaatcttcaaactcttgttgaaaataagttttgtggtgtcaggaatactggaagggaacgattttcctttcctggtcatccgtgttcaagtgaacacctacaggtccttgttaaagcagttcccattaaacaaggccatactttgagaatactatggccaatcaccccaaatattcgacattacaaggaaggtccttgcaagtatgtgagtcatctaattggccatgaaggagaggggtctctgttttatgtcctaaaaaagttaggttgggctatgagtttggaagcaggggaaggtgattggagttatgagttttctttcttcagtgttgtcataaagctcactgatgtaggccacgagcacatggaggatattgttggactgttgttcagatacataacattacttcagacctctggcactctgaagtggatttttgatgagcttcaaactatttgtgagacaggattccactatcgagacaagggtcctcctatccattatgttgccaatatttcctcaaacatgcagatctatccgccggaagattggctgattgcatcgtccgtgccatcaaaattttccccagatgctattcagggtatattaaatgagttgactcctgataatgttaggatattctgggagtccaaaaaatttgaagggcaaacaaacttaacagagccgtggtatggtacatcatattctgtggaagcagttcctccatccattatacagaaatgggtagagaaagctcccgtggaagatttgcacatgccaaaacctaatatcttccttccaagtgatctttcattgaaaaatgccgaggagaaggcaagttttccttgtatgttgaggaaaacactgttttccagagtgtggtataaacctgatacaatgttcttcacacccaaggcctatatcaagatggatttccactgtccactgtcccgtagttctcctgaatcatcagttcttactgatgtattcacaaggttgctcatggattatttaaatgattatgcttatgatgctcaagttgctggtctttattacggtgttaggccaaatgacactggttttcagataaccatggttggctacaatgacaaaatgagaactcttttggagactgttattgggaaaattgctgagtttgaagttaaggctgaccgtttttctgtgataaaggaaactataacaaaggagtatgagaatttcaaatttcggcaaccatatcagcaagctttctactattgttcattgatattagaggagcaaacgtgggcatgggatgaagaacttgctgcagtatctcaaattgaagctagcgatctcgagaagtttttgcctcatctgctggggaaaacatttattgagagctactttgctgggaacatggaaccgggtgcggtaaaaggtgttatgcagcatgttgaagacatcttattcaatgcacctgtcagtctgtgcaaagcattaccctcatcacagcatcttacaaagcgaattgtaaagcttgaaaggggtttgaggtattattatccagcattatgcctaaatcaccaggatgaaaattcttgccttctgcattatattcagattcatcaggatgatctcaaaaaaaatgttatactccagttgcttgctcttgttgctaagcaaccagcttttcaccaattacgttcagttgagcaacttggctacataacactgcttagacaaaaaaatgattcaggtgtccgtggtttgcaatttataatccagtcaaccgtgaaggatccagccaacttggatgctagagttgaagctttccttacgatgtttgaaggaactctataccaaatgcctgatacagaattcaagagtaacgtgaacgctctcattgacatgaagttggagaaatacaagaatataagagaggaatcagctttcttctggggagagatttcggaaggaactctgaaatttgatcgaaaagaagtggaggttgctgcactgagggatcttaagaaagaggagttgatagagttcttcaacaatcatgtcaaagttaatgcaccacaaaagaagatactcagtattcaagtttacggcggtctccattcctcggagtacgaaaagatagtccacgatgagccacgaccaaattcctatcaaataacagatatattcaacttcaggaggtcgagacctttatatggttcatacaagggaggtgttggtcagatgaagctataagtcaacccttttgatattcttgcaaattccaaaagaataatccttttacgtgtaattttgatcattattaaagaaacttttttgtggaca

SEQ ID NO: 2104 - DNA, 3417 bp, Triticum aestivum
  misc_feature (10)..(10): n is a, c, g, or t
  misc_feature (73)..(73): n is a, c, g, or t
  misc_feature (156)..(156): n is a, c, g, or t
  misc_feature (195)..(195): n is a, c, g, or t
  misc_feature (1041)..(1041): n is a, c, g, or t
  misc_feature (1201)..(1201): n is a, c, g, or t
ggggatacgncgacccacgcgtccgcccgagcagcgagcctcgcccaagacttacctccccaacccccgtgcnagacttgccctcccctagcgccgacgacgactgggcggcgacgcgatggattcgaggctgcgagaggtagacgcccccgccgngccggccgacggcgccgctgcgctggccaccgcgaaggntgaggtcgaagtcaccaagccccgcaacgacaggcgcgggtaccgccgcgtggtgctcccgaacgccctcgagtgcctcctcatcagcgaccccgacaccgacaaggcggcggcgtcgatgaatgtctcggtggggtacttctgcgatcccgatgggatggaggggctcgcgcacttcctcgagcatatgcttttctacgcgagtgaaaaatatccaatagaagacagttactcaaagtacatttctgagcatggtggttcgacaaatgcctttacagcctctgaacacacaaacttctattttgatgtgaacaatgacagcctggatgatgctttagataggttcgcacaattttttataaagccattgatgtcccctgatgcaacccttagggaaataaaagctgttgactctgaaaaccagaaaaatctattgtcagatccatggcgaatgagtcagctccagaagcatctttgctcgaataaccacccatatcacaagttcagcactggaaattgggacacactggaggttaaaccaaaggagaaaggattggacacaagggctgagcttattaatttctatgattcacactactcagccaacttgatgcagcttgctgtgtatggaaaagagagtcttgacaacatccaaacccttgtcgaaagtaagttctgtgatatcaagaacgttgggaggaagcacttttcttttcctggtcatccatgttcaagcaaagatctccagatccttgttaaagcggttcctataaaacaaggtcatactttgcgaatactgtggccaatcactccaaatgttaggcattacaaggaaggtccttgtangtatgtgagccatctaatcggtcatgaaggagaaggatctctcttttacatactaaaaaagttgggatgggctatgagtttggaagcaggggaaggggattggagttatgatttctctttcttcagtgtcgttatacagctcacagatgtaggccatgancacatggaggatgtcgttgggttgctgttcagatacattacattgcttcagacctctggaactccaaagtggatttttgatgagcttctagccatctgcgagacgggattccactatcgagacaagagccctcctagcaattatgttgtcaatatttcctcaaacatgcagatttttccaccagaagattggctgatcgcgtcgtctgtaccatcaaagttttcaccagatgctattcagaaggtgctaaatgaattgactacagagaatgttagaatattctgggagtcaaaattatttgaagggcatacagacttaacagaaccttggtatggtacgtcatattgtgttgaagcagtgcctccttccattatgcagaaatgggtagaaaatgctcccaacgaagatttacacctgccaaaacctaatatcttcattccaactgatctttcattgaaaaatgttgaggaaaagacaagttttccttgcatgctgaggaaaacactgttttccagattgtggtacaagcccgatacaatgttcttcacacccaaggtcttcatcaagatggatttccactgtcctctgtccaatagctcccctgaatcatcagttcttactgacgtattcactaggttgctgatggattatttgaatgattatgcttatgatgctgaagttgctggtctttattatgctgttaggccgaacgacaccggttttcaggttactatggttggctataatgacaaaatgagaacccttctggacactgttattggcaaaattgcagactttgaagttaagattgaccgcttttctgtgataaaggaaactatgacgaagggatatgagaattttaaatttcggcagccatatcagcaagcaatgtacaattgcacattgatattggaggagcaaacttggccttgggatgaagaacttgctgcactttctaatcttgaagctcgcaatttagaggatttcttgcctcgtatgctggcaaagacatttatagagtgctattttgcagggaatattgaaccaagcgaagcggaaagtgttgtccagcatattgaaggcatattgtttaattcatccacaagtgtttgcaaatcattaccaccgtcccagcatcttacaaagcgaattgttaagcttgaaaggggtttgaggtattattatccagcaatgtgcttgaatcagcaggatgaaaattcttctcttctgcattatattcagattcatcaggatgatctcaaacaaaatgtcctacttcagttgcttgctgttgtagctaagcaaccggcttttcaccaattacgttcggtcgagcaacttgggtacatagcactgcttagacagagaaatgattcaggagtccgtgggttgcaatttataatccagtcaaccgtgaaggatccatccaatctggatgcaagggttgaagctttcctgaagatgtttgaagtcacactacacgaaatgcctgatgcagaattcaagagtaatgtcaatgctctcattgacatgaaacgggagaaatacaagaacataagggaggaatcagcattcttttggggggagatttctcaaggaacactgaaatttgatagaaaggaaacagagattgctgcactggaggagcttaagaaggaagagctgatagagttctttgataatcatgtcaaggttggcgcaccagaaaagaagatccttagcattcaaatctatggcggtctccattcctccgaatacgaaaagattattcatgatgctccgccaccgcattcgcatcgaataactgatatattcagcttcaggaggtcgagacctttatatggttcattcagaggtggtgctggtcagatgaagctataggacaactttgtttcgagtcatatttacattcacttgaattgttcctatagaaaataatgtgtgggacaaatgctcgcacttttggctaggctgaatattccataccaaatctagtcatatcactttgaaattttacatggtattcttttctatactgattatcagacctgaaagtgttcgaccggcatactttctaaacctgtttatatcatgaatcagaggatggaattagcaagccgctgagcacaagtcagaagtagagtctgctattggttactatgctcttttttttcctgaacttatttggttacttataaaggtcacctagccacacc

SEQ ID NO: 2105 - DNA, 3299 bp, Hordeum vulgare
aacccggggagcgagcctcgcgcaagacttgacctcccccaacccccgtgcgaagcctcgcaagacttgcgctcccctagcgacgacgacgactgggcggcgacgcgatggattcgaggctgcgcgaggtagatgtccccagcgagccggccggcggcgcctctgctccggccatcgcgaaggttgaggtcgaagtcaccaagccccgcaacgacaggcgcgggtaccgccgcgtggtgctcccgaatgccctggagtgcctcctcatcagcgaccccgacaccgacaaggcggcggcgtcgatgaatgtctcggtggggtacttctgcgatcccgatgggatggaggggctcgcgcacttcctcgagcatatgcttttctacgcgagtgaaaaatatccaatagaagacagttactcaaagtacatcgcagagcatggtggttcaaccaatgccttcacaacctctgaacacacaaacttctattttgatgtgaacaatgacagcctggatgatgctttagataggtttgcacaatttttcataaagccattgatgtcccctgatgcaacccttagggaaataaaagctgttgactctgaaaatcagaaaaatctattgtcagatccatggcgaatgagtcagctccagaagcatctttgctcgaataaccacccatatcacaagttcagcactggaaattgggacacactggaggttaaaccaaaggagaaaggattggacacaagggctgagcttattaatttctatgattcacactactcagccaacttgatgcagcttgttgtgtatggaaaagatagtcttgacaacattcaaacccttgtcgaaagtaagttctgtgatatcaagaacgttgggaggaagcacttttcttttcctggtcatccatgttcaagcaaagatctccagatccttgttaaagcggttcctataaaacaaggtcatactttgcgaatactgtggccaatcactccaaatgttagacattacaaggaaggtccttgcaagtatgtgagccatctaattggtcatgaaggagaaggatcactcttttacatactaaaaaagttgggatgggcaatgagtttggaagcaggggaaggggattggagttacgagttctctttcttcagtgtcgttatacagcttacagatgtaggccaggagcacatggaggatgttgttgggttgctgttcagatacattacattgcttcagacctctggaactccaaagtggatttttgatgagcttctatccatctgcgagacgggattccactatcgagacaagagccctcctatgaattatgttgtcaatatttcctcaaacatgcagatttttccaccagaagattggcttattgcgtcgtctgtaccatcaaagttttcaccagatgctattcagaaggtgctaaatgaattgactacagagaatgttagaatattctgggagtcaaaattatttgaagggcaaacagacttaactgaaccttggtatggtacgtcatatagtgttgaagcagtgcctccttccattatgcagaaatgggtagaaaatgctcccaacgaagatttacacctgccaaaacctaatatcttcattccaactgacctttcattgaaaaatgttgaggaaaaggcaagttttccttgcatgctgaggaaaacaccgttttccagattgtggtacaagcccgatacaatgtttttcacaccgaaggtcttcatcaagatggatttccactgtcctctgtccaatagctcccccgaatcatcagttcttactgatgtattcactaggttgctgacggattatttgaatgattatgcttatgatgctgaagttgctggtctttattatgctgttaggccgaacgacactggttttcaggttactatggttggctataatgacaaaatgagaacccttctggacactgttattggcaaaattgcagactttgaagttaagattgaccgtttttctgtgataaaggaaactataacaaagggatatgagaattttaaatttcggcagccatatcagcaagcaatgtacaattgcacattgatattggaggagcaaacttggccttgggatgaagaacttgctgcactttctaatcttgaagctcgcaatttagaggatttcttgcctcgtatgctggcaaagacatttatagagtgctattttgcaggaaatattgaaccaagtgaagcggaaagtgttgtccagcatattgaaggcaccttgtttaattcatccaccagtgtttgcaaatcattaccaccgtcacagcatcttacaaagcgaattgtgaagcttgaaaggggtttgaggtattattatccagcaatgtgcttaaatcagcaggatgaaaattcttcccttctgcattatattcagattcatcaggacgatctcaaacaaaatgtcctacttgagttgcttgctgttgttgctaagcaaccggcttttcaccaattacgttcggttgagcagcttgggtacatagcactgcttagacagagaaatgattcaggagtccgtgggttgcaatttataatccagtcaaccgtgaaggatccatccaatctggatgccagggttgaagctttcctcaagatgtttgaagtcacactacacgaaatgcctgatgcagaattcaagagtaatgtcaatgctgtcattgacatgaaacgggagaaatacaagaacataagggaggaatcagcattcttttggggggagatttctcaaggaacactgaaatttgatagaaaggaagcagaggttgctgcactgggggagcttaagaaggaagagttgatagagttctttgataattatgtcaaggtcggcgcaccagaaaagaagatccttagcatacaaatctatggtggtctccatgcctctgagtacgaaaagattgttcatgatgttccgccaccgcattcgcatcgaataactgatatattcagcttcaggaggtcgagacctttatatggttcattcaaaggtggtgctggtcagatgaagctataggacaactttgtttcgtgtcttatttacattcaacttgtatttttcctaaagaaaataatgtgtgggacaaatgttctcacttttggctaggctgaatatattccatacatattagtttgaagttttacatgttgatgttcgtttctataccgacgattagacctgaaagtgttcgactggcatacattctaaacctgtttatatcatgaatcagaggatgtagctagc

SEQ ID NO: 2106 - DNA, 3310 bp, Hordeum vulgare
ctggaaaagccaacccggggagcgagcctcgcgcaagacttgacctcccccaacccccgtgcgaagcctcgcaagacttgcgctcccctagcgacgacgacgactgggcggcgacgcgatggattcgaggctgcgcgaggtagatgtccccagcgagccggccggcggcgcctctgctccggccatcgcgaaggttgaggtcgaagtcaccaagccccgcaacgacaggcgcgggtaccgccgcgtggtgctcccgaatgccctggagtgcctcctcatcagcgaccccgacaccgacaaggcggcggcgtcgatgaatgtctcggtggggtacttctgcgatcccgatgggatggaggggctcgcgcacttcctcgagcatatgcttttctacgcgagtgaaaaatatccaatagaagacagttactcaaagtacatcgcagagcatggtggttcaaccaatgccttcacaacctctgaacacacaaacttctattttgatgtgaacaatgacagcctggatgatgctttagataggtttgcacaatttttcataaagccattgatgtcccctgatgcaacccttagggaaataaaagctgttgactctgaaaatcagaaaaatctattgtcagatccatggcgaatgagtcagctccagaagcatctttgctcgaataaccacccatatcacaagttcagcactggaaattgggacacactggaggttaaaccaaaggagaaaggattggacacaagggctgagcttattaatttctatgattcacactactcagccaacttgatgcagcttgttgtgtatggaaaagatagtcttgacaacattcaaacccttgtcgaaagtaagttctgtgatatcaagaacgttgggaggaagcacttttcttttcctggtcatccatgttcaagcaaagatctccagatccttgttaaagcggttcctataaaacaaggtcatactttgcgaatactgtggccaatcactccaaatgttagacattacaaggaaggtccttgcaagtatgtgagccatctaattggtcatgaaggagaaggatcactcttttacatactaaaaaagttgggatgggcaatgagtttggaagcaggggaaggggattggagttacgagttctctttcttcagtgtcgttatacagcttacagatgtaggccaggagcacatggaggatgttgttgggttgctgttcagatacattacattgcttcagacctctggaactccaaagtggatttttgatgagcttctatccatctgcgagacgggattccactatcgagacaagagccctcctatgaattatgttgtcaatatttcctcaaacatgcagatttttccaccagaagattggcttattgcgtcgtctgtaccatcaaagttttcaccagatgctattcagaaggtgctaaatgaattgactacagagaatgttagaatattctgggagtcaaaattatttgaagggcaaacagacttaactgaaccttggtatggtacgtcatatagtgttgaagcagtgcctccttccattatgcagaaatgggtagaaaatgctcccaacgaagatttacacctgccaaaacctaatatcttcattccaactgacctttcattgaaaaatgttgaggaaaaggcaagttttccttgcatgctgaggaaaacaccgttttccagattgtggtacaagcccgatacaatgtttttcacaccgaaggtcttcatcaagatggatttccactgtcctctgtccaatagctcccccgaatcatcagttcttactgatgtattcactaggttgctgacggattatttgaatgattatgcttatgatgctgaagttgctggtctttattatgctgttaggccgaacgacactggttttcaggttactatggttggctataatgacaaaatgagaacccttctggacactgttattggcaaaattgcagactttgaagttaagattgaccgtttttctgtgataaaggaaactataacaaagggatatgagaattttaaatttcggcagccatatcagcaagcaatgtacaattgcacattgatattggaggagcaaacttggccttgggatgaagaacttgctgcactttctaatcttgaagctcgcaatttagaggatttcttgcctcgtatgctggcaaagacatttatagagtgctattttgcaggaaatattgaaccaagtgaagcggaaagtgttgtccagcatattgaaggcaccttgtttaattcatccaccagtgtttgcaaatcattaccaccgtcacagcatcttacaaagcgaattgtgaagcttgaaaggggtttgaggtattattatccagcaatgtgcttaaatcagcaggatgaaaattcttcccttctgcattatattcagattcatcaggacgatctcaaacaaaatgtcctacttgagttgcttgctgttgttgctaagcaaccggcttttcaccaattacgttcggttgagcagcttgggtacatagcactgcttagacagagaaatgattcaggagtccgtgggttgcaatttataatccagtcaaccgtgaaggatccatccaatctggatgccagggttgaagctttcctcaagatgtttgaagtcacactacacgaaatgcctgatgcagaattcaagagtaatgtcaatgctgtcattgacatgaaacgggagaaatacaagaacataagggaggaatcagcattcttttggggggagatttctcaaggaacactgaaatttgatagaaaggaagcagaggttgctgcactgggggagcttaagaaggaagagttgatagagttctttgataattatgtcaaggtcggcgcaccagaaaagaagatccttagcatacaaatctatggtggtctccatgcctctgagtacgaaaagattgttcatgatgttccgccaccgcattcgcatcgaataactgatatattcagcttcaggaggtcgagacctttatatggttcattcaaaggtggtgctggtcagatgaagctataggacaactttgtttcgtgtcttatttacattcaacttgtatttttcctaaagaaaataatgtgtgggacaaatgttctcacttttggctaggctgaatatattccatacatattagtttgaagttttacatgttgatgttcgtttctataccgacgattagacctgaaagtgttcgactggcatacattctaaacctgtttatatcatgaatcagaggatgtagctagc

SEQ ID NO: 2107 - DNA, 3259 bp, Brachypodium distachyon
gtgcccagctctcgtgcgaagccttccccttccccaagcgacgacgaccaccgtgcggcgacgcgatggattcgaggccgcgcgagggagacgcccccaccgagcctgccgatggcggcgccccgccggccaccgcgaaggttgaggtcgagattaccaagccccgcaacgacaagcgtgagtaccgccgcgtggtgctccccaacgccctcgagtgcctcctcatcagcgaccccgacaccgacaagggggcggcgtcgatgaatgtctcggtgggttacttctgcgatcccgatgggatggaggggctcgcgcacttccttgagcatatgcttttctatgccagtgagaagtatcctatagaagacagttactcaaaatacattgcagagcatggtggttcaaccaatgcctttacatcttctgaacacacaaacttctattttgatgtgaatagtgactgcctggatgacgctttggataggtttgcacagttttttataaagccattgatgtcttctgatgcaactctgagggaaataaaagctgttgactctgaaaatcagaaaaatctgttgtcagatccttggcgaatgagtcagctccagaagcatctttgctcaaataaccacccgtatcacaagttcagcactggaaattgggacaccttggaggttaagccaaaggagaaaggattggacacaaggcttgagcttatcagattctatgattcacattactcagccaacttgatgcagcttgttgtgtacggaaaagagagtctcgacaagattcaaacccttgtcgaaaataagttctttgatatcaagaacgttgaaaggaagccattttcatttcctggtcatccatgtgcaagcaaggatctccagattcttgttaaggcggttccaataaaacaaggtcacactttgaaaatactgtggccaatcactccaaacattcggcattacaaggaaggtccttgcaagtatgtgtcccatctaatcggccacgaaggagaagggtctctattttacattctaaaaaaactaggatgggctatgagtttgggatcaggggaaggggattcaaattatgagtttgctttcttcagtgttgttatacagctcacagatgtaggccacgagcacatggaggatattgttgggttgttattcagatacatagcattgcttcagacctctggaactccgaagtggatttttgatgagcttctagccatctgtgagacaggattccactaccgagacaagagccctcctatccattacgtagtcaatctttcctcaaacatgcagatttttccacctgaagactggttgattgcatcgtttgtaccatcaaagttttcgccagatgctattcagaaggtattagatgaattgactccagaaaatgttagaatattctgggaatcaaaaaaatttgaagggcaaacaaacttaatagagccatggtatggtacatcatactgtgttgaagcagtccctccttcaattatacagaaatggattgagaaagctcccaaggaagatttgcacctcccaaaacctaatatctttattccaactgatctttcactgaaaaatgtcgaggataaggcaaattttccatgtgtgctgaggaaaacaccattttccagattgtggtacaagcccgatacaatgttctccacacccaaggtctacattaagatggatttccattgtccactggctcatagctctcctgaatcatcagttcttactgatgtattcacaaggttgctgatggattatttgaatgaatatgcttatgatgctcaagttgctggtctttattatgttgttgggccaaatgacactggttttcaggtaactatggttggctataatgacaagatgagaacccttttggagaccgttataggcaaaattgcagagtttgaagttagggttgaccgcttttctgtggttaaggaaactatgacgaagcagtatgagaatttcaaatttctgcagccatatcagcaagccatggactactgtagattgatattggaggaccaaacttggccatgggatgaagaacttgctgtactttctaatcttggagctaacgatctagagattttttggcctcatatgctggcaaagacatttattgagtgctattttgcaggtaatattgaaccgggcgaagcaaaaggtgttatccagcatgttgaagacaccttatttaactcaccaatcggtgtctgcaaatcattactaccatcgcagcatcttacgaagcggattgttaagcttgaaaggggtttgaagtattattatccagtaatgggcttaaatcaccaggatgaaaattcttcccttctgcactatattcagattcaccaggatgatctcaaacaaaatgttctacttcagttgcttgcacttgttgctaagcaaccggcttttcaccagttacgttctgttgaacaacttggctacataacattgcttagacaaagaaatgattcaggagtccgtgggttgcaatttataattcaatcaactgcaaaggacccattcagtctagacgctagggttgaagctttcctcacgatgtttgaaggcactctataccaaatgcctgatgcagaattcatgagtaatgtcaatgctctcattgacatgaaactggaaaaatacaagaatataagggaggagtcagctttcttctggggggagatttctgagggaacactgaactttggtaggaaggaagcagaggttgctgcactaagggagctcaagaaggatgagctgatagaattcttcaataatcatgtcaaggtgaacgcaccagaaaagaagattcttagtgtacaagtctatggcggtcttcattcctcggagtacgaaaagatactgcatgatgctccaccaccacattcgcatcgaataactgatatattcagcttcaggaggtcgagacctttatatggttcattcaagggaggcgttagtcagatgaagctataggataacttagttgtatttatcaaaaacagaaaggctcatttttacatgtaatttgcattgttcctaaagatatttttagttttacatttcgctagggtgaattgcatactttaaaaatggcattcgtctggtgtaatcttccaactttctgtcaaattcatgataagcatgcctttttcattactaataattctaggcgtctgtataattccatgagcaactgcaagctt

SEQ ID NO: 2108 - DNA, 3091 bp, Setaria italica
acgcccccggcgacccggccaacggcgccgcccctccgccgccgacgggggacgtcgagatcaccaagccccgcaacgacaagcgcgggtaccgccgcgtggtgctccccaacgcgctcgagtgcctgctcatcagcgaccccgaaaccgacaaggcggcggcgtcgatgaatgtttctgtgggctacttctgcgatcccgatggtctggaggggctcgcgcacttcctcgagcatatgcttttctatgctagtgaaaaatatccagtagaagatagttactcaaagtacattgcagagcatggtggttcaaccaatgccttcacatcttcccttttattttgatgtgaacagtgatagcctgcatgatgctttagataggtttgcacaattttttatcaagccattgatgtctccagatgccacccttagggaaataaaagctgttgactctgaaaatcagaaaaaccttttatcagatccttggcgaatgagtcagcttcagaagcatctttgcgcagataatcacccttatcataagcactggttggcatctgaacaatgaaattgtcttgaagttaaagcaaaggagaaaggattggacacaaggcatgagcttattaaattctatgatgcacactactcagccaacttgatgcaacttgttgtgtatggaaaagatagtcttgataatttgcagaaccttgttgaaaataagttctgtgacattagagatgttgggaggaaaccattttcttttcctggtcatccatgtacaagtgaacatctccagattcttgtcaaagcagttcccataaaacaaggtcacactttgagaatcctgtggccaatcactcccaatgttcggcgttacaaagaaggcccttgcaagtatattagccatttaattggccatgaaggagaagggtctcttttttacatactgaaaaagttaggatgggctataagtttggaagctggcgaaggggattggagttatgattttgtgatgaagggcagggttaagcacatggagggactattgttcagatatataacacttctgcagacatctgggactccaaagtggatcttcgatgagattcatgtaataagttatccaaatgctcatttctttttgataacggtaaattatgttgacaatttaatggagctcttttgtctttttatcctattgcagatttttccaccagaagattggttgattgcatcatctgtgccatcaaaattttcaccagatgctattcagaatattttaaatgaattgactcctgagaatgtaagaatattctgggaatcgaaaaagttcgaagggcaaaccaacttaacagagccatggtatggtacatcgtattctgttgaagctatcccttcatccattatacagagatggatagagaaagcccctgaggaagatttacatctgccaaaacataacatcttcattccaagtgatctttcattaaaaagtgtagaggaaaagataagttttccttccatgctgaggaagacaccattctccagattgtggttcacaatgtttttcacacccaaagcttatatcaagatggattttcactgtccactgtcccaaagcttgcccgagtcagcagttcttactgatgtattcacaaggttgctaatggattatttgaatgactatgcttatgacgctcaagttgctggcctttattacgttgttaagccaaatgataccggttttcaggtaactatggtcggctacaatgacaaaatgaaaacccttttggagactgttattggcaagattgcacagtttgaagttaaggttgaccgtttttctgtgataaaggaagctatgacaaaggagtatgagaatttcaaatttcggcagccataccagcaagtcttatattattgttcgctgatactagatgaccaagcatggccatgggatgaggaattttctgcgctttctcaccttgaagctagtgatcttgagaaatttttgcctcatttgctagcaaagactagatggtccgcatcaacccgtcttattaattgcaaacccaatgaagcaaaaggtgtcatccagcatgttgaagatgtcttgttcaatgcacccattagcgtttgcaagccattatccccatcacagcatcttgcaaagagatgtaaagcttgaaaagggtttgagatactattatccagcaatgtgctcaaataaccaagatgaaaattctgctcttctgcactatattcaggcacgcctttgatacttgataatgtcaaacaaaacgttctacttcagctacttgctcttgttggcaagcagccagctttccatcaattgcgatcagttgagcaacttggctacatagcgctgcttaggcaaagaaatgattcaggtgtccgtgggttgcaatttataatccagtcaactgcgaaggatcctgccaatctggatgctagagttgaaaattttcttaagatgtttgaagacatcctttaccagatgtctgatgcagaattcaagagtaatgtcagcgctcttattgatatgaaactggagaaatacaaaaatctacgcgaggaatcagcgttcttctggggagagattgctgaaggaaccctcaaatttgatagaaaagaagcagaggttgctgcactgagggagctcaagaaggaagagttgatagacttcttcaatgaccatgtgaaagtcaatgcaccacaaaagaaggtacttagcatacaagtgtacggtggtctccatactgcagagtaccaaacgatagtgcaaaatgctccaccaccacagtcgtgtgagataactgatatatacagcttcaagaggtcaaggcctttgtatgggtcgttcaggggaggtgttggtcagatgaagttataggtcaaccttttgttttgcaaaaatctaaaatataatatttgtataacactatagctgctttgttcttagaagaatgtttttcacttggactaggttggatggcatgtattttgaccgtttatttgattaaggacacctgactaattatgcctcactctgctaagattttgtgagttttcgc

SEQ ID NO: 2109 - DNA, 3429 bp, Triticum aestivum
agcgagcctcgcccaagacttacctccccaacccccgtgcgagacttgccctcccctagcgccgacgacgactgggcggcgacgcgatggattcgaggctgcgagaggtggacgcccccgccgagccggccgacggcgccgctgcgctggccaccgcgaaggctgaggtggaagtcaccaagccccgcaacgacaggcgcgggtaccgccgcgtggtgctcccgaacgccctcgagtgcctcctcatcagcgaccccgacaccgacaaggcggcggcgtcgatgaatgtctcggtggggtacttctgcgatcccgacgggatggaggggctcgcgcacttcctcgagcatatgcttttctacgcgagtgaaaaatatccaatagaagacagttactcaaagtacatcgctgagcatggtggttcgacaaatgcctttacaacctctgaacacacaaacttctattttgatgtgaacaatgacagcctggatgatgctttagataggttcgcacaattttttataaagccattgatgtcccctgatgcaacccttagggaaataaaagctgttgactctgaaaaccagaaaaatatattgtcagatccatggcgaatgagtcagctccagaagcatctttgctcgaataaccacccatatcacaagttcagcactggaaattgggacacactggaggttaaaccaaaggagaaaggattggacacaagggctgagcttattaatttctatgattcacactactcagccaacttgatgcagcttgctgtgtatggaaaagagagtcttgacaacatccaaacccttgtcgaaagtaagttctgtgatatcaagaacgttgggaggaagcacttttcttttcctggtcatccatgttcaagcaaagatctccagatccttgttaaagcggttcctataaaacaaggtcatactttgcgaatactgtggccaatcactccaaatgttaggcattacaaggaaggtccttgtaggtatgtgagccatctaatcggtcatgaaggagaaggatctctcttttacatactaaaaaagttgggatgggctatgagtttggaagcaggggaaggggattggagttatgatttctctttcttcagtgtcgttatacagctcacagatgtaggccatgaacacatggaggatgtcgttgggttgctgttcagatacattacattgcttcagacctctggaactccaaagtggatttttgatgagcttctagccatctgcgagatgggattccactatcgagacaagagccctcctagcaattatgttgtcaatatttcctcaaacatgcagatttttccaccagaagattggctgatcgcgtcgtctgtaccatcaaagttttcaccagatgctattcagaaggtgctaaatgaattgactacagagaatgttagaatattctgggagtcaaaattatttgaagggcatacagacttaacagaaccttggtatggtacttcatattgtgttgaagcagtgcctccttccattatgcagaaatgggtagaaaatgctcccaacgaagatttacacctgccaaaacctaatatcttcattccaactgatctttcattgaaaaatgttgaggaaaagacaagttttccttgcatgctgaggaaaacactgttttccagattgtggtacaagcccgatacaatgttcttcacacccaaggtcttcatcaagatggatttccactgtcctctgtccaatagctcccctgaatcatcagttcatactgacatattcactaggttgctgatggattatttgaatgattatgcttatgatgctgaagttgctggtctttattatgctgttaggccgaacgacaccggttttcaggttactatggttggctataatgacaaaatgagaacccttctggacactgttattggcaaaattgcagactttgaagttaagattgaccgcttttctgtgataaaggaaactataacgaaggggtatgagaattttaaatttcagcagccatatcagcaagcaatgtacaattgcacattgatattggaggagcaaacttggccttgggatgaagaacttgctgcactttctaatcttgaagctcgcaatttagaggatttcttgcctcgtatgctggcaaagacatttatagagtgttattttgcagggaatattgaaccaagcgaagcggaaagtgttgtccagcatattgaaggcatattgtttaattcatccacaagtgtttgcaaatcattaccaccgtcccagcatcttacaaagcgaattgttaagcttgaaaggggtttgaggtattattatccagcaatgtgcttgaatcagcaggatgaaaattcttctcttctgcattatattcagattcatcaggatgatctcaaacaaaatgtcctacttcagttgcttgctgttgtagctaagcaaccggcttttcaccaattacgttcggtcgagcaacttggttacatagcactgcttagacagagaaatgattcaggagtccgtgggttgcaatttataatccagtcaaccgtgaaggatccatccaatctggatgccagggttgaagctttcctgaagatgtttgaagtcacactacacgaaatgcctgatgcagaattcaagagtaatgtcaatgctctcattgacatgaaacgggagaaatacaagaacataagggaggaatcagcattcttttggggggagatttctcaaggaacactgaaatttgatagaaaggaaacagagattgctgcactggaggagcttaagaaggaagagctgatagagttcttcgataatcatgtcaaggttggcgcaccagaaaagaagatccttagcatacaaatctatggtggtctccattcctccgagtacgaaaagattattcatgatgccccgccaccacattcgcatcgaataactgatatattcagcttcaggaggtcgagacctttatatggttcattcaaaggtggtgctggtcagatgaagctataggacaacttcgtttcgggtcatatttacatgtcacttgaattgttcctactatagaaaataatgtgtgggacaaatgttcgcacttttggctaggctgaatatattccataccgaatctgtcatatcagtttgaaattttacatgtaattcttttttatactgattatcagacctgaaagtgtttgactggcatacattctacacctgtttatatcatgaatcagagcatgtagttagcaacccgctgagcacaagtcagaagtagagtctgctattggttactatgcttttttttctgaacttatttggttatttaaaggtcacccagccacaccaaatatagttgcatatattatgtaaatgcagcgattgccatcgc

SEQ ID NO: 2110 - DNA, 1121 bp, Zea mays
cagaatagtcgacaaagcatggtgcacccatcaatcatcacacagagcgcgcgccatggcgtacagggcgttggaggtgactctcctgtcggccaaggacctgaagagggtgaacctgatctcgcgcatggaggtatacgccgtggtgagcatctccggcgaccctctgacgcggcagtgcacccagccggacccctacggcgggcgccacccgtcctggaacacctcgttccggttcaacgtcccgcccaccgccgcgacggccaccggctgcctccacgtgctcctgcgcaccgagcgcgccctgggcgaccgcgacgtcggcgaggtcatcgtgcccctggctgacatcctcgccaccgctggcggcgcgtccgaccctggcccccggcctccgcagctcgcatcgtaccaggtccgcaaggtgcaccgttgcgagcctcgcggcgtgctcaacgtgtcgtaccgcctgggccccatcgtcggccagcaggcggcgcctctggcgagagccgacgaggccgctgccgccttcgtcggctacccagtagtgccgcggcagtactaccccgcgccgtacgcctacctgccctcgccgctgtccctggcgcccgggccctctcctcccgcgcaagctgccggcggacgcgacaccctggccctgcacccgccttcgccgtacagcttgcctgctgctacttacccgccggctgcttctgcttatccgcagcaggcggctgccggtcccgggcgcaatgctctgccggcaccggcgagcgaggagagcaacggaaagctggacttcggggtaggcctcggcgcggggctggtcagcggcgcgatcggcgggatgctggtcgccagcgacgtgatgatgtctgacgcggcggcttacaactccgggtaccgcgctggactggccgacggcggcgcggcagcggtgtacaggagctcttatcgcgttcccgataaggtcgaagcaaaacgggcggcagtgtgagtcacttgaatcgatgcaaactgtgtgatttgacaaaccaagaatagtacctgccgtatatatatggaatataattgcgtatctattgaataataaataataatgagatgagattttacat

SEQ ID NO: 2111 - DNA, 1083 bp, Zea mays
cacacagagcgcgcgccatggcgtacagggcgttggaggtgactctcctgtcggccaaggacctgaagagggtgaacctgatctcgcgcatggaggtatacgccgtggtgagcatctccggcgaccctctgacgcggcagtgcacccagccggacccctacggcgggcgccacccgtcctggaacacctcgttccggttcaacgtcccgcccaccgccgcgacggccaccggctgcctccacgtgctcctgcgcaccgagcgcgccctgggcgaccgcgacgtcggcgaggtcatcgtgcccctggctgacatcctcgccaccgctggcggcgcgtccgaccctggcccccggcctccgcagctcgcatcgtaccaggtccgcaaggtgcaccgttgcgagcctcgcggcgtgctcaacgtgtcgtaccgcctgggccccatcgtcggccagcaggcggcgcctctggcgagagccgacgaggccgctgccgccttcgtcggctacccagtagtgccgcggcagtactaccccgcgccgtacgcctacctgccctcgccgctgtccctggcgcccgggccctctcctcccgcgcaagctgccggcggacgcgacaccctggccctgcacccgccttcgccgtacagcttgcctgctgctacttacccgccggctgcttctgcttatccgcagcaggcggctgccggtcccgggcgcaatgctctgccggcaccggcgagcgaggagagcaacggaaagctggacttcggggtaggcctcggcgcggggctggtcagcggcgcgatcggcgggatgctggtcgccagcgacgtgatgatgtctgacgcggcggcttacaactccgggtaccgcgctggactggccgacggcggcgcggcagcggtgtacaggagctcttatcgcgttcccgataaggtcgaagcaaaacgggcggcagtgtgagtcacttgaatcgatgcaaactgtgtgatttgacaaaccaagaatagtacctgccgtatatatatggaatataattgcgtatctattgaataataaataataatgagatgagattttacat

SEQ ID NO: 2112 - DNA, 1032 bp, Saccharum officinarum
  misc_feature (210)..(210): n is a, c, g, or t
  misc_feature (247)..(247): n is a, c, g, or t
  misc_feature (388)..(388): n is a, c, g, or t
ggaaatcgcagcacgcccccgactggggatgacgcgcgcccgccgccaatggccgcaccgccgcagacgatagcgctcgcggggctcatcctcctcaactgtgtcctcgccgtggcagcgctctgccttcacgtcctcggccgccgcaggccccggcagcaagtcccgccgccgccgctcgaggcggccgccgcgggggaggcggaggangaggaaggcggcggcgaggagaggccgcagaaccagnggcggaggaggagagcgcggaggaagcggcagcagcaggagcaggaggaggagggggcggcggcggcggagggtggtggccacgtcgcggacggggaccgggacgccgccgcgaaggcggcgctgctcccccgccggcctnagttcccgctcgcctccgtggctggcccgctgcagcggcggatcaacgcgcggtacgacgacctcgcgcgggccagcgaggcgcagtgcctcaccatcgaacaggttaatgagtttgttaactgtctcatagatgctagaaacgagttgctgcagaggtacgagaatgtacaaagaagcttcaaaataaagaaggcaatgctatccaaccatcgaaactataggtcttcatacgaacgcctctttgaacaggtacgtagattggaaaccgagcgtgataatctaaagaaagatgccgccatctacaactatattcaggagcgtcttcagaagtcagcagcatacaaaatgatcatggagctcagtgctatggagatggaggcccaagagatatcattcgaggagctgctggctaaggagaaggaggataccgtcttctggcagcgcaacgggaagctgagatcattctcgtccaagtagaacacaatgcccccacctgggctcactgacgatagcagatctcaacatgggtagtctaaacgcgaaatcctagcctgctccttgagagcagctgctgtatgcctgcatcgaaacgtttggtgtaacgccgcgatcgtctaataagatgttgggcccctgtcactt

SEQ ID NO: 2113 - DNA, 860 bp, Triticum aestivum
  misc_feature (848)..(848): n is a, c, g, or t
cgagggtgaggccagctgagggcagagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggcacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttcatgtaacgtgctcggcgtatgtaccaccatgcatgcagtgttgtataccagtcgtatatacagtacaagccgagtataatacagtactgctatgtgcatcattaccntgaaattgctac

SEQ ID NO: 2114 - DNA, 844 bp, Triticum aestivum
cgagggtgaggccagctgagggcagagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggcacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttcatgtaacgtgctcggcgtatgtaccaccatgcatgcagtgttgtataccagtcgtatatacagtacaagccgagtataatacagtactgctatgtgcatcatt

SEQ ID NO: 2115 - DNA, 817 bp, Saccharum officinarum
agcacgtaccggtacttcgaggtatagcgcgcgcatccgatccatcactcgcatatatatagctagagcgtaactcgatcgttcaccgatcgtgcacgagagcaacatgggcggagggcacgacatgcacggccacaacggcggcgtgaagggctacgtgtccaacctcgtccacggcggcggcggcggcgggggccatgggcacggctacggcggccacgggcatggaaacggccacgggcagggctacgcccacgggtaccctcctccggccgcggccggcgcgtaccctcctccgcacggcggctacccgcccgccgcctaccccgcgcactcagcgcactacgggcatatggggtcgtaccacagcagccacagccatggcggcggccaccacggcagctacggcggcaagcacaagggcggcatgttcggcggcggcaagttcaggaagtggaagtgaatgaagcgatcaatcgaaacaacacgacactcgcgctacctacctctactacggttctacgtacgtatctgccagccggcagccgcgtacgtatcctgccagccgtagctaaacatgcactgcacacacttcctataattaaataaagtgcgagcaggcaggatgcgtacgtgtacgttcaatcgaacgagtgctgctgtgaccgtgtgacgtagttgttatttgtatacggaataaagtgagacgtgtgtgtccgtctagtaactaaaataatggtcatgttcatgtaacgtgctcggcgtatgtaccaccagcagcactgtataccagtcgtatatacaagccgagtgtaat

SEQ ID NO: 2116 - DNA, 803 bp, Saccharum officinarum
agcacgtaccggtacttcgaggtatagcgcgcgcatccgatccatcactcgcatatatatagctagagcgtaactcgatcgttcaccgatcgtgcacgagagcaacatgggcggagggcacgacatgcacggccacaacggcggcgtgaagggctacgtgtccaacctcgtccacggcggcggcggcggcggcgggggccatgggcacggctacggcggccatgggcatggaaacggccacgggcagggctacgcccacgggtaccctcctccggccgcggccggcgcgtaccctcctccgcacggcggctacccgcccgccgcctaccccgcgcactcagcgcactacgggcatatggggtcgtaccacagcagccacagccatggcggcggccaccacggcagctacggcggcaagcacaagggcggcatgttcggcggcggcaagttcaggaagtggaagtgaatgaagcgatcaatcgaaacaacacgacactcgcgctacctacctctactacggttctacgtacgtatcctgccagccgtagctaaacatgcactgcacacacttcctataattaaataaagtgcgagcaggcaggatgcgtacgtgtacgttcaatcgaacgagtgctgctgtgaccgtgtgacgtagttgttatttgtatacggaataaagtgagacgtgtgtgtccgtctagtaactaaaataatggtcatgttcatgtaacgtgctcggcgtatgtaccaccagcagcactgtataccagtcgtatatacaagccgagtgtaatacagtacta

SEQ ID NO: 2117 - DNA, 849 bp, Saccharum officinarum
gtacttcgaggtatagcgcgcgcatccgatccatcactcgcatatatagccagagcgtaactcgatcgttcacctgatcgtgcacgagagcaacatgggcggagggcacgacatgcacggccacaacggcggcgtgaagggctacgtgtccaacctcgtccacggcggcggcggcggcggcggcggcggcagccatgggcacggctacggcggccatgggcatggatacggccacgggcagggctacacccacgggtaccctcctccggccgccgccggcgcgtaccctcctccgcacggcggctacccgcccgccgcctaccccgcgcactcggcgcactgcgggcacacggggtcgtaccacagcagccacagccatggcggcggccaccacggcagctacggcggcaagcacaagggcggcatgttcggcggcggcaagttcaggaagtggaagtgaatgaagcgatccaaacaaacaacactctcgcgctacctacctctactacggctctacgtacgtatctgccagccggcagccgcgtacgtatcctgccagccgtagctaaacaacatgcactgcacacacttcttataataattaaataaagtgcaagcaggcaggacgcggcgtacttgtacgttcaatacgagtgctgttgtgaccgtgtgacgtactgtagccgttgtttgtatacggaataaagtgagacgtgtgtgtgtgtcagtcgagtaactaaaataatggtcatgttcatgtaacatgctcggcgtatgtatcaccatgcagtattgtataccagtcgtatatacaaaggcgagtgtaatacagtactatgtgtatttatt

SEQ ID NO: 2118 - DNA, 852 bp, Saccharum officinarum
cacgtaccggtacttcgaggtatagcgcgcgcatccgatccatcactcgcatatatatagccagagcgtaactcgatcgttcacctgatcgtgcacgagagcaacatgggcggagggcacgacatgcacggccacaacggcggcgtgaagggctacgtgtccaacctcgtccacggcggcggcggcggccatgggcacggctacggcggccatgggcatggaaacggccacggccacgggcagggctacacccacgggtaccctcctccggccgcggccggcgcgtaccctcctccgcacggcggctacccgcccgccgcctaccccgcgcactcagcgcactacgggcatatggggtcgtaccacagcagccacagccatggcggcggccaccacggcagctacggcggcaagcacaagggcggcatgttcggcggcggcaagttcaggaagtggaagtgaatgaagcgatcaatcgaaacaattaacacgacactcgcgctacttacctctacggctctacgtacgtacgtatctgccagccgcgtacgtacgtatcctgccagccgtagctaaacatgcactgcacacacttcctataattaaataaagtgcgagaaggcaggacgcggcgtacgtgtacgttcaatacgagtgctgctgtgaccgtgtgacgtactgtagccgttatttgtatacggaataaagtgagacgtgtgcgtgtgtgtcagtcgagtaactaaaataatggtcatgttcatgtaacgtgctcggcgtatgtaccaccatacagtattgtataccagtcgtatatacaaagccgagtgtaatacagtactatgtgtatttatt

SEQ ID NO: 2119 - DNA, 852 bp, Saccharum officinarum
cacgtaccggtacttcgaggtatagcgcgcgcatccgatccatcactcgcatatatatagccagagcgtaactcgatcgttcacctgatcgtgcacgagagcaacatgggcggagggcacgacatgcacggccacaacggcggcgtgaagggctacgtgtccaacctcgtccacggcggcggcggcggccatgggcacggctacggcggccatgggcatggaaacggccacggccacgggcagggctacacccacgggtaccctcctccggccgcggccggcgcgtaccctcctccgcacggcggctacccgcccgccgcctaccccgcgcactcagcgcactacgggcatatggggtcgtaccacagcagccacagccatggcggcggccaccacggcagctacggcggcaagcacaagggcggcatgttcggcggcggcaagttcaggaagtggaagtgaatgaagcgatcaatcgaaacaattaacacgacactcgcgctacttacctctacggctctacgtacgtacgtatctgccagccgcgtacgtacgtatcctgccagccgtagctaaacatgcactgcacacacttcctataattaaataaagtgcgagaaggcaggacgcggcgtacgtgtacgttcaatacgagtgctgctgtgaccgtgtgacgtactgtagccgttatttgtatacggaataaagtgagacgtgtgcgtgtgtgtcagtcgagtaactaaaataatggtcatgttcatgtaacgtgctcggcgtatgtaccaccatacagtattaccagtcgtatatacaaagccgagtgtaatacagtactatgtgtatttattattg

SEQ ID NO: 2120 - DNA, 634 bp, Saccharum officinarum
gtacttcgaggtatagcgcgcgcatccgatccatcactcgcatatatagccagagcgtaactcgatcgttcacctgatcgtgcacgagagcaacatgggcggagggcacgacatgcacggccacaacggcggcgtgaagggctacgtgtccaacctcgtccacggcggcggcgggggcggcggcggcggcagccatgggcacggctacggcggccatgggcatggaaacggccacgggcagggctacgcccacgggtaccctcctccggccgcggccggcgcgtaccctcctccgcacggcggctaccccgcgccgcctaccccgcgcactcagcgcactacgggcatatggggtcgtaccacagcagccacagccatggcggcggccaccacggcagctacggcggcaagcacaagggcggcatgttcggcggcggcaagttcaggaagtggaagtgaatgaagcgatccaaacaaacaacactctcgcgctacctacctctactacgactctacgtacgtatctgccagccggcagccgcgtacgtatcctgccagccgtagctaaacatgcactgcacacacttcctatgattaaataaagtgcgagcaggcaggacgcgtacgtgtacgt

SEQ ID NO: 2121 - DNA, 2092 bp, Setaria italica
ggaggcccggttgcagaaagaggaagaaaacttcatctgcacctcgtgctgatgtgcattaggggatctgcgctagtaatatacagctaaacctcgcgagcttgactgaatcgactctctgagcctgacagcaccatgggttccggcgatttgagctcggacatgaagaggacggttcttggcctcacgctctgggtctggattgccatcggcgtcgtcgcccttctcgtggccatcctgctgatgatctgcatttgggtggcgtcacgccggaggacgaagagaaccatggacagcctgaggcagacgcagatccccatctactccaaggagatccccgtcgaccgtgttgccggccgcagccttgcccagacaatgcacgagcgcgagcagtcgagtttcccgccgccggacaagtacgcgaaccgggagccggccggggcgacgctgggccacctagcgctcagcaagtcctcagatcacgataacatgagccaggggagctcggtttgcaatgtggaccgtgccgccagtgtgcactccggtgaggatgggagctcggggccacggaggaagcccaattcgcctgcggcgtttgtgtccgcgtcgcctctggtcggccttcctgaattctctcatcttggctggggtcactggtttactcagcgtgaccttgagcttgctaccaaccgtttctccaaggagaatgtgcttggagaaggtggctatggagttgtgtaccgtgggcgtctggtgaacggaactgaagttgccatcaagaagatctttaacaacatggggcaggcagagaaggaattcagagtggaggttgaggctattggtcatgtccgacataagaatttagttcggctattgggatactgcgttgagggtgtaaacaggatgctggtgtatgagtttgtgaacaatggtaacttagagcagtggcttcatggagctatgtgtcagcggggtgtttttagctgggaaaatcgcatgaaggttgtaacaggcactgcaaaagcgcttgcttaccttcatgaagccatagaaccaaaagttgtacaccgagatattaaatcaagcaatatattgattgatgatgaattcaatggcaaggtctccgactttggattggctaagcttttgggttcagataaaagccacattactactagagtgatgggaacgtttggatatgttgcaccagaatatgctaatactgggatgttaaatgaaaagagcgatgtctacagcttcggtgttctcttgctggagactgtgacaggaaggggtcctgttgactatagtcgatcttccaatgaggtcaatcttgttgaatggctcaaaacgatggtggccaatcgaagggcagaggaagtggctgatccaagcttagaagttagaccatctattaggtctctgaagcgagctcttttagtggcactaaggtgtgttgatcctgactctgaaaagagacccaagatgggacaggttgtcaggatgcttgagtctgaagaagttccgtaccgggaggaccggagaaaccggaggagtcgcactggaagcatggatattgagtctattgcagagggttcgaactctgccgagtttggaaagaaggtagagaggactggcagcgcgacatcagaccgatctcagccttgaggcctgcaaatacatgctatatcatgaacagtctgagaaatgatgttgatcaccaaggtgattgctgccctgatagggtatgttggtaggtggtggaggcagggcaatccctgatgttactacctgaatcttaggtctactagtatcaggtggagtagaagcattcttggatgaagaatctcctggtctcctgttctctgtataggttatatgttggtgcctagggaattcccttggttgggtgttttaacaattggtcggttcttttggttcttgcattgttaccttctcaaatctggttcacttctccctgcttctgcagtgctgcacatgaggttgtgctgttagtgttgctggcttgctacttgtcaatgtttctctgatttgactgtagccacaagttttgtttggcaacgcatgttga

SEQ ID NO: 2122 - DNA, 2185 bp, Zea mays
ctcccgcagtctccgacctctctctctcctctctctttctttttctctctctccctcgctttttctgctgtctatccccgcgccgcgcgaggttgctgccttggccttgctggttctttgcttgtgggatgagtggaaggaaggccggtcctcgctgcagaaagagggagaagacttcatctgcacgtgctgctgatgtgcattagaggatccgtgctgataatatacagctgacacccacaagatcgactggataagttcgagcctgacggcatcatgggttccggcgatttgagctcggagatggagaggacggttcttggcctgacgctgtgggtctggattgccatcggcgtggtcgcgcttctcgtggcaatcctgctgatgatctgcatttgggtggcgtcccgcctgaggaccaagagaaccatggacagcctgaggcagacgcagatccccatctactccaaggagatccccatcgaccgggtcggcgggcgcagcctggcacagacaatgcatgagcgcgagcagccgagcttgccgccgccggacaagtacgcgaaccgggagccggccggggcggctgtggggcacctggcactcagcaagtcctcggatcatgacaacatgagccaggggagctcggtttgcaatgctgaccgtgctggcactggcagcatgcactccggtgaggatgggagctcaggacctcggaggaaacccaactctcctgcggcgttcgtgtcagcttcgcccttggttggccttccggagttctcgcatcttggttggggtcactggtttactcagcgtgaccttgaacttgctaccaaccgcttctctaaggagaatgtgctcggggagggtggttatggagttgtgtaccgtggacgtctggtgaatggaactgaagtcgcaataaaaaagatctttaacaacatggggcaggcagaaaaagaattcagagtggaagttgaggctattggccatgtccgacataagaatttggttcggctgttgggatattgtgttgagggcgtaaacaggatgctagtatatgagttcgtgaacaatggtaatttagagcagtggcttcatggagctatgcatcagcgtggtgtttttagctgggaaaatcgcatgaaggttgtaacaggcactgcaaaagcgcttgcttaccttcatgaagctattgagccaaaagttgtacatcgagatataaaatcaagcaacatattgattgatgatgaatttaatggcaaagtatctgactttggattggctaaacttttgggatcagacaaaagccacattactactagagtgatgggaacatttggatatgttgcacctgaatatgctaatactggaatgttaaatgaaaagagtgacgtttacagttttggcgttctcttgttagaaactgtgacaggaaggaatcctgttgactacagccgatcttccaatgaggtcaatcttgttgaatggcttaaaacaatggtggccaatcggagggcagaggaagtggctgatccaagcttagaggctagacccagtatccgggctctcaagcgggctcttttggtggcactgaggtgtgttgatcctgactctgaaaagagacctaagatgggccaggttgttaggatgcttgagtcagaagaagtaccataccgggaggatcggagaaatcgtagaagtcgcactggaagcatggatattgagtccattgcagagggttccaactctgcggagtttggaaagaaggtagaaaggactggaagctctatatctgacagatctcaaccatgaggcctggaaatctaagctatatcaggaactgtctcagaaacgatgttaatcaccaaggtgattgctgtcctgataggggatgctggtaggtgacagaggcaaggcaggcccaggtattactgcctaagtattaggctttagttttcaggtgcagtagaagcattcttggatgaggaacctcctggtctcctcttatttgtataggtatatgttggtgcctgaggaattcctcttggtttgggtgtttaacatttgttcggttcttttatttcttgcattgttgccttcttaaatcagtttcacttctccctgatgaaatgctgaacatgaggttgtggacttgtggtcttagcgatactgcttgtcattg

SEQ ID NO: 2123 - DNA, 2187 bp, Zea mays
cgcagtctccgacctctctctctcctctctctttctttttctctctctccctcgctttttctgctgtctatccccgcgccgcgcgaggttgctgccttggccttgctggttctttgcttgtgggatgagtggaaggaaggccggtcctcgctgcagaaagagggagaagacttcatctgcacgtgctgctgatgtgcattagaggatccgtgctgataatatacagctgacacccacaagatcgactggataagttcgagcctgacggcatcatgggttccggcgatttgagctcggagatggagaggacggttcttggcctgacgctgtgggtctggattgccatcggcgtggtcgcgcttctcgtggcaatcctgctgatgatctgcatttgggtggcgtcccgcctgaggaccaagagaaccatggacagcctgaggcagacgcagatccccatctactccaaggagatccccatcgaccgggtcggcgggcgcagcctggcacagacaatgcatgagcgcgagcagccgagcttgccgccgccggacaagtacgcgaaccgggagccggccggggcggctgtggggcacctggcactcagcaagtcctcggatcatgacaacatgagccaggggagctcggtttgcaatgctgaccgtgctggcactggcagcatgcactccggtgaggatgggagctcaggacctcggaggaaacccaactctcctgcggcgttcgtgtcagcttcgcccttggttggccttccggagttctcgcatcttggttggggtcactggtttactcagcgtgaccttgaacttgctaccaaccgcttctctaaggagaatgtgctcggggagggtggttatggagttgtgtaccgtggacgtctggtgaatggaactgaagtcgcaataaaaaagatctttaacaacatggggcaggcagaaaaagaattcagagtggaagttgaggctattggccatgtccgacataagaatttggttcggctgttgggatattgtgttgagggcgtaaacaggatgctagtatatgagttcgtgaacaatggtaatttagagcagtggcttcatggagctatgcatcagcgtggtgtttttagctgggaaaatcgcatgaaggttgtaacaggcactgcaaaagcgcttgcttaccttcatgaagctattgagccaaaagttgtacatcgagatataaaatcaagcaacatattgattgatgatgaatttaatggcaaagtatctgactttggattggctaaacttttgggatcagacaaaagccacattactactagagtgatgggaacatttggatatgttgcacctgaatatgctaatactggaatgttaaatgaaaagagtgacgtttacagttttggcgttctcttgttagaaactgtgacaggaaggaatcctgttgactacagccgatcttccaatgaggtcaatcttgttgaatggcttaaaacaatggtggccaatcggagggcagaggaagtggctgatccaagcttagaggctagacccagtatccgggctctcaagcgggctcttttggtggcactgaggtgtgttgatcctgactctgaaaagagacctaagatgggccaggttgttaggatgcttgagtcagaagaagtaccataccgggaggatcggagaaatcgtagaagtcgcactggaagcatggatattgagtccattgcagagggttccaactctgcggagtttggaaagaaggtagaaaggactggaagctctatatctgacagatctcaaccatgaggcctggaaatctaagctatatcaggaactgtctcagaaacgatgttaatcaccaaggtgattgctgtcctgataggggatgctggtaggtgacagaggcaaggcaggcccaggtattactgcctaagtattaggctttagttttcaggtgcagtagaagcattcttggatgaggaacctcctggtctcctcttatttgtataggtatatgttggtgcctgaggaattcctcttggtttgggtgtttaacatttgttcggttcttttatttcttgcattgttgccttcttaaatcagtttcacttctccctgatgaaatgctgaacatgaggttgtggacttgtggtcttagcgatactgcttgtcattgtttttc

SEQ ID NO: 2124 - DNA, 2608 bp, Oryza sativa
gattaaacaaacagaggatttcggtgaggattgagggggagtggtggccgcactctcccaggctcagatcagccagcctgaatccatgcttattcggtcatgcttatgcatgcagttattctattctgtcagttgaccttatcctgcagaccagcgaaattgttttcccttccctctcttcccctgcagctgcagcagcagcagcagcacagcgccacagccattttcaccgctgcatccaacaatctaccggaccatttctttctttaattgccagcccaccatctctccttcacttctccctgatccagcctttaatgctagacctgcaacatccaccaccttcccttttactctctctctctctctctctctctccgtcttgggcgttacttccatcgccattgctggcacaggttctttgcttgagggatgagcagatggaggtcctattgccaaaagtgggagaagagtgcatccacacttgctgaggccaactaggggatccccattgatgcagtccaactgaaatttcccaatctacacaagaattgagcacggggccactatgggttccagtgatttgagttcagagatgaggaggacggttcttggcctaacattgtgggtctggattgcaattggtgtggtcgctcttctagttgccattctgctgatgatatgcatttggatggcatcccgccgcaagacgaagagaacaatggacaatttgaggcaaacacagatccccattttctccaaggagatcccggttgacagggttggcggccgcagccttgcgcagacaatgcatgaacgtgagcagcctagcttcccaccgcaagacaagcacacaaaccgggagccggggaagacgctggggcatatggcactgagcaagtcatcggaacctgacaacatgagccaggggagctcagtttgcaatgttgaccgtgctggtagtgtgcattccggtgaagatggtagcacagggcatggtaggaaaccgtattctcctgcagcatttgtgtcagcgtcgccgctggttggcctcccggagttctctcatctcggctggggccattggtttactttgcgtgaccttgagcttgctaccaaccgtttctctagggagaatgtgcttggagagggtggatatggagttgtgtatcgtggccgtctagtgaatggaactgaagttgctatcaaaaagatctttaacaatatggggcaggcagaaaaggagttcagagtggaggtcgaggctattggccatgtccggcataagaatttggttcggctgttgggttactgtgttgagggagtgaataggatgttggtgtatgaatttgtgaataacggtaacttggagcagtggcttcatggagctatgcgccagcatggtgtttttagctgggaaaatcgtatgaaggttgttatcggcactgcaaaagcactagcttaccttcatgaagctatagaaccaaaagttgtgcaccgagatataaaatcaagcaatatcttgattgatgaggaatttaatggcaaggtctctgactttggattggccaagcttttggggtctgataaaagccacattactactagagtgatgggaacatttggatatgttgcacctgagtatgctaacacgggcatgttgaatgaaaagagcgatgtttatagttttggtgttctcttgttggaaactgtgacaggaagggaacctgttgattacagccgctctggcaatgaggtcaatcttgtcgagtggctcaaaataatggtggcaaaccggagagcagaagaagtggttgatccaatcctagaggttagaccaactgttagagctattaagcgggctcttttggttgcgttacggtgtgttgatcctgactctgaaaagagacctaagatgggccaagttgttaggatgcttgagtctgaagaagttccataccgggaggatcggaggaaccgaaggagtcgcacaggaagcatggatatcgagtcgattgcagagggctcaaattcaaccgaatttgcaaacaaggtagaaagaactggaagctcgacatcagacaggtctcagtcctgagttcataaacctacgatccatcctgagtactcatcatcatcatcattgatcagcctgggatatgatgttattgatcaccaatgtggttaccgttctgatagggagatgattggtaggtaaaacctagccattaggtcgagtagtagcattattggagggaaggatttcatggttcttttgttgttcaaagttttttgtgctgtataggtatatgttggttctttggatgaccattcttgtgatccacgaagctcgttgggtgtatgcatgacacggatcattcattgggtttatgtgctgttaagctttcagttttcacttgctcctctgtttgcagacttgcagtgttgtgcatgagggaatggtgttatcatcagtttctctccccttgtattggtagaatcagctacacggttcatttgaccaggccatgtcagtttgactgagtttggtcgagagtatgatgtttctcatgatgctttaagccaaatgacaacactgaatttcacg

SEQ ID NO: 2125 - DNA, 2248 bp, Brachypodium distachyon
tcctcgctcccatttcaccattttcacatagtaggaacgagaatctaccacaccattttctttaattgctttctccacccgtttctccttgccttcttcctgatccagcctttaatgccatacctgcaacatccactaccttacccccttttactcccatctctctctctccccccttctctctctggtgtttccctttcgccattggtgccacaggtcctttgcttgtgcttgagggatgagtagatggaggtcttcttgcagaaatagggagaagagttcagttaccgatgcctagtaggggatctacttcgacacagcagagctgaatttcgcaagatactgtagaatttagcacgtcgccactatgggttcaaccgatctgaattcagagatgacgaggacggttcttgggctcacattgtggatttggattgcaattggcgtagttgctcttcttgtggccattctgttgatgatatgtatctgggtggcgtcccgtcgcaggacaaagagaacaattgacaacatgacccagacacagatccccatctactccaaggagatcccggtcgacagggttggcggcggtcgcagccttgcacagacgatgcatgaacgtgagcagcctagcttcccgccgcaagacaagcacgcaaaccgggagccgggtaagacgccggggcatatggcattgagcaagtcgtcagatcatgataacatgagccagggaagctcggtttgtaatgtggaccgtggtggcagcgtgcattctggtgaagatggcagctcagggcagcatggtagaaagccatattctcctgcagcgtttgtgtcagcgtcacctctggttggccttcccgaattctctcatctcggttggggacattggttcactctccgtgaccttgaatttgccaccaaccgtttctcaaaggagaatgtgcttggagagggtggttatggggtcgtgtatcgcgggcgtctagtgaatggaactgacgttgccatcaagaagatctttaacaacatgggtcaggcagagaaggaattcagagtggaggttgaggccattggccatgtccgacataagaatctagttcgtctgttgggatattgcgtcgagggagtgaacaggatgctggtttatgagtttgtgaacaatggtaacttggagcagtggcttcatggagctatgcgtcagcatggtgtttttagctgggaaaatcgtatgaaggttgttataggcactgcaaaagcacttgcttaccttcatgaagcaatagaaccaaaagttgtccatcgtgatattaaatcaagcaacatcttgattgatgatgaatttaacggcaaggtctctgacttcggattggccaagatgttggggtcagataaaagccacattactactagagtgatgggaacatttggatacgttgcacctgaatacgctaatacggggatgttaaatgaaaagagtgatgtttatagttttggtgttctcttgttggaaactgtgactggaagagaccctgttgattatagccgctctgccaatgaggtcaatcttgttgagtggctcaaaatgatgatagccaaccggagagcagaagaagtggttgatccaatcctagaggttaggccaactattagggctcttaagcgagctctgttaatcgcactaaggtgtgttgatcctgactctgaaaagagacctaagatgggtcaggttgctaggatgctcgagtctgaagaagttccatatcgagaggatcggcgaaaccggaggagtcgcacaggaagcatggacatcgagtctattacggagggatcgaattctgctgaatttgcaaacaaggtagaacggactggcagctcaagatcagaccggtctcagtcatgactgagcctgatgtttacaaatgcatcttacaccgtgagcactcctgttcattgatcattctgagaaatgatgctattcaccgaggtggttactgaaccctagtaggaaatattagtaggttaaggaaggcacgcccagattttactagctaagatttaggccgagctattaggtcgagcagaagcattcttggaggaagaatttcctggtctttggtcatttttttgtgtgtgctgtataggtatgtgttggtgcctgggatgatcatacttatgatccatgatgttccttcagtttgtggaagtggaccgttcttgatttccttttggttctttgattgctgct

SEQ ID NO: 2126 - DNA, 2731 bp, Hordeum vulgare
cctgaatccatgaaccctctttctgcgccatgctaatacatgcagttattatattctgccagttgaccttatcctgcagaccagcacattgcctcccctccacctctctctctctctctctgctcttcttccatctcctctcgcccgttttcaccagtctaccacgccatttctttaatcgcctccctcacccgtttctgcttcgcgtcttcctcatccagcctttaattgtcacacctgcaacatccaccaccttccaatcctccccccttttactccctctcacctctctctctctctctctcttggattcccccttcgccattgctgccacaggctggctggattcttctgaagctttgctacgcgcggttctttgcttgacgaatgagtggatggagcttctgctgcacaaagagggagaagaattcgtccacagttgctgatgcctagcagtgccaaaatttagcacactgccggctgccgccatggtttccaccggtctgagttcagagatgacgaggaaggttcttggccttacattgtgggtctggattgcaatcggtgtggtcgctctcctagtggccattctgctgatgatatgtatctgggcggcgtcccgtcgcaagacaaagagaaccatggagaacttgagccagacgcagatccccatctactccaaggagatcccggtggacagggtgggcggtgggcgcagccttgcgcagacgatgcatgaacgtgagcagcctagcctcccaacgcaggacaagcacgccgcgaatcgggagccggggaaggcagcggggcatatggcattgagcaagtcctcggatcacgataacgtgagccagggaagctccgtgtgcaatgtggaccgggttggcagcgtgcattccggtgaagatgccggctcggggaagggcaggaaaccgtattctcctgcggcgttcgtgtccgcgtcgcccctggttggccttcctgggttctctcatctcggttggggtcactggttcactctgcgcgaccttgaattcgccaccagccgcttctcaaaggagaatgtgcttggagagggtggttacggagttgtgtaccgtggccgtctggtgaatggaactgaggtggccataaagaagatttttaacaacatggggcaggcggagaaggaattcagagtggaggttgaggctattggccatgtacggcacaagaatctggtccgtctgctgggatactgtgttgagggggtgaataggatgttggtttatgagtttgtgaacaatggtaacctagagcagtggcttcatggagctatgcgccagcatggtgtttttacctgggataatcgcatgaaagttgttataggcactgcaaaagcacttgcttaccttcatgaagctatagaaccaaaagttgttcaccgggatataaaatcaagcaacattttgattgatgatgaattcaatggcaaggtctctgactttggattggccaagatgttggggtcagataaaagccacattaccaccagagtgatgggaacatttggatacgttgcacctgagtatgctaacactgggatgttaaatgaaaagagtgatgtttatagttttggtgttctcttgttggaaactgtgacaggaagagaccctgttgactatagccgctctgccaacgaggtcaatcttgtcgagtggctcaaaatgatgatagccaaccggagagcagaagaagtggttgatccaatcctagaggttaggccaaccattagggctcttaaacgagctctgctaatcgccctaaggtgtgttgatcctgactctgaaaagaggcctaagatgggccaggttgctaggatgcttgagtcggaagaagttccattccgggaggaccggagaaaccggaggagtcggacggggagcatggacatcgaatctattacagagggatcaaattcggctgaatttgcaagcaaggtagaaaggactggcagctcaagatcagaccggtctcagtcctgagtagtcctgacgtttgggcctgtctttggatcatgagcactcatgctcgttgattggtccgagaaacggtgttgatcaccaaggtgattactgccccgaatccctgtaggaaatgttagtgggttaatgaaggcaagcccagattttactactagctaaagtttaggccgagctgttaggtcgagcagaagcattcttggaggaagaattccctggtgttttgttcaatgtattttgtgctgtgtaggtatgtgttggtgcctgggatgatcatgcttgtgaaccgggatgttccttcagtttgtcacagtggaccattcttcattttcttttctgattttttgggtcttgcattgttaccctgtgagttttttgcgtgcttctgttaaaaaaaagtcgtcgtttgttgggcgaactacatgaggtggcttcatcaactgaaacagccagaacctacatggttcatttgggtggacattttgatttgacagacttctgcctagagtaaaaaactttttgtcaacgcaaattgccttaggcctccttcggttgttagggggccaatccatgcagatctcacatggagagaagtcatagacaaggaaaagtgagaaaacagaccattgcagttgttgctgatgttctcattacggtcatattgttgtactaattatagcaattcctttaaagcaaacattaacaatgcc

SEQ ID NO: 2127 - DNA, 2303 bp, Triticum aestivum
gccagccgttaatgccacacctgcaacatccaccaccctccttccccacttttccttttactcccatctcctctctccctctctcgggttcccccgtcgccattggtgccacaggctggattcttctcaagctttgctacgcgcggttctttgcttgacgaatgagtggatggaggttctgcggcacaaagagggagaagaattcgcctacagtcgctgatgcctagcagcgctctactctgatgcggcacagctccaaattttagcacactgccgccatggtttccactggtctgagtttagagatgacgaagaaggttcttggcctggcattgtgggtctggattgcaatcggtgtggtcgctctcctagtggccattttgctgatgatatgtatctgggcggcgtcccgtcgcaagacaaagagaaccatggagaacttgagccagacacagatccccatctactccaaggagatcccggtagacagggtgggcggtggccgcagccttgcgcagacgatgcatgaacgtgagcagcctagcttcccaacgcaggacaagcacgccgtgagtcgggagccggggaaaacggtggggcatatggcattgagcaagtcctcggatcatgataacgtgagccagggaagctcagtgtgcaatgtggaccgggttggcagtgtgcattctggtgaagatggcggctcggggcacggcaggaaaccgtattctcctgcggcatttgtgtccgcgtcgcccctcgttggccttcctgagttctctcatcttggttggggtcactggttcactctgcgcgaccttgaattcgccaccaatcgcttctcaaaggagaatgtgcttggagagggtggttacggagttgtgtatcgtggtcgtctggtgaatggaaccgaggttgccataaagaagatttttaacaacatggggcaggcggagaaggaattcagggtggaggttgaggctattggacatgtacgacataagaacctggtccgtctgctgggatactgtgttgagggagtgaataggatgttggtttatgagtttgtgaacaatggtaacttggagcagtggcttcatggagctatgcgccagcatggtgtttttacctgggataatcgcatgaaggttgttataggcactgcaaaagcacttgcgtaccttcatgaagctatagaaccaaaagttgtacaccgtgatataaagtcaagcaacatcttgattgatgatgaattcaacggcaaagtctctgactttggtttggccaagatgttagggtcagataaaagccacattaccaccagagtgatgggaacatttggatacgttgcacccgagtatgctaatactgggatgttgaatgaaaagagcgatgtttatagttttggcgttctcttgttggaaactgtgacaggaagagaccctgttgactatagccgctcttccaatgaggtcaatcttgttgagtggctcaaaatgatgatagccaaccggagagcagaagaagtggttgatccaatcctcgaggttaggccaacaattagggcacttaagcgagctctgttgatcgcactaaggtgtgttgatcctgactctgaaaagagacctaagatgggccaggttgctaggatgctggagtctgaagaagttccatttcgggaggaccggagaaaccggaggagtcgcacaggaagcatggacatcgaatctattacagagggatcaacttcggctgaatttgcaatcaaggtagaaaggactggcagctcaagatcagaccggtctcagacctgacgtatacgggtctgtcttgcatcatgagcactcacgctcgtttatcagtccgagaaacgatgttcatcaccaaggtgattactgccccgaatccgtgtaggaaatattagtgggttaatgaaggcacgcccagattttagtagctaaagtttaggccgagctgttagatcgagcagaagcattcttggaggaagaattccctggtattttgttcaattgttttgtgctgtatatgtgtgtgttggtgcctgggatgatgatgcttgtgaaccgggatgttccttcagtttgtgacagtggaccattctttattttcttttctgttttttggctcttgcattgctagcctgtggtttttttctttttcttttgcgtgctcctgttgaaaaatgtcatcgtttgttgggcaaactacatgaggtggcttcatcaactgaaacagtcagaacttacatgattcatttgggtagaaaaaaaaaaaaaaaacga

SEQ ID NO: 2128 - DNA, 2105 bp, Triticum aestivum
gccagcctttaatgccacacctgcaacatccaccaccttccttccccccttttccttttactcccatctcctctctctctccctcctctggttccccttcgccattgctgccacaggctggattcttctcgagctttgctacgcgcggttctttgcttgacgaatgagtggatggagcttctgctgcacaaagagggagaaggattcgtctacagttgctgatgcctagcagtgctctactctgatgcggtacagctccaaattttagcacactgccgccatggtttccactggtctgagtttagagatgacgaagaaggttcttggcctggcattgtgggtctggattgcaatcggtgtagtcgctctcctggtggccattctgctgatgatatgtatctgggcggcgtcccgtcgcaagacaaagagaaccatggagaacttgagccagacacagatccccatctactccaaggagatcccggtagacagggtgggcggtggccgcagccttgcgcagacgatgcatgaacgtgagcagcctagcttcccaacgcaggacaagcacgccgtgagtcgggagccggggaaaacggtggggcatatggcattgagcaagtcctcggatcatgataacgtgagccagggaagctcagtgtgcaatgtggaccgggttggcagtgtgcattctggtgaagatggcggctcggggcacggcaggaaaccgtattctcctgcggcatttgtgtccgcgtcgcccctcgttggccttcctgagttctctcatcttggttggggtcactggttcactctgcgcgaccttgaattcgccaccaatcgcttctcaaaggagaatgtgcttggagagggtggttacggagttgtgtatcgtggtcgtctggtgaatggaaccgaggttgccataaagaagatttttaacaacatggggcaggcggagaaggaattcagggtggaggttgaagctattggacatgtacgacataagaatttggtccgtctgctgggatactgtgttgagggagtgaataggatgttggtttatgagttcgtgaacaatggtaacttagagcagtggcttcatggagctatgcgccagcatggtgtttttacctgggataatcgcatgaaggttgttataggcactgcaaaagcacttgcgtaccttcatgaagctatagaaccaaaagttgtacaccgggatataaagtcaagcaacatcttgattgatgatgaattcaacggcaaagtctctgactttggattggccaagatgttagggtcagataaaagccacattaccaccagagtgatgggaacatttggatacgttgcacctgagtatgctaatactgggatgttgaatgaaaagagcgatgtttatagttttggtgttctcttgttggaaactgtgacaggaagagaccctgttgactatagccgctcttccaatgaggtcaatcttgtcgagtggcttaaaatgatgatagccaaccggagagcagaagaagtggttgatccaatcctcgaggttaggccaacaattagggctcttaagcgagctctgttgatcgcactaaggtgtgttgatcctgactctgaaaagagacctaagatgggccaggttgctaggatgcttgagtctgaagaagttccattccgggaggaccggagaaaccggaggagtcgcacaggaagcatggacatcgaatctattacagagggaacaaattcggctgaatttgcaatcaaggtagaaaggactggcagctcaagatcagaccggtctcagacctgacgtttacgagtctatcttgcatcatgggcactcatgctcgttgatcagtccgagaaatgatgttcatcactaaggtgattacctgtaggaaatattagtgggttaatgaaggcacgcccagattttactagctgaagtttaggccgagctgttagatcgagcagaagcattcttgtaggaagaattccctggtattttgttcaattgttgtgtgctgtatatgtgtgtgttggtgactgggatgatcatgcttgtgaaccgggatgttcctgcagtttgtgacagtgga

SEQ ID NO: 2129 - DNA, 2148 bp, Triticum aestivum
gccagcctttaatgccacacctgcaacatccaccaccttccttccccccttttccttttactcccatctcctctctctctccctcctctggttccccttcgccattgctgccacaggctggattcttctcgagctttgctacgcgcggttctttgcttgacgaatgagtggatggagcttctgctgcacaaagagggagaaggattcgtctacagttgctgatgcctagcagtgctctactctgatgcggtacagctccaaattttagcacactgccgccatggtttccactggtctgagtttagagatgacgaagaaggttcttggcctggcattgtgggtctggattgcaatcggtgtagtcgctctcctggtggccattctgctgatgatatgtatctgggcggcgtcccgtcgcaagacaaagagaaccatggagaacttgagccagacacagatccccatctactccaaggagatcccggtagacagggtgggcggtgggcgcagccttgcgcaaacgatgcatgaacgtgagcagcctagcttcccaacgcaggacaagcacgccgtgaatcgggagccggggaagacagtggggcatatggcactgagcaagtccttggatcatgataacgtgagccagggaagctcagtgtgcaatggtggaccgggttggtagtgtgcattctggtgaagatggcggctcggggcaaggcaggaaaccgtattctcctgcggggttcgtctccgcgtcgcccctcgttggccctcccgaggtctctcatcttggttggggtcactggttcactctgcgcgaccttgaattcgccaccaatcgcttctcaaaggagaatgtgcttggagagggtggttacggagttgtgtatcgtggccgtctggtgaatggaaccgaggttgccataaagaagatttttaacaacatggggcaggcggagaaggaattcagagtggaggttgaagctattggccatgtacgacataagaatttggtccgtctgctgggatactgtgttgagggagtgaataggatgttggtttatgagttcgtgaacaatggtaacttagagcagtggcttcatggagctatgcgccagcatggtgtttttacctgggataatcgcatgaaggttgttataggcactgcaaaagcacttgcgtaccttcatgaagctatagaaccaaaagttgtacaccgggatataaagtcaagcaacatcttgattgatgatgaattcaacggcaaagtctctgactttggattggccaagatgttagggtcagataaaagccacattaccaccagagtgatgggaacatttggatacgttgcacctgagtatgctaatactgggatgttgaatgaaaagagcgatgtttatagttttggtgttctcttgttggaaactgtgacaggaagagaccctgttgactatagccgctcttccaatgaggtcaatcttgtcgagtggcttaaaatgatgatagccaaccggagagcagaagaagtggttgatccaatcctcgaggttaggccaacaattagggctcttaagcgagctctgttgatcgcactaaggtgtgttgatcctgactctgaaaagagacctaagatgggccaggttgctaggatgcttgagtctgaagaagttccattccgggaggaccggagaaaccggaggagtcgcacaggaagcatggacatcgaatctattacagagggaacaaattcggctgaatttgcaatcaaggtagaaaggactggcagctcaagatcagaccggtctcagacctgacgtttacgagtctatcttgcatcatgggcactcatgctcgttgatcagtccgagaaatgatgttcatcactaaggtgattacctgtaggaaatattagtgggttaatgaaggcacgcccagattttactagctgaagtttaggccgagctgttagatcgagcagaagcattcttgtaggaagaattccctggtattttgttcaattgttttgtgctgtatatgtgtgtgttggtgcctgggatgatcatgcttgtgaaccgggatgttccttcagtttgtgacagtggaccattctcttattttcttctctgttttttggctgttgcattg

SEQ ID NO: 2130 - DNA, 1678 bp, Panicum virgatum
  misc_feature (265)..(265): n is a, c, g, or t
  misc_feature (831)..(831): n is a, c, g, or t
  misc_feature (1081)..(1081): n is a, c, g, or t
  misc_feature (1241)..(1241): n is a, c, g, or t
  misc_feature (1251)..(1251): n is a, c, g, or t
  misc_feature (1288)..(1288): n is a, c, g, or t
  misc_feature (1437)..(1437): n is a, c, g, or t
aatgcacgagcgcgagcacccgagcttcccgccgcaggacaagcacgcgagccgggacccggccggggcgacgctgggccacatggcgctcagcaagtcctcggatcacgataacatgagccaggggagctcggtttgcaatgtcgatcgtgccgccagcgtgcactccggtgaggatgggagctcggggccacggaggaagcccaattcgccggcggcgtttgtgtctgcgtcgcctctcgtcggccttcccgaattctctcancttggctggggtcactggtttactcagcgtgaccttgagcttgctaccaaccgtttctccaaggagaatgtgctgggagagggtggctatggagttgtgtaccgtgggcgcctggtgaacgggactgaagttgccatcaagaagatctttaacaacatggggcaggcagagaaggaattcagagtagaggttgaagctattggccatgtccggcataagaatttggttcggctgttgggatactgtgttgagggtgtaaacaggatgctggtatatgagtttgtgaacaatggcaacttagagcagtggctacatggagctatgcgtcagcgtggtgtttttacctgggaaaatcgcatgaaggttgtaacgggaactgcaaaagcgcttgcataccttcatgaagctatagaaccaaaagttgtacaccgagatattaaatcaagtaatatattgattgacgatgaattcaatggcaaggtctccgactttggattggctaagcttttgggctcagataaaagccacattactactagagtaatgggaacatttggatatgtggnaccagaatatgctaatactgggatgttaaatgagaagagcgatgtctatagtttcggtgttctcttgttggaaactgtgacaggaaggggtcctgttgactacagccgatcttccaatgaggtcaatcttgttgaatggctcaaaacaatggtggccagtcgaagggcagaggaagtggctgatccaagcttagaagttaggccatctattaggtctctgaagcgggctcttctagtggcactaaggtgngttgatcctgactctgaaaagagacccaagatgggccaggttgtcaggatgcttgagtctgaagaagttccgtaccgggaggaccggagaaaccggaggagtcgcactggaagcatggatattgagtctatagcagagggttcaaactctgccgagtttngaaagaaggnggagaggactggcagtgcaacatcagaccgatctcanccttgaggccttgcaaacaaattctatatcgtgaaaagtctgagaaatgatgttaatcaccaaggtgattgctgccctgatagggtatgttggtaggtggtggaggcagggcaagccctgatgttactacctgaatcttaggtctactngtatcaggtcgagtagaaacattcttggatgtaggatctcctggtctcctctcctgttgtctgtacaggttatatgttggcgcctagggaattcccttggttgggtgtttaacaattggtcggttcttctggatcttgcactgttaccttctcaaatctggttccttgcttctgcggtgctgtatatgaggttgtactgttagtgttcttggcttgcagcttgttaatatttctctggatt

SEQ ID NO: 2131 - DNA, 1976 bp, Zea mays
gagctcccgcaacatcagcagcaaggacatcctggtggagccgtcgcgcatctcacgcttccttcacctgaccaacagccaagccgggaggcacgcttgagagccacacactgagacctcacgcgcggatggccgccgccgcgggcgggaccggcggctgcggctgccacattgtagcggtgccgttcccgggccgcggccatgtcaacgccatgatgaacctgagccgcctcctcgcagcccggggcgcggcggtcaccttcgtcgtcaccgaggagtggctcggactcatccgctcctcctccgccgccgccgctgccgagccggccggcatccgcatccgcaccatccccaacgtcatcccttccgagcacggccgcgccgccaaccactcaggcttcctcgacgccgtcgccacagagatggaggcgcccttcgaccgccttcttgacgggctcgaaggcccgccgcccgcggcgctcgtggccgacgcctacgttccctgggtggtcggcgtcggcaaccggaggggcgtccccgtctggtcgctcttccccatgtccgccgcctttttctttgcctactaccacttcgaccgcctcccggcctggcttaccaactctgagcacgcgccggaatccggtgagactattggaaactctgatcagagacttgggcactatatcgctgggcaggcttcaagttcaatacggttgtcagatctcgagcccttaattcacaacaagagaacagtgaagcatatcctaacaactatctctagcatcagaaatgctcagtctctccttttcaccaccatgtatgagcttgaggccagtgtcattgactcgctaaggtcagtactctcttgtccagtgtacccaataggcccctgcgttccatacatgatgcttgaagaccataccgtgtccagtggcaaagttgccaggcaaggagattatttcacatggttggattctcaacctgtgaactcagttttgtatgtctcccttggcagttttgtttcagtctcagcctctcaacttgaagagatcgcattgggcctaatagccagtgaggtcaggttcttgtggattcttcgagaacaatcccctcgggtgcaagaactcttctctggcatcaataatgggatgatactgccatggtgtgagcagcttgaggtgttgtgccatcattcagttgggggcttcatgacccattgcgggatgaactcgacacttgaaggcgtcttcgctggtgtgcctatgcttgccttaccactgttttttgatcaaccgattgatgggcgattaattgtggaagagtggaagattggccttgccgttagggattgggctagcaagggtggtctgatcgggagagaggatattgcacgggctgtgaagaagctgatgtcttctgatgaaactgggacaaaggcgctgagggaacgtgctcttgagttgaaggaggcttctcgcagagcagtcaatgagggtggatcttcatactgcaatctgagttcattgatggagacggtatgcactccaaaataattggaattgtatttggtatgtgctaaaacactgtagtggtggtgtaacctgtaaccatcatgcttcaaatatcaattctacaatcaacccttgcgcagctcaactctttagaatttgtgcaactttcggaaagggtgatgatgcgattgatgtacgatttgttcaatacgttgttattttgtccgagctccatttggattgtacttatagcaaaatgtcttcgtttcaagatagctgcgaattagcttgaagtttcaaatttacagcagcctttgaattgtacttatagcaaaatggattgtacttaccattttgatcctgaagacttgagcagcctttgaaggacaagggtgtttgggtctggtttttgtaaggaaaaataacatttgatcaatgaattttggtgtttaataatcaaacata

SEQ ID NO: 2132 - DNA, 1969 bp, Zea mays
gagctcccgcaacatcagcagcaaggacatcctggtggagccgtcgcgcatctcacgcttccttcacctgaccaacagccaagccgggaggcacgcttgagagccacacactgagacctcacgcgcggatggccgccgccgcgggcgggaccggcggctgcggctgccacattgtagcggtgccgttcccgggccgcggccatgtcaacgccatgatgaacctgagccgcctcctcgcagcccggggcgcggcggtcaccttcgtcgtcaccgaggagtggctcggactcatccgctcctcctccgccgccgccgctgccgagccggccggcatccgcatccgcaccatccccaacgtcatcccttccgagcacggccgcgccgccaaccactcaggcttcctcgacgccgtcgccacagagatggaggcgcccttcgaccgccttcttgacgggctcgaaggcccgccgcccgcggcgctcgtggccgacgcctacgttccctgggtggtcggcgtcggcaaccggaggggcgtccccgtctggtcgctcttccccatgtccgccgcctttttctttgcctactaccacttcgaccgcctcccggcctggcttaccaactctgagcacgcgccggaatccggtgagactattggaaactctgatcagagacttgggcactatatcgctgggcaggcttcaagttcaatacggttgtcagatctcgagcccttaattcacaacaagagaacagtgaagcatatcctaacaactatctctagcatcagaaatgctcagtctctccttttcaccaccatgtatgagcttgaggccagtgtcattgactcgctaaggtcagtactctcttgtccagtgtacccaataggcccctgcgttccatacatgatgcttgaagaccataccgtgtccagtggcaaagttgccaggcaaggagattatttcacatggttggattctcaacctgtgaactcagttttgtatgtctcccttggcagttttgtttcagtctcagcctctcaacttgaagagatcgcattgggcctaatagccagtgaggtcaggttcttgtggattcttcgagaacaatcccctcgggtgcaagaactcttctctggcatcaataatgggatgatactgccatggtgtgagcagcttgaggtgttgtgccatcattcagttgggggcttcatgacccattgcgggatgaactcgacacttgaaggcgtcttcgctggtgtgcctatgcttgccttaccactgttttttgatcaaccgattgatgggcgattaattgtggaagagtggaagattggccttgccgttagggattgggctagcaagggtggtctgatcgggagagaggatattgcacgggctgtgaagaagctgatgtcttctgatgaaactgggacaaaggcgctgagggaacgtgctcttgagttgaaggaggcttctcgcagagcagtcaatgagggtggatcttcatactgcaatctgagttcattgatggagacggtatgcactccaaaataattggaattgtatttggtatgtgctaaaacactgtagtggtggtgtaacctgtaaccatcatgcttcaaatatcaattctacaatcaacccttgcgcagctcaactctttagaatttgtgcaactttcggaaagggtgatgatgcgattgatgtacgatttgttcaatacgttgttattttgtccgagctccatttggattgtacttatagcaaaatgtcttcgtttcaagatagctgcgaattagcttgaagtttcaaatttacagcagcctttgaattgtacttatagcaaaatggattgtacttaccattttgatcctgaagacttgagcagcctttgaaggacaagggtgtttgggtctggtttttgtaaggaaaaataacatttgatcaatgaattttggtgtttaataatc

SEQ ID NO: 2133 - DNA, 1582 bp, Setaria italica
cgggatggccgccgccgccgcgggggacgagccgcgcgtccgcggctgccacattgtggcgatgccgttcccgggccgcggccacgtcaacgccatgatgaacctcagccgcctcctcgccgcgcgcggcgccgcggtgaccttcgtcgtcaccgaggaatggctcggcctcatccgctcctcctcctcctccaccgccgtcggcgtccgtctgcgctccatccccaacccctccgagcacggccgcgccgccgaccactcgggcttcctcgacgccgtcgccaccgagatggaggcgcccttcgagcgcctgctcgacgggctcgagggcccgccgcccgccgcgctcgtggccgacgcctacgtcccctgggtcgtcggcgtcggcaaccggaggggcgtccccgtctggccgctcttccccatggccgcctccttcttcttcgcctactaccactacgaccgcctcccgacctggcttaccggcgacggtaagcacgcgccggactccggtgaggttgtagataactctgatcagagacttatgcactatatctccagcttcaagttcaataagattgtctgatctcgagcccttaattcacaacaagagaacagtaaagcatatcctatcagccatctctagtattagaaatgctcaatgcctcctttttaccaccatgtatgagcttgaggccagtgtcatcgactctctacggtcggtactctcttgcccagtgtacccaatcggcccctgtgttccctacatgacacttggagaccacagttccatgtccaatggggataccagccaaggagactacttcacatggttgaattctcaacctgtgagctcagtgctatatgtgtcccttggcagctttgtctcagtgtcaacctcgcagcttgacgagattgcattgggcctagcggcgagtgaggtcaggttcttgtggattcttcgtgaggtgcgagacctcattggtgacaccgataaggggatgatactgccatggtgtgagcagctgaaggttttgtgccattcctcagttgggggcttcttgacccattgcgggatgaactcgacacttgaagccatctttgctggtgtacctatgcttgccttaccactattctttgatcagccaattgatggccgattaattgcggaagagtggaagattggcctgaacttgagggattgggctaacaaggatggtctgattgggagagaggatattgcacgtgctgcaaagaggctgatgtcttctgatgaagctgaggcaaaggcagtgaggagacgtgctcttgagtggaaagaggcttctcgcagagccgttgacatgggtggatcttcatatggcaatctgagttcattgatggagatggtatgtgcttcagaataagagagggaattccttatttgacactggaatcagcatggtatgtactgaaaccgctcttgtcatactgtagtggttttgtaataatcaatgtttcaaatatggatgctacaatcatccctcttaaaaaatttacgagatttctgaaaggtgatgcagatttttttttataaaggaat

SEQ ID NO: 2134 - DNA, 1790 bp, Oryza sativa
gtcgcaggcagaaaccacgcgaggcgcgcgactcacctgccgagccacgcgtcgcgcacgctgcggagatcgcctcctcctcgccgccgccgccggggggaatggggagcacggggcgcgacgcggaggtgacccgcggcgacttccccgacggcttcgtcttcggcgtcgccacctccgcttaccagattgaaggggcgagacgggagggaggcaaaggagataacatatgggatgttttcacagaaaacaaagaacgtatcttagatgggagcagtggagaagttgcagttgatcattaccatcgatacaaggaagacattgaactcatggccagtttgggtttccgtgcttatagattttctatatcttggccacgcatatttcctgatggcctggggaaaaatgtcaatgagcaaggagttgccttttataatgaccttataaatttcatgattgagaaaggtattgagccatacgcaactctgtatcattgggatcttccacataatcttcagcagactgtgggtggttggctttctgataagatcgtggagtactttgcactgtatgcagaagcttgctttgcaaattttggagacagagtaaagcattggataacaatcaatgagcctcttcaaactgcagttaatggttacggaattggacattttgcacctggaggatgtgaaggggaaactgctagatgctacttggccgcccactaccaaatcttggctcatgctgctgctgttgatgtttacagaaggaaatttaaggctgtgcaaggtggtgaagtaggcttggttgtcgattgtgaatgggcagagccattttcagagaaaacagaagatcaggttgctgcagaacgaaggcttgactttcagctaggatggtacctggacccaatatatttcggtgattacccagaaagtatgcgtcagcgactgggcgatgatcttccaaccttctcggagaaagataaagaatttatcaggaacaaaattgactttgttggaataaatcattatacttcaagattcattgctcatcatcaggatccagaagatatttatttttaccgagtacaacaagtggagagaatagaaaaatggaacactggtgaaaaaattggtgaaagggccgcatctgagtggcttttcatagttccttggggcctccggaaattacttaattatgcagcaaagagatatggaaatcctgtgatatatgtaactgagaatggcatggatgaggaagatgatcaatcggcaacgcttgaccaagtcttgaatgatacgacgagggttggttacttcaaaggatacctcgcgtcagttgcacaagcaatcaaggatggtgctgatgttcgtgggtacttcgcatggtcgttcctggacaacttcgagtgggctatgggatacaccaagaggtttggcattgtttatgttgattacaaaaatgggctttcccggcatcccaaagcatcggcccggtggttctcgcgcttcttaaagggcgatgacgctgagaacaaagctgacatgaactaggccatcctgaagaaagtaaaggaacattacacagtaatcgtttctgctgttgttgtatcttatattgatatatgtagtgtatctattcatcatcataatagtgtatcttatattgatatacatctcagatgtgctatttagtttgtcattgatcaaattcagaggtttgcccataccaataaaatctgaatcaatgccaaacactcatgtttacagccctcacgcttataatctcca

SEQ ID NO: 2135 - DNA, 1933 bp, Brachypodium distachyon
aaatttgcccacttcctcctcttcctcacgactccactcgtccctcttcctcaggagccacgacgcaccaccggatcgagatcactagctagcctagcgatcctcggcggcctcgcgcggggaatcaatggggagcaccgggcgcgacgaggaggcggtggcggcggcggaagtgacccgcgccgacttccccgagggcttcatcttcggcgtcgccacctccgcctaccagattgagggggcgagaaaagagggtggcaaaggtgatagcatatgggatgtatttgcagataataaagaacatatcctagacggaacatctggagaagttgcagttgatcattaccatcgatacaaggaagacattgaactgatggccaaattgggttttggagcctatagattttccatatcttggtcacggattttccctgatggcctggggaaagaaatcaatgagcaaggagttgctttctataacaatcttatagattttatgattgagaaaggtattcagccttatgcaactctgtatcactgggatcttccacataatctgcaacagaccatggggggttggctttcggacaagattgtagaatacttcgcattatatgcagaagcttgctttgccaattttggagacagagttaagcattggatgacaatcaatgaaccacttcaaacatcagttaatggttatggcattggaatatttgcacccggagtatgtgaaggtgcagctgctgaacctttcttggctgctcatcaccagatcttagctcatgctgcttctgttgatgtctacagaaggaaattcaaggctgtacaaggtggccaagtagggtttgttattgattgtgaatgggcagagccattttctgacaaaatggaagatcaggctgctgcagcacgacgcattgacttccaacttggatggtacctggacccaatatactttggtgattacccagaaagcatgcgccagagattgggtgatcatcttccaaaattctctgagaaagaacgtgaactgatcaggaacaaaattgattttattggattaaatcactatacatcaagattcattgctcatcagcaggacccacaagctatccatttctatcaggttcaacaaatggagagaatagaaaaatggaataccggtgaaggaattggtgaaagagctgcttctgagtggcttttaatagttccttggggtcttcgaaaagctattaattatatagtgaagaaatacaataatccagtgatatatgtaacagagaatggcatggatgatgaagacgatcagtcagcaccacttgatcaggtgttaaatgatacaaagagggttggtttcttcaaaggatatgttggagccgtcgcacaagcaataaaggatggtgccgatattcgtggatactttgcatggtcattcttggataactttgagtgggctatgggctacaccaagaggtttgggcttgtctatgttgattacaaggatgggctctcccgacaccctaaagcatcagccatgtggttctcacgtttcttgaatggcgaggctgctgacatcaaacctgacacaaactaagcaagcattcaccaagggggtggcatcgctgtttgaggatagtttgcatggtcatttccggacaactttgggtgggttataggatacaccaagaggtgtggtagtgttcatgttcaagaatgggctcgcttgacatcccaaatcgtcgtcagcactgtggttctcacacttgttgcaaacaaagcggatacgagacgagctgagtcatccttcagcaagtaaatgaatattacacagtaactgtttgtcctgttcacctgttgttgtatcatacagtaactgctagtatatccgttcacaataatactcagatctgctacggtctgccatttatcc

SEQ ID NO: 2136 - DNA, 4528 bp, Zea mays
ggcctctcctactgttgtgactggtgccacctctcctttcccttcttcctccgtgccccaatccctcttctcccctcgaccagccgagagagcgcccctaccgcagcagctgcagtgctgctctgctctgctctgttctgcccccacttcaccctctcgtctcaccccgcctgcagcttggtcgcttttctccccagtctcctcccctccaccctctcgtctcgtcgcacctcacctgcttggtcgcttttctcccccaatctcctcgtctcccgccggcaccaataccatcctctgtccgctcgctgttgctgttgctattcccgtccgtcccgtgcttctactcgctagtcgtttcgtattcgtatcctctctcctcagccgccctgctcccctcccgtcctctggtgtctggtcaaaccagcggctcccaagatttgccgctgcttccttcctggagaaatcaagcctgtgcggcgagaaatcaagaggaagggggaagagagggagaaagagagaggggcgggggtggaggaaagaaagcctgccccttgcggacgtgcctgctccctcgggggcattcaattggagccaacagtgggcgggtgggcggctgctacagcacggcggcctccataaattagctccccgcgttccggccccttccgccccctgtcgtcgcacccgccccgtgtctcccccgatcggtccgtcgatcacgcggacgcccgccggagcatgcgcgccgcgggcctcggccgccggagaagcagcatcagccgccgcgccgccgccggcgtccggaaggagatgtagcgctagctccccgacccgcgaggaaagggaaaggggaatgaccgttacggcgcgcgggaggagcggtggagccgggatgggggagaagggcggcgctcccgggctcggcttcctgagcctcgatcggatgcgcgtcctcctgccgccgctccgcctgccggagaagctgtcggccaggacgctgcggacgcacctcttcactaactaccggatgcgcaaggtgcgggacagctccagctggctcatcccgctctgggtcagctcttgggtcctcgtcgcctccctcatctacctttgcatgagctaccaggccgtcggcaagcgccgggagtctctcgccagcatgtgcgacgagcgcgcgcgcatgctccaggaccaatttaacgtcagcatgaaccacctccaggcgctcgccatcctcgtctccaccttccaccactccaagacaccctccgccatcgaccagaaaacgttcgcgaggtatgcggagaggacggcgttcgagcggccgctgacgagcggggtcgcgtacggggtgcgggtcacgcacgccgagcgggagcagtttgagcgccagcagggatggagcatcaagaagatgtactcctccaagaccaagaatcagtcgcagggacccgggaacgccgaggacgccgaggtgcgggagccggcggaggagtatgctcccgtaatcttcgcgcaggacgcctacaagcacgtcatctccttcgacttgctatccggcgccgatgaccgggacaacgtactccgagctagagaatctgggaagggtgttcttactgctcctttcaagttgctcaataatcgccttggagtgatcttcacctatgctgtgtacaagtatgagcttcctgcaaatgccaggccacaggagcgcattcaggctgctataggctatttaggtggcatatttgatattgaagctcttgttgataagttgcttcaccagctcgcgggcaagcaatccatcatggtgaacgtttacgatactactaatgagagaccaatcagtatgtatggttcgaatgatacaggcagtggcatgtgccaggtcagcacactgaacttcggtgacccttcaaggaagcatgtgatgcactgcaggttcattcagagcccaccttggccttggatggcaataacgacatcaattggaactctagtgattgctttactgattggatacatagttcatgctaccgcaaaacggattgccagagttgaagatgactttcaggagatgagtttgctcaagaagcgcgcagaggatgcagatattgccaagtcacagttcttggctactgtttctcatgagatcagaactccaatgaatggtgtcctagggatgctccaaatgctcatggatactgatttggacacaacacaacaagactatgttagaaccgcacaagccagtggcaaaactttggtatccctcatcaatgaggttcttgatcaggcaaagatcgagtctggtaaacttgagcttgaggtggtaccctttgatcttagaacagtttgtgatgacattttgtctctcttctgtgggaaagcacaggagaaaggactggagttggcagtgtttgtttctgatcaagttccacaaacactaattggcgatcctggaagaataaggcaaatcattacaaatcttgttggaaactctataaaattcacagagaagggtcatatctacttgacggttcatgtcgttgaagagattatgcattgtctggaggttgagacgggaactcagtatacaaataccttaagtggctacccagtggcgaacaggaagcgcagttgggaaaactttcgactttttagtagggaactgaactcatccgagatgccttttgcacccattgcatcagactcaataagcttgatgatatcagttgaagatacgggtgctggaatcccgttcgatgctcaatcccgtgtcttcacccctttcatgcaagtaggtccatccatcgctcgcatacacgggggcactggcattggattaagcatcagcaaatgcttggttggcctcatgaagggagagatcggatttgcaagtaaaccccaagttggttctactttcaccttcactgcagtgcttacgagggtccattccagcagaaatgagaataaatcatcagaatttaaagagatcaatgcattggtggtagatcatagaccggtccgtgccaaggttactaagtatcatttgcaaagactgggagttcagactgaattgacaactgacctagatcagtatatttctaaaaataattgtggatcacagattgcaaagcttgtgctcattgacaaagaaacctggctgaaagaatcccactccatgcctcttttggttactaaattgaggaacaaagatcagccagactctacaaagttatttcttttggagaaccctaaaagttctgtcaagagcaattcacatatattcagggaatataacttgaatgtaattatgaagccacttcgtgcaagcatgcttcaggtttcgctacaaagagcattgggtgggatagataaactgcattgcaggaatggagtagtcggcaattcaacactgggcagccttcttcacaagaagcgaatcatagtggttgatgataatattgtaaatctcaaggttgctgcaggcgctctaaagaaatatggcgcggaagtaacttgtgctgacagtgggaaggaagcaatcacactgctgaaacctcctcacaattttgatgcttgtttcatggacatacagatgcctgaaatggatggatttgaagccacaaaaaggattagagtgatggaaagagatctaaatgagcaaatagaacgtggagaagccccaccagaatgcgtaggggttcggcagtggcgaactccaatattagccatgacagcagatgttatccaggcgacacatgaacaatgcttgaaatctgaaatggatggttatgtttccaagccattcgagggcgagcaattgtacagagaagtagctcgctttttcctaaatcaagaccaagttcagtaggtaggcttatatggagtgtaaaatagtggaggatatcagggttcacccatcgaggctgaaagaattttgtcagagatcccatgttcttgagagtggacatcaattcgcagagttaggggccctattaaaacgctagcaacgctgggatgtggcctccagttaggtggaaaacactttaggctggagatgaaccacccatgttcggttccttggtacatctgaccaagctgcaaaactaaatgtgcaatgtcttgaaatcaaggtgcatgtggagctatttactcgacaatctgaggtcaaggcgtgtgaaaaaaaagcccagctgcattcactaaccgcagatgtcctctgccactataatatagagtagggagagaaattttccttccccggaaggtaccggctgtacatattaggtattggttgtttgtgcaggcatttgttggcattttgttgtgcatcgtcttcggtctgtattgtttgggtcgaagctgtaaaatgtaaatggcattttcaaagatggaagttttgtttgacaaatacatcggtcgtcatcagcttgtcttcctgagtttctctcctgctactggttctctcccaaccagccaatcactatactgaaggctgcctgttggtgtggctttatctgat

SEQ ID NO: 2137 - DNA, 4529 bp, Zea mays
ggcctctcctactgttgtgactggtgccacctctcctttcccttcttcctccgtgccccaatccctcttctcccctcgaccagccgagagagcgcccctaccgcagcagctgcagtgctgctctgctctgctctgttctgcccccacttcaccctctcgtctcaccccgcctgcagcttggtcgcttttctccccagtctcctcccctccaccctctcgtctcgtcgcacctcacctgcttggtcgcttttctcccccaatctcctcgtctcccgccggcaccaataccatcctctgtccgctcgctgttgctgttgctattcccgtccgtcccgtgcttctactcgctagtcgtttcgtattcgtatcctctctcctcagccgccctgctcccctcccgtcctctggtgtctggtcaaaccagcggctcccaagatttgccgctgcttccttcctggagaaatcaagcctgtgcggcgagaaatcaagaggaagggggaagagagggagaaagagagaggggcgggggtggaggaaagaaagcctgccccttgcggacgtgcctgctccctcgggggcattcaattggagccaacagtgggcgggtgggcggctgctacagcacggcggcctccataaattagctccccgcgttccggccccttccgccccctgtcgtcgcacccgccccgtgtctcccccgatcggtccgtcgatcacgcggacgcccgccggagcatgcgcgccgcgggcctcggccgccggagaagcagcatcagccgccgcgccgccgccggcgtccggaaggagatgtagcgctagctccccgacccgcgaggaaagggaaaggggaatgaccgttacggcgcgcgggaggagcggtggagccgggatgggggagaagggcggcgctcccgggctcggcttcctgagcctcgatcggatgcgcgtcctcctgccgccgctccgcctgccggagaagctgtcggccaggacgctgcggacgcacctcttcactaactaccggatgcgcaaggtgcgggacagctccagctggctcatcccgctctgggtcagctcttgggtcctcgtcgcctccctcatctacctttgcatgagctaccaggccgtcggcaagcgccgggagtctctcgccagcatgtgcgacgagcgcgcgcgcatgctccaggaccaatttaacgtcagcatgaaccacctccaggcgctcgccatcctcgtctccaccttccaccactccaagacaccctccgccatcgaccagaaaacgttcgcgaggtatgcggagaggacggcgttcgagcggccgctgacgagcggggtcgcgtacggggtgcgggtcacgcacgccgagcgggagcagtttgagcgccagcagggatggagcatcaagaagatgtactcctccaagaccaagaatcagtcgcagggacccgggaacgccgaggacgccgaggtgcgggagccggcggaggagtatgctcccgtaatcttcgcgcaggacgcctacaagcacgtcatctccttcgacttgctatccggcgccgatgaccgggacaacgtactccgagctagagaatctgggaagggtgttcttactgctcctttcaagctgctcaataatcgccttggagtgatcttcacctatgctgtgtacaagtatgagcttcctgcaaatgccaggccacaggagcgcattcaggctgctataggctatttaggtggcatatttgatattgaagctcttgttgataagttgcttcaccagctcgcgggcaagcaatccatcatggtgaacgtttacgatactactaatgagagaccaatcagtatgtatggttcgaatgatacaggcagtggcatgtgccaggtcagcacactgaacttcggtgacccttcaaggaagcatgtgatgcactgcaggttcattcagagcccaccttggccttggatggcaataacgacatcaattggaactctagtgattgctttactgattggatacatagttcatgctaccgcaaaacggattgccagagttgaagatgactttcaggagatgagtttgctcaagaagcgcgcagaggatgcagatattgccaagtcacagttcttggctactgtttctcatgagatcagaactccaatgaatggtgtcctagggatgctccaaatgctcatggatactgatttggacacaacacaacaagactatgttagaaccgcacaagccagtggcaaaactctggtatccctcatcaatgaggttcttgatcaggcaaagatcgagtctggtaaacttgagcttgaggtggtaccctttgatcttagaacagtttgtgatgacattttgtctctcttctgtgggaaagcacaggagaaaggactggagttggcagtgtttgtttctgatcaagttccacaaacactaattggcgatcctggaagaataaggcaaatcattacaaatcttgttggaaactctataaaattcacagagaagggtcatatctacttgacggttcatgtcgttgaagagattatgcattgtctggaggttgagacgggaactcagtatacaaataccttaagtggctacccagtggcgaacaggaagcgcagttgggaaaactttcgactttttagtagggaactgaactcatccgagatgccttttgcacccattgcatcagactcaataagcttgatgatatcagttgaagatacgggtgctggaatcccgttcgatgctcaatcccgtgtcttcacccctttcatgcaagtaggtccatccatcgctcgcatacacgggggcactggcattggattaagcatcagcaaatgcttggttggcctcatgaagggagagatcggattttcaagtaaaccccaagttggttctactttcaccttcactgcagtgcttacgagggtccattccagcagaaatgagaataaatcatcagaatttaaagagatcaatgcattggtggtagatcatagaccggtccgtgccaaggttactaagtatcatttgcaaagactgggagttcagactgaattgacaactgacctagatcagtatatttctaaaaataattgtggatcacagattgcaaagcttgtgctcattgacaaagaaacctggctgaaagaatcccactccatgcctcttttggttactaaattgaggaacaaagatcagccagactctacaaagttatttcttttggagaaccctaaaagttctgtcaagagcaattcacatatattcagggaatataacttgaatgtaattatgaagccacttcgtgcaagcatgcttcaggtttcgctacaaagagcattgggtgggatagataaactgcattgcaggaatggagtagtcggcaattcaacactgggcagccttcttcacaagaagcgaatcatagtggttgatgataatattgtaaatctcaaggttgctgcaggcgctctaaagaaatatggcgcggaagtaacttgtgctgacagtgggaaggaagcaatcacactgctgaaacctcctcacaattttgatgcttgtttcatggacatacagatgcctgaaatggatggatttgaagccacaaaaaggattagagtgatggaaagagatctaaatgagcaaatagaacgtggagaagccccaccagaatgcgtaggggttcggcagtggcgaactccaatattagccatgacagcagatgttatccaggcgacacatgaacaatgcttgaaatctgaaatggacggttatgtttccaagccattcgagggcgagcaattgtacagagaagtagctcgctttttcctaaatcaagaccaagttcagtaggtaggcttatatggagtgtaaaatagtggaggatatcagggttcacccatcgaggctgaaagaattttgtcagagatcccatgttcttgagagtgggcatcaatccccagagttaggggccctattaaaacgctagcaacgctgggatgtggcctccagttaggtggaaaacactttaggctggagatggaaccacccatgttcggttccttggtacatctgaccaagctgcaaaactaaatgtgcaatgtcttgaaatcaaggtgcatgtggagctatttactcgacaatctgaggtcaaggcgtgtgaaaaaaaagcccagctgcattcactaaccgcagatgtcctctgccactacaatatagagtagggagagaaattttccttccccagaaggtaccggctgtacatattaggtattggttgtttgtgcaggcatttgttggcattttgttgtgcatcgtcttcggtctgtattgtttgggtcgaagctgtaaaatgtaaatggcgttttcaaagatggaagttttgtttgacaaatacatcggtcgtcatcagcttgtcttcctgagtttctctcctgctactggttctctcccaaccagccaatcactatactgaaggctgcctgttggtgtggctttatctgat

SEQ ID NO: 2138 - DNA, 4459 bp, Zea mays
ggagccacttgcgtgctggcctctcccactggcgccacctcccctccttttctcttcttcctccgtccgcccgtcccccaatccctccgctcctctctaccagccgagaccgagagagagcgcccgaccctaccacagctgctgcctgctgctgctctgttctgctctcccccttttccaccgtttctctctcttctcacctcacctgtttggccgcttttctccactcccctcttccaatcagaccaatctccccgtctccctaaacacgaataccatccctctgctccggtgttccggctctcccacgcaccccaccccaccccactagtttttgcttcctgttcacttgtgcctgctctcgctcgctgttggcctgttgctgttgctattcccgtcccgtgcttcccttcctctcactggtcgtctagtatcctctctcccacctgccgctgccgccgccgccgccgccgccgccctgctcccacctgccgtcctctggtcaaagccagcggctcccgagatttgccgctgcttccttgcttgaggaatcaagcctgagcggtgagagatcaagagggagggacggagcgagagacgcaagaggaaagggagccagcccctcgcgcccggcattcaattggagccaacagtaggcgggtggggcggctgctacagcacgtcggactccataaattagctccccgctttccggcccccttttcgccccgtgtctcccccgatcggcccgtcgacgacgcggacgcccgccggagcatgcgcgccgcgggcctcggccgccgcagcgccgccgccggcgtccggaagatgtagctccgcgacccgcgaggagagggcgagggggatgaccgttacggcgcgcgggaggagcggcggggccgggatggaggagaagggcgacgcgcccgggctcggcttcctgggcctcgaccggatgcgcgtcctcctgccgccgctccgcctgccggagaagctgtcggccagggcgctgcggacgcacctcttcaccaactaccggatgcgcaaggtgcgggacagctccagctggctcatcccgctctgggtcctcttctgggtgctcctcgcctccgtcatctgcctctggatgagcaaccaggccgtcgccaagcgccgggagtcgctcgccagcatgtgcgacgagcgcgcgcgcatgctccaggaccagttcaacgtcagcgtgaaccacctccaggcgctcgctatcctcgtctccaccttccaccactccaagacaccctccgccatcgaccagaccacgttcgcaaggtacgcggagaggacggcgttcgagcggccgctcacgagcggggtcgcgtacggggtgcgggtcacgcacgccgagcgggagcagttcgagcgccagcagggatggagcatcaagaagatgtactcctccaagaccaagaagcagtcgcagggaccagggaacgctgaggacgccgaggtgcgggagccggcggaggagtatgctcccgtaatcttcgcgcaggacgcatacaagcatgtcatctccttcgacttgctatccggcgccgatgaccgcgacaacgtactccgagctagagaatctgggaagggtgttcttactgctccttttaagctgctcaataatcgccttggagtgatctccacctacgctgtgtacaagtatgagcttcccccaaatgccaggccacaggagcgcattcaggctgctataggctacttaggtggcatatttgacattgaagcgcttgttgacaagttgcttcaccagctcgcgggcaagcaatccatcatggtgaacgtttacgatactactaatgatagacggatcagtatgtatggttcgaatgatacaggcagtggcatgtgccaagtcagcacactgaactttggtgacccgtcaaggaagcatgaaatgcactgcaggttcattcagagtccaccttggccttggatggcaataacgacatcaattggaactcttgtgattgctttactgattggatacataatttatgctactgcaaaacggattgccagagttgaagatgactttcaggagatgagtgtgctcaaaaagcgtgcagaggatgcagatattgccaagtcacagttcttggctactgtttctcatgagatcagaactccaatgaatggtgttctagggatgctccaaatgctcatggatactgatttggacacaacacaacaagactatgttagaaccgcacaagccagtggcaaagctttggtatctctcatcaatgaagtacttgatcaggccaagatcgagtctggtaaacttgagcttgaagcggtgccctttgaccttagaacagtttgtgatgacattttgtctctcttctgtgggaaagctcaggagaaaggactggagctggcagtgtttgtttctgaccaagttccacaagcactaattggcgatcctggcagaataaggcaaatcattacaaatcttgtcgggaactctataaaattcacagagaagggtcatatctacttgacagttcatgttgttgaagagattatgaattgtcttgaggttgagacgggaactcagtccgccaataccttaagtggctacccagtggcgaacagaaagcgcagttgggaaaactttcgagtctttagcagggaactgaactcatctgagatgccttttgcacccatcgcatcagactcaataagcttgataatatcagttgaagatacgggtgttggaatcccgttcgatgctcagtcccgtgtcttcacccctttcatgcaagtaggtccatccattgctcgcatccatgggggcactggcattggattaagcatcagcaaatgcttggttggactcatgaggggagagattggatttgcaagtaaaccccaagttggttctactttcaccttcactgcggttcttacgagggcccattccagcagaaatgagaataaatcgtcagaatttaaagggatcaatgcattggtggtagatcataggccggtccgtgccaaggttactaggtaccatttacagagactgggagttcagaccgaattgacaactgacctagatcaatatatttctaaaattaattgcggatcacaaattgcaaagcttgtgctcattgacaaagaaacctggctgaaggaatcccactctatgcctcttttggttactaaattgaggaacaaagatcagccagactctacaaagttatttcttttggagaaccctaaaagtactgccaaaagcaattcacatatattcagggaatttaacttgaatgtaattatgaagccacttcgagcaagcatgcttcaggtttcgctacacagagcattgggtgggatagataaactgcactgcaggaatggagtacttggcaattcaacactgggcagccttcttcacaagaaacgaatcttagtggttgacgacaatattgtaaatctcaaggttgctgcaggcgctctgaagaaatatggcgcagaagtaacttgtgctgatagcgggaagaaagcaatcacgcaactgaaacctcctcacagttttgatgcttgtttcatggacatacagatgcctgaaatggatggatttgaagccacaaaaaggattagagtgatggaaagagatctaaatgagcaaatagaacgtggagaagccccaccggaatgcgcagggctccggcagtggcgaactccaatattagccatgacagcagatgttatccaggcgacgcacgaacagtgcttaaaatctgaaatggacggttatgtatccaagccattcgagggcgagcaattgtacagagaagtagctcgctttttccaaaatcaagaccaagttcagtaggtaggcttatatggaggagtgtaaagtagtggaggatatcgccaacggttcacccgtcgaggccgaaagaattttgtcaaagatctcatcttcttgaaagtgggcatcaattcgcaaagttagagggcccctattaaaacactagaaatgctgggatgtggccgccagttaggtggaaacgatttaggctggagatggaaccacccatgttcggatgcttggtacatctgaccaatctgcaaagctaaatgcgcaatgtcttgaaatcaacatgcacgtgcagctattcattcgacgatttgctgaggtcaaggcgtgtgaaaaaaaatcagctgcattcactaactgcaggtgccctctgccactatataatatataagactagggggagaagttttccttcccccggaaggcacggctgtacatattatattagggattggttggttgtttgtgcaggcatttttgtatgcatcatattcggcctgtatgggtcgaagctgtaaagtgtaaatgacacattcaaagatggaagttttgtttgacaaaaaaaaaaaacatcagtcgcca

SEQ ID NO: 2139 - DNA, 2103 bp, Zea mays
ttcccatttcccaaccatgccattgccatcggccgcccagagcgctctcgtcgtggcggccgtcgccatagccaccgccaccgtcctcctccccttcccacggacgccgccgcgggaccgcttcgccgacatggtgctggccaacggcaccatctacaccgcggaccccgcccgacccttcgccgacgccatgtccgtccgcggcggccgcgtgctccgcgtcgggacctacgagtccgtcaaggagctcaagggccctcgcactcgtgagctgaatctcagtgggaacgtggtgctgccggggttcatcgactcccatgttcacttcatagacggtggattgcagctagcgagggtgccacttcgtggggtcagaagcaaagatgacttggttgccagggtcaaggaagctgtcagagataagcaacctgggcagtggatcttgggcggaggttggaatgatgattttgggggagatggtctcccggctgctgtttggctggatgatatctcacctgataatccagtctggctctctcgcatggatggtcatatgggagtagccaactcattagctatgaagattgctgggattgacaaaaacacaaacgatccaattggtggaactatcatacgaacaactgaaggagagcctactggtcttctagttaatactgctatgaaacccatatttgatgtcattcaaaatgtttctaaccatgaaagaagagaggctcttcttagagcaagtagacatgccctaatgaggggagtgactactgttgttgatgttggaagttacttccctggggcctcagctgagaaaacgtggcaagattttgcagaattagaaggattcacttgtcttgtttttatctatgaccttatttgtactcctggcatactgacacaagtattgataccactacagaaatctataaatgggctcactctatggaaaaatgattttgagagtatgcttattcttcccaatgcccacatggtctcgtgtttccgatcttattagtgaacatggtcgatcgctaagtcagtggatccatctaggtggtgttaaagctttccttgatgggtctctgggttcttcaagcgcgttgttccatgagccttatgagggtgatccggataattatggtctccaaatgacagatttagacagcctacttaatagaacactagaatctgacaaatctggactccaggttgccatacatgcaattggggataaagctaatgacatactactggatatggttgacaagattgttgatttaaatggagcgaaggaccgtagattccggatcgaacatgcccaacatctggctccaggtgcagcaaaccgctttggcaagcatggtaccattgcatccgtgcagccagatcatctactagatgatgccgaccatgcttggagcaagattggggtggaaaggtctgagcgaagctcctacacatttcgatcactgttagatggcggtgcgcagctagcttttggttctgactggcctatttcagacatcaaccccttgcaagctatccgatccgcagtgttccgcaagcctcctggatgggaggtcccctggatccctgcggagcgcttgaccctggatgaatcactgaaagcgcacacgatgtctgctgcctacgcctgcttcctggaccacgccgtgggcagcctttctgaagggaaatacgccgattttgtggtggtaccttctacatcgtgggacgaattctccagcgatttgccggggcatgtcctggcgacgtacgtgagcggcaggcaagcttatccatgacagatagcagttgtgtaagtgttggagaccaaaaagagcagcgcggacagtccggccctgaggccggaaggccggacgatccgcggtccggacagtccgcggtgatggcgcggacggtctgcgcgtgcgcagagtcagttaggatttctagtttctcgcgggatttgttacctaaaaccgcgggattaactcggaaatctgttggaagcggatccagacctcccctttatatcgatgaagggctacggccgattgaactccccaacaatcgaacaaatcaagtcta

SEQ ID NO: 2140 - DNA, 1845 bp, Zea mays
gccgacatggtgctggccaacggcaccatctacaccgcggaccccgcccgacccttcgccgacgccatgtccgagctcaagggccctcgcactcgtgagctgaatctcagtgggaacgtggtgctgccggggttcatcgactcccatgttcacttcatagacggtggattgcagctagcgagggtgccacttcgtggggtcagaagcaaagatgacttggttgccagggtcaaggaagctgtcagagataagcaacctgggcagtggatcttgggcggaggttggaatgatgattttgggggagatggtctcccggctgctgtttggctggatgatatctcacctgataatccagtctggctctctcgcatggatggtcatatgggagtagccaactcattagctatgaagattgctgggattgacaaaaacacaaacgatccaattggtggaactatcatacgaacaactgaaggagagcctactggtcttctagttaatactgctatgaaacccatatttgatgtcattcaaaatgtttctaaccatgaaagaagagaggctcttcttagagcaagtagacatgccctaatgaggggagtgactactgttgttgatgttggaagttacttccctggggcctcagctgagaaaacgtggcaagattttgcagaaatctataaatgggctcactctatggaaaaatgattttgagagtatgcttattcttcccaatgcccacatggtctcgtgtttccgatcttattagtgaacatggtcgatcgctaagtcagtggatccatctaggtggtgttaaagctttccttgatgggtctctgggttcttcaagcgcgttgttccatgagccttatgagggtgatccggataattatggtctccaaatgacagatttagacagcctacttaatagaacactagaatctgacaaatctggactccaggttgccatacatgcaattggggataaagctaatgacatactactggatatggttgacaagattgttgatttaaatggagcgaaggaccgtagattccggatcgaacatgcccaacatctggctccaggtgcagcaaaccgctttggcaagcatggtaccattgcatccgtgcagccagatcatctactagatgatgccgaccatgcttggagcaagattggggtggaaaggtctgagcgaagctcctacacatttcgatcactgttagatggcggtgcgcagctagcttttggttctgactggcctatttcagacatcaaccccttgcaagctatccgatccgcagtgttccgcaagcctcctggatgggaggtcccctggatccctgcggagcgcttgaccctggatgaatcactgaaagcgcacacgatgtctgctgcctacgcctgcttcctggaccacgccgtgggcagcctttctgaagggaaatacgccgattttgtggtggtaccttctacatcgtgggacgaattctccagcgatttgccggggcatgtcctggcgacgtacgtgagcggcaggcaagcttatccatgacagatagcagttgtgtaagtgttggagaccaaaaagagcagcgcggacagtccggccctgaggccggaaggccggacgatccgcggtccggacagtccgcggtgatggcgcggacggtctgcgcgtgcgcagagtcagttaggatttctagtttctcgcgggatttgttacctaaaaccgcgggattaactcggaaatctgttggaagcggatccagacctcccctttatatcgatgaagggctacggccgattgaactccccaacaatcgaacaaatcaagtcta

SEQ ID NO: 2141 - DNA, 2418 bp, Oryza sativa
agatacctcccctcttttcgctctttttgtgttaggctgcctcacacggcgagggatcgcggactccccggacgaggcggcggcggcggcggagctccggcgaacccacacggcggccgccccgactccgtctcctctgcttctcccacagctccggcgacaatccagaaactccactcccttgagagcgagcgccgccgcgccgccgccggtgattgcttccgcctgcagcctcgtcgaaatcgtaggctgtggattcagaagagagaggagagagagaagttcgaacagagcaggtcacgtggagcgccatgtccacccggagcgccttcctcgccgccggcgttgccatcgccgccgccatcttcctcctccgccctgcttccgacctgtcgagggatttgggggaagccgtcgctgacatgatactggccaatgccaccatctacaccgccgaccccgcaatgccgttcgccgaagccatggccgtacgcgccggccgcgtgctccgcgtgggcggatactactctgttaaggagttgaagggtagacacacaatggagttgaatcttagtggaaatgttgttcttccgggattcattgattcccatgtgcacttcattgatggtgggttgcagttagcgcgggtgccacttcgaggggttacaagcaaagatgatttcatcaacagggtcaaggaagctgtcaaagataagcatcctgggcaatggatatttggaggaggttggaacaatgatttttggggaggtgattaccccactgctgcttggttggatgatatatctcctgataatcctgtctggctttcacgcatggatggacatatgggaatagccaattcactagctatgagaatggctgggatcaacaaaaacacaaacaatccagttggtggaactattatgagaacaactgaaggagagcctaccggtcttctagttgatgctgctatgaagcttgtgtttgatgttatctcagaagtctctatccatgaaaggagagatgctcttcttagggcaagtagacacgccctaatgaggggggtgactactgttgttgatgttggaagttatttccctggaaagtcagaaaagcaagtctggcaagattttacagatatatatgaatgggctcattctgtcgaaacaatgattatgagagtttgcttattcttccccatgcccacatggtctcgtgtttatgaccttatccatgaaaaaggtcggatgttaagtcaatggattcatctaggtggtgttaaagctttccttgatggttctttgggttcttccagtgctttattctatgagcactacaaggatgatcctagaagttatggtctccaattggttgacatggattatctgctcaatacaacattagaattagacaaatcaggactacagattgccatacatgcaattggagataaagccaatgatatgctactcgatatgtatgagaaggtggttgatttgaatggaatgaaggatcatagattccggattgagcatgctcaacaccttgctcccggtgcagccaagcgctttggcaaacatggtattattgcatctgtgcagcctgatcatatattagatgatgccaattctgctgggaagaaaattgggatagaacgagctgagcgaagctcctattcttttcggtcactattagatggtggtgcacatctggcttttggttctgattggcctgtttcagatattaatccattacaagctattcgaactgcagtatcccgcaaacctgttggatgggaagtcccttggatccctgcggaacgcttatctctagatgattctctgaaagcacatactatatctgccgcctatgcctgcttccttgaccatgttttgggcagcctatctgaaggaaagtacgccgattttgtgatcctgcctagcacatcatggaacgagttcggcagcgacataacggaccacgtcttggcaacatatgtgaacggcaagcaggcctatccatgatcccattaggtgaccgactgactgtgctctaggttgagtacctgaacaagagattttagctatgtacctaaacgagcacttgtccagatacacagccaaaatatgttaaatttgctgacagggagtactgtaattgtcatatgcaaagttagctatttacctgaacaagcacttgtccaaatacacagctaaaatctcttaaatttgtggacagtgaatactgtaattgtcatatgcatacaacatctgagattttagtatgtacttgaacaaacacttgtctagagatacacagccaaaatctcttaaatttgtggatagggagtactgtaattgtcataagcaaagtcgacagcatacaacatctgtgtgccaatgaaatgttattgtggct

SEQ ID NO: 2142 - DNA, 1948 bp, Zea mays
gagaatcgaggattattatcgaataacagaacaccacttacctggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggactacctttttcggcgagaccaccctagtagaggatgatatacaccgcgattgacacgttctacctgacggaggagcagctgcgcaactcaccatcacggaaggatgggatcgacgaggccactgagactgtgctccgcgtctatggctgcgacctcatccaggagagcggcatcctcctcaggctaccacaagcagtgatggccacggcacaagtattgttccatcgcttttactgcaaaaaatcatttgttcgatttagtgcaaagagagttgctgctagttgtgtttggctggcagggaagttggaggagagtcccaggaaatcaaagcatattatatttgtcttccatagaatggaatgtaggagagagaacttgccaattgaattcttagatgtcttttcaaagaaatattcagaactgaggcgtgacctgatacggacagaacgacatctgttgaaggagatggggtttatttgccatgtcgagcacccccataagttcatatcaaactaccttgcaacacttgaagcccctcccgagcttactcaagaggcatggaaccttgccaatgatagcttaaggacaactctgtgtgtgcgatttaagagtgaagtagtagcatgtggagttgtgtatgctgcagctaggagacaccgggttccccttcctgaagatcctccgtggtggactgtctttgatgctgatgaagcaggaattcaggaagtttgcagtgttcttgctcacctctacagcctgcccaaggctcaatacattccagtgtataaagaatatgattcctttactgttaagagaatctctgatccacaggctttaaaggaaagtccagcaagggctgttgctagcgataagggtacccctataccctcaagttctaaccaggagaaggattcagtggctaagactataccgaatagggtgaaggaaaaaagtgatgacgaaggtagacacttgcctgctgaatttgatggaaaagaaaacctggtggtgaactcaaaaattgagaagtctgattctggtgttgactggagtcgagaaagagaaagagaaagagagagatcaagagggcgggaacgtgatgctaggggtagggattctgatcatgatagcaggggtcgtgactctgatcgcgagagggatcggagacgtcgctctagggatagaagttcaggacactcagacaaggagaaatcaaggcgccatccatcacacgaccgagttgactactacagttcgcattcatctcgtgaaaaagatcggcatagacaccattgatcaaggtgaggaggatcccgggtttgcagggctttgctgcatggagaccaccacatggcagtgccgacagaatcatgaaaacttgtagattgtcatctcattggcggttgcatttgcttcattgtgttttgcaccttggattgtaacttgcagagcaacatgaatttgtagaaccttcatctccactagttcccaaaattctcgagaattaatttagggtgttactaataaaaaatcatcctctaaccgttttttaaataggtttcaaatatacgaacttcgtaaatattccta

SEQ ID NO: 2143 - DNA, 1953 bp, Zea mays
gagaatcgaggattattatcgaataacagaacaccacttacctggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggactacctttttcggcgagaccaccctagtagaggatgatatacaccgcgattgacacgttctacctgacggaggagcagctgcgcaactcaccatcacggaaggatgggatcgacgaggccactgagactgtgctccgcgtctatggctgcgacctcatccaggagagcggcatcctcctcaggctaccacaagcagtgatggccacggcacaagtattgttccatcgcttttactgcaaaaaatcatttgttcgatttagtgcaaagagagttgctgctagttgtgtttggctggcagggaagttggaggagagtcccaggaaatcaaagcatattatatttgtcttccatagaatggaatgtaggagagagaacttgccaattgaattcttagatgtcttttcaaagaaatattcagaactgaggcgtgacctgatacggacagaacgacatctgttgaaggagatggggtttatttgccatgtcgagcacccccataagttcatatcaaactaccttgcaacacttgaagcccctcccgagcttactcaagaggcatggaaccttgccaatgatagcttaaggacaactctgtgtgtgcgatttaagagtgaagtagtagcatgtggagttgtgtatgctgcagctaggagacaccgggttccccttcctgaagatcctccgtggtggactgtctttgatgctgatgaagcaggaattcaggaagtttgcagtgttcttgctcacctctacagcctgcccaaggctcaatacattccagtgtataaagaatatgattcctttactgttaagagaatctctgatccacaggctttaaaggaaagtccagcaagggctgttgctagcgataagggtacccctataccctcaagttctaaccaggagaaggattcagtggctaagactataccgaatagggtgaaggaaaaaagtgatgacgaaggtagacacttgcctgctgaatttgatggaaaagaaaacctggtggtgaactcaaaaattgagaagtctgattctggtgttgactggagtcgagaaagagaaagagaaagagagagatcaagagggcgggaacgtgatgctaggggtagggattctgatcatgatagcaggggtcgtgactctgatcgcgagagggatcggagacgtcgctctagggatagaagttcaggacactcagacaaggagaaatcaaggcgccatccatcacacgaccgagttgactactacagttcgcattcatctcgtgaaaaagatcggcatagacaccattgatcaaggtgaggaggatcccgggtttgcagggctttgctgcatggagaccaccacatggcagtgccgacagaatcatgaaaacttgtagattgtcatctcattggcggttgcatttgcttcattgtgttttgcaccttggattgtaacttgcagagcaacatgaatttgtagaaccttcatctccactagttcccaaaattctcgagaattaatttagggtgttactaataaaaaatcatcctctaaccgttttttaaataggtttcaaatatacgaacttcgtaaatattcctatttac

SEQ ID NO: 2144 - DNA, 1728 bp, Pennisetum glaucum
gctgcgctcttcccggcgcacggtttgttccgaccatccggcccgtgccctcaccgtgctacttccatccccttccgccgcgcgtcgcataggcgcagctgccgttgccctggcggagcgaggggcggctcgggccctaggcccctagcagaggttcgggcggtgaggcggcgcgggtagaggatgatctacacggcgatcgacacgttctacctgacggacgagcagctgcgggactcgccgtcgcggaaggatgggatcgacgaggccaccgagaccgcgctccgcatctacggatgcgacctcatccaggagagcggcatcctcctcaggctaccacaggcagtaatggccacagcacaagtattgttccaccgcttttactgtaagaaatcatttgttcgatttagtgcgaagagagttgctgctagctgtgtttggctggcaggaaagttggaggaaagtcctagaaaatcaaagcatatcatatttgtattccacagaatggaatgtaggagagaaaacttgccaattgaatacttagatgtcttttcaaagaaatactcagaactaaggcatgacctgataaggacagagcggcatctgttgaaggagatgggttttatttgccatgtcgaacacccccataaattcatatcaaactaccttgtaacacttgaagctcctgatctgactcaagaggcatggaaccttgccaatgatagcttgaggacaactctctgtgtgcgattcaagagtgaagtagtagcttgcggagttgtgtatgctgcagctaggagacgcggtatttcccttcctgaggatcctccgtggtggactgtcttcgatgctgatgaagctggaattcaagaagtgtgccgggttcttgctcacctctacagcctccccaaggcgcaatacataccagtgtataaagacaatgattcctttactataagaaggacaccagatccacaggcttcaaaggacaatcctgcaagtcttgttgttagtgataagggtacacctataccctcgagttctagccaggagaaggattcagtgacaaaggctgcaccaaacaaggtcaaggaaaaaagtgacgacgaaggtaagccattgcctgctgaactcaatggaaaacaagacccagcagtgagcttgaagaatgagaaatcagagtctgatgttgaccggagtcgggaaagagaaagagagagatcaagagggcgcgatcgtgatggcaggagtagggattctgatcgtgatagcaggggccgtgactcggatcgtgaaagggacaggagacgacgttctagggaaagaagttcaggacattcagacaaggagaagtcaaggcaccattcatcacgagaccggggtgactactacagttcgcacccatctcgtgagaaggatcggcgcaggcaccattgatcaagctgaggatccgttacaaaggctagagaagaatatgtagcgtgggtgtcatctcatcattgcacatgacaatggctttcccttggcaacattgtttttgtacctggattttgtaacttttaagacattatatagagctgttaggtacttgaatttgtacaaactgaacaaagaagtctagggtcacttggagtacatgcactgttgcattatctcgttgaggttccgttgtaacggattgtggaatgtttgtgccatcatggtaatggtaaacggataattgctcga

SEQ ID NO: 2145 - DNA, 2063 bp, Panicum virgatum
cgagcagttgtcgagcaccccgcgactcccgagcggagcttgactcttcaatccccttccccgcgaacgctttcttccgaccatccgccgccgccgacgccgccctcgtgccctcaccgtgccactcccgccggcgccagcctcctctcctccctctctgccgcgcgtcgcatcgcgcagctgccgtcgtcctggcggagcgcgggggcggctccggcccgatcagaggcgcccggtgaggcggcgcggggccgaccgtgggggaggcgcacggcggtggggcggcccgtgtagaggatgatctacacggcgattgacaccttctacctgacggacgagcagctgcgggactcgccgtcgcggaaggatgggatcagcgaggccaccgagaccgcgctccgcgtctacggatgcggcctcatccaggagagcggcatcctcctcaggctaccacaagcagtgatggccacagcacaagtattgtttcatcgcttttactgcaagaaatcatttgttcgatttagtgcaaagagagttgctgctagctgtgtttggctggcagggaagttggaggagagtcctagaaaatcgaagcatattatatttgtattccatagaatggaatgtaggagagaaaacttgccaattgaatatttagatgtcttctcaaagaaatactcagaactgaggcatgatctgataaggacagaacggcatctgttgaaggagatgggttttatttgccatgtcgaacacccccataagttcatatcgaactaccttgtaacgcttgaagcccctgagctgactcaagaggcatggaaccttgccaatgatagcttgaggacaactctgtgtgtgcgattcaagagtgaagtagtagcatgcggagttgtgtatgctgcagctaggagacgcggtattgcccttcctgaggatcctccgtggtggactgtcttcgatgctgatgaagctggaatccaagaagtttgccgggttcttgctcacctctacagcctccccaagtcagagtacataccagtatataaagacaatgattcctttactgttagaaggacaccagagccgcaggtttcaaaggaaagtcctgcaagtgctgttgctagtgataagggaacccctgtaccctcaagttctagccaggaaaaggattcggtgacaaaggctgcaccagacaaggtcaaggaaaaaagtgacgatgaaggtaaggcattgtctgctgaactcaatggaaaacaagatgcagcggcgaagttgaagaatgagaaatcggagtcgggtgttgaccggagtcgggaaagagaaagagagagatcaaaaggccgggaccgtgatggcaggggtagggattctgatcgtgatagcaggggccgtgactcggatcgtgaaagggacaggagacgacgttctagggaaagaagttcaggacattcagacaaggagaggtcaaggcaccactcgtcacgagaccgtggtgactactatagttcccactcatctcgtgaaaaggatcggcacagacaccattgatcaatctgaggatccctgtccacaaagattcgctgcaaggagaccaacagaagaacgaagcaggagaatatgtagtgcgggtgccatactgccatctcatcattgcacatggcaatggctttcccttacctctattattttggcacctggattctgtaacatgcaaggtaatcaatatctgctggggacttgaatttgtagaaacggaaccaaggagaagtcgaggcgcggaccacgggcattaattacctctttgaactgtcacgtaacgggagtatggaacctgtcgtgctgctttgcctgtgtgaattgtaatgcgcgtactcctacatagcttgcggatgttagaaaagatatacggtaatgctatagatctgacgtctgaaattttaatttttttaaaaaattggacgctcagatatatattgcaatagttaagcatttaatattgcaactattgttttctgtgtcaaagtaaaaatgttatatgaaacatagtgtttatgttgtgg

SEQ ID NO: 2146 - DNA, 1884 bp, Brachypodium distachyon
ggcttcggttcccgaccgcgtctcttgctcggtcgctcgctctggcctctggttaacggggaactcgccggtcttcccctccgcgccgccgtatcggtgcgccgctctggcagactagagacggggaagcgaaggaggagggaggatgatctacacggcgatcgacacgttctacctgacggacgagcagctgcgggactcgccatcgcgcaaggatgggatcgacgaggccgccgaggcctccctccgcgtctacggctgcgacctcatccaggagagcggcatcctcctcaagctaccacaagcagtgatggccacagcacaagtcctgttccatcgtttttactgcaagaaatcatttgcacgatttagtgctaagcgggttgcagctagttgtgtctggctagctgggaagttggaggagagtccaaggagatcaaagcatattatatttgtcttccatagaatggaatgcaggagagaaaacctgccaattgaattcttggacgtattttcaacgaaatatacagagctgaggcatgatctcataaggaccgaacgtcatctattgaaggagatggggtttatttgccatgtcgaacaccctcacaagttcatctcgaactaccttgcaacactagaagctcctgagctgacacaagaagcttggaaccttgccaatgatagtttgcggacaactctttgcgtacggttcaagagtgaagttgtggcatgtggagtcgtgtatgctgcagctaggagacaccgggttcccctccctgaagatcctccttggtggacagtctttgatgctgatgaggcaggaattcaggaagtttgcaaggttcttgctcacctctacagcctcccgaaggcacagtatattccagtgtacaaagacaatgattccttcagtgttagaagggcctctgatacacaggcttctaaggagagtcctgcaagtgctgttgctagtgataggggtaccgctgtgccttccagttctagccaggagaagaattccctgaccaaggcaggaccagagaaggtgaaggaaaacagtgataacaaggataagccagtgcctgctgagctaaatggaaaaggagaccaggcagtgaattcgaagagtgagaagtcagagtccaatgttgaccggactgaggaaagagaaagaagtagatcaagaggtcgggaccgtgatagtaggggtagggattctgatcgtgacagggagcgtgatcgagccaagagacaccgttcgagggacaaaacttcaggatactcggacaaggagaaatcaaggcaccgctcatcacgagaccgtggcggttactactcatctggtgacaaagatcggcgcaggcaccattgatcccgccgagctttcctgaagatcatatgagtagagcccacccagccgttagccaagcatgagaagaaattggtgccttcagatgtatgtcaagcaaatcaggcttcatctctacctttttttgaaatggaattttgtaattcgtctgtaacagtaatgttgtacacagtaacagagcttcccatctgcctgtagcttctgaagaggtaacaaaggcaagagacttggagtagattcgtgcttaaaagcgaaggcttttggagagtgactgataacatgataaaatccgtttcttctttgggagcatccgggcatgatgaaaactttagttatctctgattacggctcctgggctgctatgcgatactgtaagttgtttcgtgactaatacggagtatgtatcttgacataattaatccgggcctggttcagtacatccaaatattagaaactcttttagggatgtaactatgaattttttgcgagatatgaattttaaagagttgggt

SEQ ID NO: 2147 - DNA, 1914 bp, Oryza sativa
ggaccagattgctccgacctcaccgtctctcttctttctccccaatccctatagctctcgcttcgtcaaattctccggcgtttccagttcaaaaataaaaaataaaaaatctccggcgcaaatcctcctctccgccgccgccgcctccacctccaccgctcgccccctcgccgcgcctccactcctcacaccacgctcctcctgacctcctccctcgcgcttctccggcggcgcctcgctcctctgcgcggaccgttgcccctggccgagcgcggcgcggcgcgggccgcccgcggggggatcgggctcgggtagaggcgggcgacctggcgggggaagtaaggggtcgcgcgtggcggggagatgatctacacggcgatagacacgttctacctgacggacgagcagctgcgggactcgccgtcgaggaaggatgggatcgacgaggccaccgagaccgccctccgcgtctacggctgcgacctcatccaggagagcggcatcctcctcaagctaccacaagcagtgatggccacagcacaagtattgtttcatcgtttttactgcaagaaatcatttgttcggtttagcgttaagagagttgctgcaagctgtgtttggctggcagggaagttggaggagagtccaaggagatcaaagcatataatcattgtcttccatagaatggaatgtaggagagagaacgtaccaatagaacacttagatgtgttttcaaagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgatagcttgcggacaactctatgtgtaagattcaagagtgaagttgtagcatgtggagttgtgtatgctgcagcaaggaggcatggcgtgcccctccctgaagatcctccctggtggaatgtgtttgatgctgatgaggcaggaattcaggaagtttgcagagttcttgctcatctctacagcctccccaagtcacaatatatacaagtgtataaggacaatgattccttcacgcataggaggacttctgatacaaatgcttcaaaggaaagtcctgcaacgactgttgcaagcgataagggtacccctgtaccgtcaagttctagccaggaaaaggatgcactgattaaggcagggtcagataaggtgaaagaaaaaggtgacgatgatgggaagacgttaccttctgaacccaatggtaaagaaggccctgcagtgaatttgaagagtgagaagtcagaatccaatgttgatcgctctcgggaaagagaaagagatagatcaagagggcgggaccgtgatagcaggggccgggactctgatcgtgatagcaagggcagggactccgatcgggagagggagcgtgatagagaagcagacagggataggcagcggagacaccattctaaggacagaagttcaggatactctgacaaagagaagtcaaggcaccgctcatcaagagatcgtggtgatcactacagttcgcactcatctcgtgacaaagatcggcacaggcggcagtaatctagcagagctcgaaaacatgtaaactgatgaagtacacgttgcactatcgtggtaaaattgccattgcaactgggctccggggtgtttgttatgattgttaaactctttttttatttgcaacagaaaaagaattcttcttttgtggtgagtatcagacttcatagacttagctttgtatgacgcgtgggtctgggcatgaatcacttgttatgggagaaacttattcttgctatgcaaatctatatatcagttgattctatacta

SEQ ID NO: 2148 - DNA, 2324 bp, Brachypodium distachyon
atgccgtttcgtcgatctcgatcccgatcgcagctcgccgccgctcctccaccgggaagggacggatctgcttatttcttggctatctacggcgctctactgtctcttcagttgttggacttcttgcaaggtaaccatttcgatccggttctattcttcctcccttctctgttaattgatgttcttggctgtatatgctatatgttccccactgctatgctcttgttgttctccttctgtttacaggacatgaatcttgtactggttggatctattgagaaatttgctttgctttggaagcttcggtctgcatctcctagaccatctgctactacttcttgggattcttgcaagcaaggtctgcttcttggtttttcaattgagcaagctctttcaattcagtgtctcgcagcttctcgtattgcctcttggtcttctagcaagtgttctatcaaactgatttgccgtgccggcccggcccgatggtactattctgcagtaaccatactcgggccagcttacgtcattacgggcggcttcggttcccgaccgcgtctcttgctcgtcgctcgctttggcctctcgttaacggggaacttgccggccttcccctccgcgccaccaccgcgccccgtatcggtgcgccgctctggccgactagaggcggggaagcgagggaggatgatgtacacagcgatcgacacgttctacctgacggacgagcagctgcgggactcgccatcgcgcaaggatgggatcgacgaggctgccgaggcctccctccgtgtctacggctgcgacctcatccaggagagcggcatcctcctcaagctaccacaagcagtgatggccacagcacaagtcctgttccatcgtttttactgcaagaaatcatttgcacgatttagtgctaagcgggttgcagctagttgtgtctggctagctgggaagttggaggagagtccaaggagatcaaagcatattatatttgtcttccatagaatgtaatgcaggagagaaaacctgccaatagaattcttggacatattttcaacgaaatatacagagctgaggcatgatctcataaggacctaacgtcatctattgaaggagatgggatttatttgccatgtcgaacaccctcacaagttcatctcgaactaccttgcaacactagaagctcctgagctgacacaagaagcatggaaccttgccaatgatagtttgcggacaactctttgcgtacggttcaagagtgaagttgtagcatgtggagtcgtgtatgctgcagctaggagacaccgggttcccctccctgaagatcctccttggtggacagtctttgatgctgatgaggcaggaattcaggaagtttgcaaggttcttgctcacctctacagcctcctgaaggcacaatatataccagtgtacaaagacaatgattccttcagtgttagaagggcctctgatacgcaggcttctaaggagagtcccgcaagtgctgttgccagtgataggggtacccctgtaccttcgagttctagccaggagaagaattccttgaccaaggcaggaccagagaaggtgaaggaaaaaagtgataacaaggataagccattgcctgctgagctaaatggaaaaggacaccaagcagtgaattcgaagagtgagaagtcagagtccaatgttgaccggactgaggaaagagaaagaagtagatcaagaggtcgggaccgtgatagtaggggtagggattctgatcgtgacagggagcatgatagagccaagagacaccgttcgagggacaaaacttcaggatacttggacaaggagaaatcaaggcaccgctcatcacgagaccgtggcggttactactcatcgggtgacaaagatcggcacaggcaccattgatcccgccgagctttcccgaagatcatatgagtagagcctaccaagccgttagccaagcatgagaagaaatcggtaccttcagattaacagagcttgccatccgcctgtagcttctgaagaggtaacaaaggcaagagacttggagtagattcgtgcctaaaagggaaggcttttggggagtgactgataacatgataaaatccgtttcttctttgggagcatccgagcatgataaaaacttcagttatctctgattgcggcgcctgggctgctatgcgatactgtacgttgtttcgtgactaacatgtatcttgacataattaatcacggttcagtacatccaaatattacagaccctcttagggatgtcactatgaatatttaagagttgggatggagatcacttttctaat

SEQ ID NO: 2149 - DNA, 1858 bp, Cenchrus ciliaris
  misc_feature (941)..(941): n is a, c, g, or t
  misc_feature (1392)..(1392): n is a, c, g, or t
  misc_feature (1396)..(1397): n is a, c, g, or t
  misc_feature (1399)..(1403): n is a, c, g, or t
  misc_feature (1425)..(1432): n is a, c, g, or t
  misc_feature (1435)..(1436): n is a, c, g, or t
  misc_feature (1438)..(1441): n is a, c, g, or t
  misc_feature (1443)..(1443): n is a, c, g, or t
ccgttccgtgccctcaccgtgctactccccacatcgcgccggccctgcttccatccccttccgccgcgcgtcgcatagacgcagctgccgttgccctggcggagcgcggggcggctcgggccctaggtccctagcagagccgctcgggcggtgaggcggcccgggtagaggatgatctacacggcgattgacacgttctacctgacggacgagcagctgcgggactcgccgtcgcggaaggatgggatcgacgaggccaccgagaccgcgctccgcgtctacggatgcgacctcatccaggagagcggcatcctcctcaggctaccacaggcagtgatggccacggcgcaagtattgttccatcgcttttactgtaagaaatcatttgtccgatttagtgcaaagagagttgctgctagctgtgtttggctggcaggaaagttggaagaaagtcctcgaaaatcaaaacatattatatttgtatttcacagaatggaatgtaggagagaaaatttgccaattgaatacttagatgtcttttcaaagaaatactcagaattaaggcatgacctgataaggacagagcggcatctgttgaaggagatgggttttatttgccatgtcgaacacccccataaattcatatcaaactatcttgtaacacttgaagctcctgaactgactcaagaggcgtggaaccttgccaatgatagcttgaggacaactctgtgtgtgcgattcaagagtgaagtagtagcttgcggagtcgtgtatgctgcagctaggagacgcggtatttcccttcctgaggatcctccgtggtggactgtcttcgatgccgatgaagttggaattcaagaagtgtgccgggttcttgctcacctctacagcctccccaagtcgcaatacataccagtgtataaagataatgattcctttantattagaaggacaccagatccacaggcttcaaaggaaagtcctgcaagtcttgttgctagcgataagggtacacctataccctcgagttctagccaggagaaggattcagtgacaaaggctgcaccaaacaaggtcaaggaaaaaagtgctgatgaaggtaagccattgcctgctgaactcaatggaaaacaagatccggcagtaaacttgaagaatgagaaatcagagtccgatgttgaccggagtcgggaaagagaaagagagagatcaagagggcgtgaccgtgatggcaagagtagggactcagatcgtgatagcaggggccgtgactcagatcgtgaaagagacaggagacggcgttctagggaaagaagttcaggacattcagacaaggagaagtcaaggcaccactcatcacgagacaggggtgactactacagttcgcactcntctnntnnnnnggatcggcgcaggcaccattgnnnnnnnngannannnnangtcatctcatcattgtacatgacaatggctttcccttggcaacaccttttttacacctggattttgtacaaactgaacaaaaacgtctagggacacttgggagtacgtgcactgttgcattatatcgttaagctgtcattgtaacggattgtggaatgtttgtgccattgtcatggtaaacggataatggctcgaccgtttcaggcgatgtgggtgcatgctgcctgtcaactcttgccttgagtctcaagatgtgctacgcaacctagagaagactatatggagatacactgcagcaggagcatacatgaagacgagagcaaatggcaaatgcacggtgaggtgttgggcacgctttgccaccgtagggaaacgaaaacgatccatttctaaagtgagctgcttcaatttcata

SEQ ID NO: 2150 - DNA, 1604 bp, Triticum aestivum
acggcgatcgacacgttctacctcacggacgagcagctgcgcgactcgccgtcccggaaggatgggatcgacgaggccgccgagacgaccctccgcgtctacggctgcgacctcatccaggagagcggcatcctcctcaggctacctcaagcagtgatggccacagcacaagtactgttccatcggttttactgcaagaaatcatttgcacgatttagcgctaagagagttgctgctagttgtgtttggttggctgggaaattggaggagagtccaagaagatcaaagcatattatatttgtcttccatagaatggaatgcaggagagaaaacctaccaatagaattcttggatgtattttcaacgaaatatacagagctgaggcatgatctgataaggactgaacggcatctgctgaaggagatggggtttatttgccacgttgaacacccgcacaagttcatctcgaactaccttgcaacactcgaagcccctgagctgacacaagaagcgtggaaccttgccaatgatagcttgcggacaactctttgtgtacggtttaagagtgaagtagtagcatgcggagttgtgtatgctgcagctaggaggcaccgggttcccctcccagaagagcctccttggtggacagtctttgatgctgatgaggcagcaattcaggaagtttgcagggttcttgctcacctctacagcctcccaaaggcacaatatataccagtgtataaagataatgattccttcagtgttagaagggccttggatacacacgcgtctaaggagagtccagcaagtgctgttgctagtgataggggtactcctgtaccttcgagttctagccaggagaagaattcactggccaaggcaggacgagagaaagtgaaggaaaacagtgataccaaggataagctgttgcctgctgagctaaatgggaaaggagaccaggcagtgaattcgaagagtgacaggtcagagcctaatgtcgaccgtgcagaggaaagagaaagaagtagatcaagaggccgtgaacgtgaccgtgatattaggggtagagattctgatcacgagagggagcgtgatagagccaagagacaccgttcgagagacaaaagttcaggatactcggacaaggagaagtcaaggcaccgctcgtcacgcgaccgtgccggctactactcgtctggagacaaagatcatcggcacaggcgccattgatccagccgagcttccctgttgtaagaacatccgcagagagagcatgaagctcctgacgaagcgtgagaagaatttggtatcatctggtgttacactctctgtgccattagcaaaatcaggccaatatgtatcactttgcaacagagaaacagagcgcttgtcaataatttacctgtagtttatccgttgttccctcagtacatgcgtgcctgccacttttaacatgaagggcttttgggagtgagtgattttcacggcatgataacccggtttcttgtggcctggggggcgcatgaagaacttttgtgttgctttgctcgcagcttcataggctgatacacattgatattgttgtactttgtttcggactaatg

SEQ ID NO: 2151 - DNA, 2015 bp, Hordeum vulgare
ttcctccaggggcgaggcttctccctccctatcgcgcgacaccgacgcaaacctacagctggcacgccgtcgcctacttccctcccagagatcctacggcctcctccctgcccacctgcaacgccgacgctaccggccccttcctccttcgccgccttgcctatgctgccctcgcgtcagccggcgcaacaagccctagccccagccgccacggcgcgccgcccgggccgggcggttcctgcccgattgaacaccgtgagcagggggagacatgatttacacggcgatcgacacgttctacctcacggacgagcagctgcgcgactcgccgtcgcggaaggatgggatcgacgaggccgccgagacgaccctgcgtgtctacggctgcgacctcatccaggagagcggcatcctcctcaggctaccacaagcagtgatggccacagcacaagtgctgttccatcggttttactgcaagaaatcatttgcacgatttagtgctaaaagagttgctgctagttgttgtggttggctggcaagttggaggagagtccaagaagatcaaagcatatcatatttgtcttccatagaatggaatgcaggagagaaaacctaccaatagaattcttggatgtattttcaacgaaatatacaaagctgaggcatgatctgataaggactgaacgacatctgctgaaggagatggggtttatttgccacgttgagcaccctcacaagttcatctcgaactaccttgcaacactcgaagcccctgaattgacacaagaagcatggaaccttgccaatgatagcttgcggacaactctttgtgtacggtttaagagtgaagtagtagcatgcggagttgtgtatgctgcagctaggaggcaccgggtccccctcccagaagagcctccttggtggacagtctttgatgctgatgaggcagcaattcaggaagtttgcagaattcttgctcacctgcacagcctcccaaaggcacagtatataccagtgtataaagataatgattccttcagtgttagaagggccttggatacacacgcgtctaaggagagtccagcaagtgctgttgctagtgataggggtactcctgtaccttcgagttctagccaggagaagaattcactgaccaaggcaggacgagagaaagtgaaggaaaacagtgataccaaggataagccgttgcctgctgagctaaatggaaaaggaggccaggcagcaaattcgaagattgaaaggccagagcctaatgtagaccgtgctgaggaaagagaaagaagtagatcaagaggccgtgaccgtgatattaggggtagagattctgatcacgagagggagcgtgatagagccaagagacaccgttcgagagacaaaagttcaggatactcggacaaggagaaatcaaggcaccgctcgtcacgtgaccgtgccggctactactcatctggagacaaagatcatcggcacaggcgccattgatccagctgagcttccgtgttgtaagaacatccgcagagagagcacgaaggtcctgacggagcgtgagaaggatctggtttcatctggtgttacactacctattccattaacaaatcaggccaatctttatcactttgcaacagagaaacagagcgcttgtcaataatttacctgtagtttatcagagggaacaaagacaggtgtctcccgagtacatccgtgcctgccacttttgacatgaagggcttttgacagtgagtgattgtcacagcatgataacctggtttcttgtggcctgggggcacatgaaaaactttcgtgttgttttggttgcagcttcctaggctgatatgcattgatattgttgtaatttgtttccggactaatatggatatgttgtagctcttgtgtttgaagatgtcatgtgatgtcttagctaatttataataaatttcatgtaggaattaagaggtctatttaatcctgattacacattacctcttatggttttg

SEQ ID NO: 2152 - DNA, 2016 bp, Hordeum vulgare
ttcctccaggggcgaggcttctccctccctatcgcgcgacaccgacgcaaacctacagctggcacgccgtcgcctacttccctcccagagatcctgcggcctcctccctgcccacctgcaacgccgacgctaccggccccttcctccttcgccgccttgcctatgctgcccttgcgtcagccggcgcaacaagccctagccccagccgtcacggcgcgccgcccgggccgggcggttcctgcccgattgaacaccgtgagcagggggagacatgatctacacggcgatcgacacgttctacctcacggacgagcagctgcgcgactcgccgtcgcggaaggatgggatcgacgaggccgccgagacgaccctccgcgtctacggctgcgacctcatccaggagagcggcatcctgctcaggctacgacaagcagtgatggccacagcacaagtgctgttccatcgggtctactgcaagaaatcatttgcacgatttagtgctaagagagttgctgctagttgtgtgtggttggctggcaagttggaggagagtccaagaagatcaaagcatatcatatttgtcttccatagaatggaatgcaggagagaaaacctaccaatagaattcttggatgtattttcaacgaaatatacagagctgaggcatgatctgataaggactgaacgacatctgctgaaggagatggggtttatttgccacgttgagcaccctcacaagttcatctcgaactaccttgcaacactcgaagcccctgaattgacacaagaagcatggaaccttgccaatgatagcttgcggacaactctttgtgtacggtttaagagtgaagtagtagcatgcggagttgtgtatgctgcagctaggaggcaccgggtccccctcccagaagagcctccttggtggacagtctttgatgctgatgaggcagcaattcaggaagtttgcagaattcttgctcacctgcacagcctcccaaaggcacagtatataccagtgtataaagataatgattccttcagtgttagaagggccttggatacacacgcgtctaaggagagtccagcaagtgctgttgctagtgataggggtactcctgtaccttcgagttctagccaggagaagaattcactgaccaaggcaggacgagagaaagtgaaggaaaacagtgataccaaggataagccgttgcctgctgagctaaatggaaaaggaggccaggcagcaaattcgaagagtgaaaggtcagagcctaatgtagaccgtgctgaggaaagagaaagaagtagatcaagaggccgtgaccgtgatattaggggtagagattctgatcacgagagggagcgtgatagagccaagagacaccgttcgagagacaaaagttcaggatactcggacaaggagaaatcaaggcaccgctcgtcacgtgaccgtgccggctactactcatctggagacaaagatcatcggcacaggcgccattgatccagctgagcttccgtgttgtaagaacatccgcagagagagcacgaagatcctgacggagcgtgagaaggatctggtttcatctggtgttacactacctattccattaacaaatcaggccaatctttatcactttgcaacagagaaacagagcgcttgtcaataatttacctgtagtttatcagagggaacaaagacaggtgtctcccgagtacatccgtgcctgccacttttgacatgaagggcttttgacagtgagtgattgtcacagcatgataacctggtttcttgtggcctgggggcacatgaaaaactttcgtgttgttttggttgcagcttcctaggctgatatgcattgatattgttgtaatttgtttccggactaatatggatatgttgtagctcttgtgtttgaagatgtcatgtgatgtcttagctaatttataataaatttcatgtaggaattaagaggtctatttaatcctgattacacattacctcttatggttttg

SEQ ID NO: 2153 - DNA, 1637 bp, Triticum aestivum
  misc_feature (1372)..(1372): n is a, c, g, or t
cctcctccctgcccccctgcaacgctaccgccacctgccccgtcctccgtcgccgcctcccctcccctcccctacccttccctcagccgccggccaccactccgcgcctctccctaccctctatttcacggcgcgccgccccgggggggggggggctgccccgattggaggccgtcagcatggggagacaggggggggacggccatcgacactttctacctcacggaccagcagctgcgcgactcgccgtcccggaaggatgggatcgacgaggccgccgagacgaccctccgcgtctacggctgcgacctcatccaggagagcggcatcctcctcaggctacctcaagcagtgatggccacagcacaagtactgttccatcggttttactgcaagaaatcatttgcacgatttagcgctaagagagttgctgctagttgtgtttggttggctgggaaattggaggagagtccaagaagatcaaagcatattatatttgtcttccatagaatggaatgcaggagagaaaacctaccaatagaattcttggatgtattttcaacgaaatatacagagctgaggcatgatctgataaggactgaacggcatctgctgaaggagatggggtttatttgccacgttgaacacccgcacaagttcatctcgaactaccttgcaacactcgaagcccctgagctgacacaagaagcgtggaaccttgccaatgatagcttgcggacaactctttgtgtacggtttaagagtgaagtagtagcatgcggagttgtgtatgctgcagctaggaggcaccgggttcccctcccagaagagcctccttggtggacagtctttgatgctgatgaggcagcaattcaggaagtttgcagggttcttgctcacctctacagcctcccaaaggcacaatatataccagtgtataaagataatgattccttcagtgttagaagggccttggatacacacgcgtctaaggagagtccagcaagtgcctgttgctagtgataggggtactcctgtaccttcgagttctagccaggagaagaattcactggccaaggcaggacgagagaaagtgaaggaaaacagtgataccaaggataagctgttgcctgctgagctaaatgggaaaggagaccaggcagtgaattcgaagagtgacaggtcagagcctaatgtcgaccgtgcagaggaaagagaaagaagtagatcaagaggccgtgaccgtgatattaggggtagagattctgatcacgagagggagcgtgatagagccaagagacaccgttcgagagacaaaagttcaggatactcggacaaggagaaatcaaggcaccgctcgtcacgcgaccgngccggctactactcgtctggagacaaagatcatcggcacaggcgccattgattcagccgagcttccctgttgtaagaacatccgcagagagagcatgaagctcctgacgaagcgcgagaagaatttggtttcatctggtgttacactgtctgtgccattagcgaatcagtccaatctgcatcactttgcaacagagaaacagagcgcttgtcaataatttacctgtagtttatcagagggaacaaagacaggtgtctccccgagt

SEQ ID NO: 2154 - DNA, 1741 bp, Avena sativa
ccagcgattccgcttcggctctggttaaaactcgccggccatcccaccgcgcttctcccctccctcccccagccgccgggacgcgctgcctcggccgggcggacggttccggaccgattcgaggcggtaagtgagcaagggaggatatgatctatacggcgattgacacgttctacctcacggacgagcagctgcgggactcgccgtcgcggaaggatgggatcgacgaggctgccgagacgaccctccgcgtctacggctgcgacctcatccaggagagtggcatcctcctcagacttgatggccacaggacaagtactgtttcaccgtttttactgcaagaaatcatttgcacgatttagtgctaagagacttgctgctagttgtgtttggctagctgggaagttggaggagagtccaaggagatcaaagcatattatatttgtcttccacagaatggaatgcaggagagaaaacctaccaatagaatacttggatgtattttcagcgaaatattcagagctcaggcatgatctgataaggactgagcggcatctattgaaggagatgggtttcatttgccatgtcgaacaccctcacaagttcatctcgaactaccttgcaacactcgaagcccctcagctgacacaagaagcatggaaccttgctaatgatagcttgcggacaactctttgcgtacggttcaagagtgaagtagtagcatgtggagtcgtgtatgctgcagctaggagacacaaggttccactccctgaagatcctgcttggtggacagtttttgatgctgatgaggcagctattcaggaaatttgcagggttcttgcccatctctacagcctcccaaaggcacaatatataccagtgtataaagacaatgattccttcagtgttagaagggcttatgattctcaggcttctaaggagagttcagccagtgctgttgctagtgataggggtacccctatacttctagttctagccaggaaaagagttcactggccaaggcagcaccagagaaggtgaaggaaaaaagtgataaaaaggagaagtcattgcctgatgagctaaatggaaaaggagacctggcagtgaattcgaagagtgagaagtcagagtctaatgtcaaccggactgaggaaagagaaagaagcagatcgagaggacgtgaccgtgatagtaggggtagggattctgatcgcgagaaggagcgtgatagatccaagagacaccgttcgagagacaagagttcaggatactctgacaaggagaaatcaagacaccgctcatcacgagatcatggcggttactactcgtctggtgacaaagatcggcacaggcgtcattgatccagctgagcttccctgttgtacgaagatgtgtgcagagaccaccaagtgcctaatgaatcgtgagaggaatttggtttcatctcatgtgttacacatgtacatgcgactagcaagttagtccttgtctgttgtattagttgcttggaacaatttttttgtaattttgatttcgctgaaagtaacagatggcttgtagtatgagggaacaaaggcaggagatcttttgggagtggctctggcttcgtttcttgtttccagtgggccttggaaaactttggtgttgtgttgcttgcatcctgatatacacaggaaggtgtacttcaattaaggttcgggacatgtgtatattcacattattgatacggagtgctatg

SEQ ID NO: 2155 - DNA, 1389 bp, Zea mays
cacacacatgcatgaagtgcctccatccctaataaatacctatgtggcactatctgggcatcttacctgtctcctttccttctagtagacacgcatgtgaatcatgattccaaacgtttatctctgactaacactaagtctaatgtagattatacatatgattttggtataataatattcatattacactttcatataatgtcaatttcatgctcatgccaaatctaatagatgaaatattcatggtttcaaaggcaaggcgtcgcctaggcgtccaggcggccaaagaagtctaggcgtccccgtcgcctagccaagagtcagcaagagaggcaagaggggaggggaagaagcctagcagagactttggggagcgggatcggcggcgcagagcttgggggagtgccgagctcgggggagcagcagtgctgagactcgggggagcgctgagcttgggggagcaggagcagcgatgttgtgacaggagtggcaatgctccaccatgaagatagcctggggtaagaaatctaaggttaagaagcagtcagtggttgtatcaactataccaggcctaccatttggagcggggagtgacaacgatgaggttgaaacggaggaaaaatcagatgcaaacacaaactgtcctggaacaaagccagttgaaactgctgagttgctccagagtcagggagacaagctagccgaggaagggaagtaccatgaagcacttgctaaatgggaggctgctctgatcttgatgcctgataatgcgatacttcatgagcagaaagctcaggttttacttgaagtgggagatgcatggcgtgcactgacagcagcaaccagagcaacagaactggatccattttggcctgaggcttgggttacacttggtagagctcaattaaattttggggagccagattcagctatactgacttttgacaaggcgttagctatgaagcctgactacaccgacgcaaaagctgaccgtgaaactgctgctcgcctagtcaagaaacgaggacagctgcatacgtcaggtttaagtgctaacaaaagacgcttcacagttggggagtacccaaaggagggaggtgcagagggtgaagaaaaagggaaagaaacagccgagcaactccaaaagatcacccaagaaaattagctaaattaactgattttgttactgtgtaaaatagatattacaaaaaaatattacattagtgttggtcacctgctttaattcgtaaagggaaccataacaaggcaatacaattaaagataatcggccttcgttttcctaatctatctaatagataaattaagggaggaggattatggtaatccaagaccttcgaataataaaataggaatgtctgatgagaatca

SEQ ID NO: 2156 - DNA, 1316 bp, Zea mays
agtccaccggcatttggaacttgttcgcgagtcgcgactcgcccagccgccccttccgagttccgacgccgataccgtgactccgctcgctccattccgctcctaccgccgctggccgccgcaccattcgatccctgtttcttaatccggcggccggcctggagccctcagctcaacactcggcagatcatctcggctgttcgcctactttcttcttccccacggtcgttcgcgtgcagcacggccggcggtaccggaacagggcccagccggagcagcggtgccgtcccggcccggctgccttttgctactgctaacatcccaggacgcagtccggaagctgtagctcctttccggtggtctggtcttcacggttctactcctattcgtctgcttcaatccagctgcgtcatctaatttatgctccaccatgaagatagcctggggtaagaaatctaaggttaagaagcagtcagtggttgtatcaactataccaggcctaccatttggagcggggagtgacaacgatgaggttgaaacggaggaaaaatcagatgcaaacacaaactgtcctggaacaaagccagttgaaactgctgagttgctccagagtcagggagacaagctagccgaggaagggaagtaccatgaagcacttgctaaatgggaggctgctctgatcttgatgcctgataatgcgatacttcatgagcagaaagctcaggttttacttgaagtgggagatgcatggcgtgcactgacagcagcaaccagagcaacagaactggatccattttggcctgaggcttgggttacacttggtagagctcaattaaattttggggagccagattcagctatactgacttttgacaaggcgttagctatgaagcctgactacaccgacgcaaaagctgaccgtgaaactgctgctcgcctagtcaagaaacgaggacagctgcatacgtcaggtttaagtgctaacaaaagacgcttcacagttggggagtacccaaaggagggaggtgcagagggtgaagaaaaagggaaagaaacagccgagcaactccaaaagatcacccaagaaaattagctaaattaactgattttgttactgtgtaaaatagatattacaaaaaaatattacattagtgttggtcacctgctttaattcgtaaagggaaccataacaaggcaatacaattaaagataatcggccttcgttttcctaatctatctaatagataaattaagggaggaggattatggtaatccaagaccttcgaataataaaataggaatgtctgatgagaatc

SEQ ID NO: 2157 - DNA, 1096 bp, Panicum virgatum
ggccatctgccatctcccatggtcggtcgcatttcctcggtggctcgtcccaaccggctgctttgagcggaacgatccgttctcctactccaagactacaatccatccacaatgaagataacctggggtaagaatgccaaaatgaagaggcagccagtgctagtgtcaactaaaccaggtctaccatttggagtggacagcgataccgatgaggctgacaaggaggaaacagcaggggctagcacaaactgtcctggaacaaagccacttgacacagctgaatcgctccagcgtcaaggagacaagctagctgaggaaggaaagtaccatgaagcacttagtaggtgggaggctgcacttaccttggcacctgacaatgcaatacttcacgaacagaaagctcaggttttacttgaagtgggagatgcatggcatgcactgacagcagcaaccagagcaacagagctggatcctctatggcccgaggcttgggtcacacttggtagagcacagttaaattttggggaaccagattcagctatactatcatttgacaaggcactagtaattaagcccgaccatgatggtgcgaaagctgaccgcgaaactgcagtccgtcttgtcaagaaacgagggcagctgcactcatcaggtctaagcaccaacaaaaggaggttcacggttggagagaactcagttaagggcgccgagggtaaagagaaggcggatgaaacagcggtacagtctggttagcctgctacatgttggctttctatcatcctggggctagtgctttagagtagaactggctaaaatgagggttaacatacaaggatttctggcctctgcctcatattttcgcatatcaggattctgagttgggttctgttgaaattttgtgccgctctgtggaactttgttagagccttaagaggtatgttgtagggatttagacgtttattattatgaagctatgtggttgattgtgaatatatacgggtagatcgtgtccggcacaatgctattgtcatggtacaaagtgtacaacaatataaccgactgttaaacttggtaccaatccctcggttccgtttgt

SEQ ID NO: 2158 - DNA, 1082 bp, Panicum virgatum
ggtgccatctgccatagtcggtcgcctttcctcggtggctcgtttgctttcgcccgagccctggagtcctgaatcctgatcctgactcgtcccaaccggcaaggcggaacctgctgcttcgagcggaacgatcagtttgggaaatcgccggcgctagccatacactccgttctcctactccagtccatccacaatgaagatagcctggggtaagaatgccaaaatgaagaggcagccagtggtagtgtcaactaaaccagggctaccatttggagtggacagcgataccgatgaggctgaaaaggaggaaacagcaggggcaaacacaaactgtcctggaacaaagccacttgacacagctgaatcactccagcatctaggagacaagctagctgaggaaggaaagtaccatgaagcactttgtaggtgggaggctgcacttaccttggcacctgacaatgcaatacttcacgaacagaaagctcaggttttacttgaagtgggagatgcatggcatgcactgacagcagcaaccagagcaacagaactggatcctctatggcccgaggcttgggtcacacttggtagagcgcagttaaattttggggaaccagattcagctatactatcatttgacaaggcactagtaatcaagcacgaccatgatggtgcgaaagctgaccgtgaaactgcagtccgtcttgtcaagaaacgagggcagttgcactcatcaggtctaagcaccaacaaaaggaggttcacggttggagagaactcagttaagggcgcagagggtgaagaaaaggcggatgaaacagcggtaccgtctggttagcctgccacatatgttggctttctttcatcctggggctagtgctttagagtagaactggctaaaatgagggttaacatgtaaggatttctggcttccggcgcatattttcgcatgtcaggattctaagttgggttctgtcgaagttttgtgccgctctgtggaagtttgtgccgctgtaggtagacgattattgttatgaagctctgtggttgattgtgaatatacgggtaggtcggcgagacttcgc

SEQ ID NO: 2159 - DNA, 1372 bp, Setaria italica
ctccaaaatgaagatagcctggggtaagaatgccaagacgaagaggcagccagtggtagtgtcaactaaaccaggcctaccatttggagtggagagtgacaccgaagaggccgaaaaggatgaaactgcaggggcaaacacaaactgtcctggagcaaagccacttgacactgctgagtcgctccagcatcaaggagacaagctagccgaggaagggaagtaccatgaagcacttagtaggtgggaggctgctcttaccttggcacctgataatgcagtactttatgaacagaaagctcaggttttactcgaagtgggagacgcatggcatgcactgacagcaggaaccagagcaacagaactggatccgctatggcccgaggcttgggtcacacttggtagagcacagttaaattttggggagccagattcagcaatactatcatttgacaaggcactagcaatcaagcccgaccacgatgacgcgaaagccgaccgtgaaactgcagctcgccttgtcaagaagcgagggcagctgcactcatcaggtctaagcgctaacaaaaggcggttcactgttggagagaaagagaactcagataacggcgcagagggtgaagaaaaggcggatgaaacggcggtacagtctgtccacgctcgaaagaagcggcacctggaatcgggaacgcttgagaaatcgaagatgtgggggaaggggaagaagcgcttcggcggcgggggcgggagcgagccggcggccaagcgccaggccgccggggacgaggggccctctgaatccgccgaagacggcaccgtagtggccgagatatcgaagaataagaaggtgtcggtgaggagctggaagggcaaggtctacgtcgacatgcgcgagttctacaccaaggacggcaagaccctccccaccaagaaaggtatatcactccaattggatcagtggaaaatattgagggacaacatcaaagccatagatgaggccatcaaggagaacgcatgacggcagcggtcgaactgatcataggggcaagcttttggctgatgtattcttgtaggtcctaggctggtttttgttgcccctgtgctgcaggctgctgcaggcctaatgttgcgcgcgcgcttgatcacgggttgttaattaggtggccacatggcagaatggtttggttttctgccccctgtgtgccctgtagtctgcactttggacatccagatgatgtaatgtcatgtctccttacgtgtgattggctccccacctgtttatgggctcggtccctcgggatcatccgagccatgtgtttcttcttcaattcttctgcaatctgcagcacagccattcgacgagcaaagatgacat

SEQ ID NO: 2160 - DNA, 862 bp, Saccharum officinarum
aggaaaaatcagatgcaaacacaaactgtcctggaacaaaaccagttgaaactgctgtgttgatccagagtcagggagacaagctagctgaggaagggaagtaccatgaagcacttgctaaatgggaagctgcgcttatcttgacacctgatagtgcaatacttcatgagcagaaagctcaggttttacttgaagtgggagatgcatggcgtgcactgacagcagcaaccagagcaacagaactggatccattttggcctgaggcttgggttacacttggtagagcacagttaaattttggggagccagattcagctatactgacttttgacaaggcgttagctatcaagcctgactacaacgacgcaaaagctgaccgtgaaactgctgctcgtctagtcaagaaacgagggcagctgcatacatcaggtttaagtgctaacaagagacgcttcacagttggggagtacccagagaagggtgcagagggcgaagaaaaagggaaagaaacagctgtatagttcagttagtctgctcccttttaatcccggtatggctggcctagaatggatggagcgcatgtaaagatgtactcgtaaccgtttcaggattctgctccaattttgcatgtcaggattctggatttctgagctgctcggttgtgacaaagctgtatcatggctctgcgaacatatatatttagagggagatgtatatagaggtctagaagtgagtgtcgtgaagccgtgtggtctttgtgcatattctgtgagccctgtgctaatgtcgcctcgtggcccggctttattatctgtctgctgactacttacgagtacttttaatgaacgaacatgtttctctt

SEQ ID NO: 2161 - DNA, 1142 bp, Setaria italica
ctttcgccgagtcccggagtcctcaactcctgatcctgactcgtcccaaccggccaggcggaacctgctgcttcgagcggaagaatccaacgatcaactcgggagactccggagctactccaatccctccaaaatgaagatagcctggggtaagaatgccaagatgaagaggcagccagtggtagtgtcaactaaaccaagcctaccatttggagtggagagtgacaccgaagaggccgaaaaggatgaaactgcaggggcaaacacaaactgtcctggagcaaagccacttgacactgctgagtcgctccagcatcaaggagacaagctagccgaggaagggaagtaccatgaagcacttagtaggtgggaggctgctcttaccttggcacctgataatgcagtactttatgaacagaaagctcaggttttactcgaagtgggagacgcatggcatgcactgacagcaggaaccagagcaacagaactggatccgctatggcccgaggcttgggtcacacttggtagagcacagttaaattttggggagccagattcagcaatactatcatttgacaaggcactagcaatcaagcccgaccacgatgacgcgaaagccgaccgtgaaactgcagctcgccttgtcaagaagcgagggcagctgcactcatcaggtctaagcgctaacaaaaggcggttcactgttggagagaaagagaactcagataacggcgcagagggtgaagaaaaggcggatgaaacggcggtacagtctggttagcctgctacatatgcctttcatcctgggcccagtatactgtagaattgactaaaacgagttctggattctgcccccattttcgcattctgaattgggttctgcggaagctttgtgccggtctctgtagctatgttggaggagcagtgctgtagtctagattctaaagacgagtgctcttacgctgtttggtggtttgtgaatatacagttggtcgtgtcatgtgtcacggtggcccaggttgcgacaatctctcagtttaacttggtaacaatctctcagttccgtttgtaaactctccttgcggctaaacttgtactaccagctctttcttgaaaagatttctacggaaggcgacaaggaa

SEQ ID NO: 2162 - DNA, 762 bp, Saccharum officinarum
ccggcaaaaacgaagcagaggccaggcacgcgccagcgcgagcgataaggcactggacatggccgccaccacggcgtactccaccgcgcttctcggcggggcgcgcctccccgctgccggagccgccgcgccgccctccgccctcctcctcccgcggcgtaacctgctgtctccgctccctctccggctccaagatgctgctgcgccgaggctgtcgctgctccgggtgaaggcctcctccgacgactcctcggccgcgagcggggacgagctcatcgccgacttgaaagccaagtgggacgccgtcgagaacaagagcactgtcctcacctacgccggcggcgccgtcgtcgctctctggctgacgtccgacatcgtcggcgccatcaactccgtgcctctgctccccaagatcatggagctagtcggcctcggctacaccggatggttcgtttaccgctaccttctcttcaaggaaagcaggaaagagctcgccgacgacatcgagtcactcaagaaaaagattgctgggacagagtaaaatgtggttctcttgaatgttttttttttggacaattctttcgagaacacgcgtcgcctcctgtctagactccagagtgctacttgtctttgcacttggaatactgtttgtccttggtgtccagcagatagctttgtacgatgatggagaataacaatgtttgtacaaactggacaccctcggggaatgtcttcttaaaatgaaggaatcgggtatccagg

SEQ ID NO: 2163 - DNA, 752 bp, Saccharum officinarum
  misc_feature (53)..(53): n is a, c, g, or t
  misc_feature (340)..(340): n is a, c, g, or t
  misc_feature (372)..(372): n is a, c, g, or t
  misc_feature (732)..(732): n is a, c, g, or t
  misc_feature (751)..(751): n is a, c, g, or t
ccggcaaaaacgaagcagaggccaggcacgcgccagcgcgagcgataaggcantggacatggccgccaccacggcgtactccaccgcgcttctcggcggggcgcgcctccccgctgccggagccgccgcgccgccctccgccctcctcctcccgcggcgtaacctgctgtctccgctccctctccggctccaagatgctgctgcgccgaggctgtcgctgctccgggtgaaggcctcctccgacgactcctcggccgcgagcggggacgagctcatcgccgacttgaaagccaagtgggacgccgtcgagaacaagagcactgtcctcacctacgccggnggcgccgtcgtcgctctctggctgacgtccgncatcgtcggcgccatcaactccgtgcctctgctccccaagatcatggagctagtcggcctcggctacaccggatggttcgtttaccgctaccttctcttcaaggaaagcaggaaagagctcgccgacgacatcgagtcactcaagaaaaagattgctgggacagagtaaaatgtggttctcttgaatgttttttttttggacaattctttcgagaacacgcgtcgcctcctgtctagactccagagtgctacttgtctttgcacttggaatactgtttgtccttggtgtccagcagatagctttgtacgatgatggagaataacaatgtttgtacaaactggacaccctcggggaatgtnttcttaaaatgaaggaatng

SEQ ID NO: 2164 - DNA, 1684 bp, Zea mays
gccacggctacccgatcgcgcgccgcgccacggagcaccacacgatccccgacgcaaacctgctacacaaagaaaaaaaaaaacagaacgagccttcacttccgttcccctggccggcctggccccgtcctctgttccagcgttcgccgccgctctgcacgagccctgcctaccgatgtccgtcgcgtccgtggccgccctccggacggccggctccggccgccgccgcggcgcgggttcccagcagaccggccttaacgggggcaggttcctgatgatgcagaggagggagctggtgaccaaggccgggatcgcgctcgccgtctcctgctcgatggctacctcacccgcttcagccaacggcgctgctcaagggctggagattttgccgttcaaagctgacgggtacaacttctggacgtggcggggtcgccggatacactacgtcgagcaaggcgcggggcggcccgtcgtgctcatccacggcttcggcgcttccgccttccactggaggtacaacatccctgagctggccaagaagtacaaggtgtacgccatagacctgctggggttcggctggagcgagaaggcgctggtggactacgaggccaccatctggatggagcaggtctccgacttcctccgggagatcgtcaaggaaccagccgtccttgtaggcaacagcttgggaggcttcacgacgctgttcacggccaccgaggtgccggagctggtccggggcgtcgtgctcctcaactccgccggccagttcgccgaccccaacaagccggccgccgcgccggccgaggaggaggaggggggcagcgcgctgtccaggtacatcgtgcagccgctcaaggaggccttccagcgggtggtgctggggctcctcttctggcagtccaagcagcccgccagggtcgagaaagtcttgaaaagcgtgtacatagatcccagcaacgtcgacgactacctggtcggctccatcacggcgccggcggcggaccccaacgccggcgaggtgtactacaggctgatgtcgcggttcatgtcgaaccagagccggtacacgctggaccggctgctggggaagatgtcgtgcccgctgctgctgctgtggggcgacctggacccgtgggtcggcccggccaaggccgcgcggatccaggagttttacgccgacaccgccgtcgtgcacctgcaggccggccactgcccgcacgacgaggcgccggagcaggccaaccgcgcgctgctcgagtggctcgcggccctcgacgcccgcgctaagtcggccgagcccagcctacagaccgtctgatggatcgagcgcaaggggcttagcgtatgctagtcaaagaatacaatttggtggcctatatctatagtttgatgtagtatgtcctgtagtaggaacagtaatttcttactgtgagttagtttactgttctacagctgttgcacccgtttgatgtagttatagatgaccaataagcacgaggcccgcgagcccggcacgaggcccgcgagcccggcacgaagcccactgtttagcctcgatccgagtccggcacggcacggttctatgcaggcccgggccgggctcggacaggaaactaggcacggtgggctagtccggcacggcccgtttaactctaagcccgttaagcccgctttttgcact

SEQ ID NO: 2165 - DNA, 1634 bp, Zea mays
cccgacgcaaacctgctacacaaagaaaaaaaaaaacagaacgagccttcacttccgttcccctggccctggccccgtcctctgttccagcgttcgccgccgctctgcacgagccctgcctaccgatgtccgtcgcgtccgtggccgccctccggacggccggctccggccgccgccgcggcgcgggttcccagcagaccggccttaacgggggcaggttcctgatgatgcagaggagggagctggtgaccaaggccgggatcgcgctcgccgtctcctgctcgatggctacctcacccgcttcagccaacggcgctgctcaagggctggagattttgccgttcaaagctgacgggtacaacttctggacgtggcggggtcgccggatacactacgtcgagcaaggcgcggggcggcccgtcgtgctcatccacggcttcggcgcttccgccttccactggaggtacaacatccctgagctggccaagaagtacaaggtgtacgccatagacctgctggggttcggctggagcgagaaggcgctggtggactacgaggccaccatctggatggagcaggtctccgacttcctccgggagatcgtcaaggaaccagccgtccttgtaggcaacagcttgggaggcttcacgacgctgttcacggccaccgaggtgccggagctggtccggggcgtcgtgctcctcaactccgccggccagttcgccgaccccaacaagccggccgccgcgccggccgaggaggaggaggggggcagcgcgctgtccaggtacatcgtgcagccgctcaaggaggccttccagcgggtggtgctggggctcctcttctggcagtccaagcagcccgccagggtcgagaaagtcttgaaaagcgtgtacatagatcccagcaacgtcgacgactacctggtcggctccatcacggcgccggcggcggaccccaacgccggcgaggtgtactacaggctgatgtcgcggttcatgtcgaaccagagccggtacacgctggaccggctgctggggaagatgtcgtgcccgctgctgctgctgtggggcgacctggacccgtgggtcggcccggccaaggccgcgcggatccaggagttttacgccgacaccgccgtcgtgcacctgcaggccggccactgcccgcacgacgaggcgccggagcaggccaaccgcgcgctgctcgagtggctcgcggccctcgacgcccgcgctaagtcggccgagcccagcctacagaccgtctgatggatcgagcgcaaggggcttagcgtatgctagtcaaagaatacaatttggtggcctatatctatagtttgatgtagtatgtcctgtagtaggaacagtaatttcttactgtgagttagtttactgttctacagctgttgcacccgtttgatgtagttatagatgaccaataagcacgaggcccgcgagcccggcacgaggcccgcgagcccggcacgaagcccactgtttagcctcgatccgagtccggcacggcacggttctatgcaggcccgggccgggctcggacaggaaactaggcacggtgggctagtccggcacggcccgtttaactctaagcccgttaagcccgctttttgcact

SEQ ID NO: 2166 - DNA, 1392 bp, Saccharum officinarum
  misc_feature (394)..(394): n is a, c, g, or t
  misc_feature (519)..(519): n is a, c, g, or t
  misc_feature (540)..(541): n is a, c, g, or t
  misc_feature (560)..(561): n is a, c, g, or t
  misc_feature (563)..(563): n is a, c, g, or t
  misc_feature (583)..(583): n is a, c, g, or t
  misc_feature (592)..(593): n is a, c, g, or t
  misc_feature (624)..(624): n is a, c, g, or t
  misc_feature (714)..(714): n is a, c, g, or t
  misc_feature (776)..(776): n is a, c, g, or t
  misc_feature (778)..(778): n is a, c, g, or t
  misc_feature (790)..(790): n is a, c, g, or t
  misc_feature (853)..(854): n is a, c, g, or t
  misc_feature (1024)..(1024): n is a, c, g, or t
  misc_feature (1083)..(1083): n is a, c, g, or t
  misc_feature (1276)..(1277): n is a, c, g, or t
  misc_feature (1284)..(1284): n is a, c, g, or t
  misc_feature (1290)..(1290): n is a, c, g, or t
  misc_feature (1292)..(1292): n is a, c, g, or t
  misc_feature (1321)..(1321): n is a, c, g, or t
  misc_feature (1327)..(1327): n is a, c, g, or t
  misc_feature (1331)..(1331): n is a, c, g, or t
  misc_feature (1341)..(1341): n is a, c, g, or t
  misc_feature (1384)..(1384): n is a, c, g, or t
ccttggccccgtcctctgttaccagcgtttccgccgctctccagaagctctgcctacccgatgtccgtcgcgtccgtggccgccctccggacggccggctccggccggtgccgtggcgcgggttccccgcaggccggccttaacgggggcaggttcttgatgatgcagaggagggagctggtgaccaaggccgggatcgcgctcgccgtctcctgctcgatggcaacttcttcagcctcggccaacggttctgctcaagggctggagattttgccgttcaaagcggacgggtacaacttctggacgtggcggggacgccggatacactacgtcgagcaaggcgccgggcagcccatcgtgctcatccacggcttcggcgcttccgccttccacntggaggtacaacatccctgagctggccaagaagtacaaggtgtacgccatagacctgctggggttcggctggagcgagaaggcgctggtggactacgaggccaccatctggatggagcaggtctncgacttcctccgggagatcgnnaaggagcctgccgtccttnnangcaacagcttgggaggcttnacgacgctnntcacggcgaccgaggtgccggagctggtccngggcgtcgtgctcctcaactccgccggacagttcggggaccccaacaaaccggccgccgcgccggccgacgaggaggacgaggagggcancccgctgtccacgttcatcgtgaagccgctcaaggaggccttccagcgggtggtcctgggtntnctcttctggcantccaagcagcccgccagggtcgagaaagtcttgaaaagcgtgtacatagactccagcaatgtnnacgactacctggtcggctcgatcacggcgccggcggcggaccccaacgccggcgaggtgtactacaggctgatgtcgcggttcatgtcgaaccagagccggtacacgctggaccggctgctggggaagctgtcgtgcccgctgctgctgctgtggggggacctggacccntgggtcggcccggccaaggccgcgcggatccaggagttctacgccgacaccgccgtcgngcacctgcaggctggccactgcccgcacgacgaggcgccggagcaagccaaccgggcgctgctcgagtggctcgcggctctcgacgcccgcgccaagccggccgagcccagcctccagaccgtctgactctgatcgatcaggcgtcaggggcttagcgtacatacactagtcaaagaatacaatttgggtggnncatgtgncagtgnancatgtcttgtacggagtagaacactagtnaattcntacngtgattcccnaggagcaagagcattcgtggagttgggttctcgaacgaccgtngtagactt

SEQ ID NO: 2167 - DNA, 1002 bp, Zea mays
cacatcctgcttactgcccacaagaaagaagctagggaaacccgggggatcggaggactgaggagaggcagaaaacagaaggcccggctgcggctgcggctgcggctgcctttggtttcgtcgtcgtctccgcctgttttcccctctttccatggcaggctgatgctcttcaacacacacagtccactgtcgctcctcagttataagtagctagggcatctggctgctggaaaatcaagcacgcatccaccacacacacagctagctagcagatcgtttcgagtgaagatccaaagaggtagagagatggaaaggatgagttcgtcgctgcagtactgggtggaggagcacaagctctcaaccatcggagccgtgtgggcgacggcggtgggcgcgtcggtggcgtacagccggcggcgggcgccggcgcgggcgacgggcatgcgcctcatccacgccaggatgcacgcgcaggcgctcacgctcgccgtcctcgggggagccgcgctcgcgcaccactaccacggcaagagcaccaacgccgggaagaggcagcagcaggaggacctggactacggcttctactcgcagctgccgccggccaccgacgccgacggcaacgagaacgagcgctggagctggtagagcatgctgcatcgggacaagaacaagacagcagcgagaagaaagaaaaaacaataaattagtagcaataattggtgggtggtttggcatttggcaatgatgcgtgacgtggcgcctgcaggctttcttggtcctaatcctaatcctaatcctaatcccaatccatccagctaagacgtccacgcccgtggttttgtcctgttgatttgccaccggagacgacgatgcagcgcttgctctttgatttccatggcttattatcgatcagcctccgattcttctcctgcactactactacttgtaccatttcatctattgattgaatgaatggtcacgatgatgacgataattatgttt

SEQ ID NO: 2168 - DNA, 827 bp, Saccharum officinarum
  misc_feature (767)..(767): n is a, c, g, or t
  misc_feature (770)..(770): n is a, c, g, or t
  misc_feature (820)..(820): n is a, c, g, or t
gggggagcctctggtttcgtcgtcgtctccgcccgttttcccccttctccatggcataggcaaggcagggtgcttgaacacacgcactccactctcgtcagccataagcctatataagtaggtcacctgcttgcagcaatccatccatccctgcaatcaagcaagagcatacaccaaatccaacacacagcagcctccgattccggcacccatcatcagcagacccgtttcgagggtagatccgttgatcgaatcgcagatcgagagatggagaggatgagctcgtcggtgcagtcctgggtggaggaacacaagctctcaaccatcggagccgtgtgggcgacggcggtgggcgcgtcggtggcgtacagccggcgccgggcgccggcgcgggcgaccagcctgcgcctcatccacgccaggatgcacgcccaggcgctcacgctcgccgtcctcggcggagccgcgctcgcgcaccactactacggcaactccggcagcagcaagaagacgcagcaggaggacctggactacggcttctactcccagctgccgccggccaccgacgccgacggcaacgagaacgagcgctggagctggtaacaccggagcagcagctttcacttcacttggtctggagaagatactagcaagaagacagaggaacaaacaataaattagtagcaataattggtggttagcaatgatgcgtgacgtggcgcctggctttcttcgtcctaatcctaatccatccagccaagacgttncangcccgtggtttcgtttactttacattatccatcccatcaatccatgattncatgtct

SEQ ID NO: 2169 - DNA, 557 bp, Saccharum officinarum
ctgcaatcaagcacgcatccaccaaatccaaacacacagatagctagcagaccgtttcgagggaagatcaccgtcgatcgaatcgaatcgaatcgaagatcgagggaggaagggagagatggaaaggatgagctcgtcggtgcagtcgtgggtggaggaacacaagctctcaactatcggagctgtgtgggcgacggcggtgggcgcgtcagtggcgtacagccggcgccgggcgccggcgcgggcgaccagcctgcgcctcatccacgccaggatgcacgcccaggcgctcacgctcgccgtcctcggcggagccgcgctcgcgcaccactactatggcaactgcggcagcagcaagaagaggcagcaggaggacctggactacggcttctactcccagctgccgccggccaccgacgccgacggcaacgagaacgagcgctggagctggtaacaccggagcagtagctttcacttcacttgggagaagatactagccagaagacagaggaaccaacaataaattagtagccataattggtggttagcaatgatgc

SEQ ID NO: 2170 - DNA, 742 bp, Saccharum officinarum
cacctggctgctgctaccaccaatccatccatccatccatccctgcaatcaagcacgcatccaccaaatccaagcacacagatagctagcagaccgtttcgagggaagatcaccgtcgatcgaatcgaatcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgccggcgcgggcgaccagcctgcgcctcatccacgccaggatgcacgcccaggcgctcacgctcgccgtcctcggcggagccgcgctcgcgcaccactactacggcaactccggcagcagcaagaagaggcagcaggaggacctggactacggcttctactcccagctgccgccggccaccgacgccgacggcaacgagaacgagcgctggagctggtaacaccggagcagcagctttcacttcacttggtctggagaagatactagcaagaagacagaggaacaaacaataaattagtagcaataattggtggttaccaatgatgcatgacgtggcgcctggctttcttcgttctaatcctaatccatccagccaagacgttccaggcccgtggtttcgtctactttacattatccatccacatcaatccatgtcgattcggcccgcggcattcattcgagttgcaggag

SEQ ID NO: 2171 - DNA, 943 bp, Saccharum officinarum
ggagcctctggtttcgtcgtcgtctccgcccgttttcccccttctccatggcataggcaggcagggtgttcgaacacatacactccactccgtcagctataagtaggtcacctggctgctgctaccaccaatccatccatccatccctgcaatcaagcacgcatccaccaaatccaaacacacagatagctagcagaccgtttcgagggaagatcaccgtcgatcgaatcgaatcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgccggcgcgggcgaccagcctgcgcctcatccacgccaggatgcacgcccaggcgctcacgctcgccgtcctcggcggagccgcgctcgcgcaccactactacggcaactccggcagcagcaagaagaggcagcaggaggacctggactacggcttctactcccagctgccgccggccaccgacgccgacggcaacgagaacgagcgctggagctggtaacaccggagcagcagctttcacttcacttggtctggagaagatactagcaagaagacagaggaacaaacaataaattagtagcaataattggtggttaccaatgatgcgtgacgtggcgcctggctttcttcgtcctaatcctaatccatccagccaagacgttccaggcccgtggtttcgtttactttacattatccatccacatcaatccatgattccatgtttatccgggcgggggcatccatcggaggtgcaggagcccgcccatggttttctcctgttgggttgctaccggaatctgcggggacgacgatcgatccagtgctcaacagcttggttttccatggg

SEQ ID NO: 2172 - DNA, 1065 bp, Zea mays
agagccctgaaggtttgaaattttaattaacgattcttgtttgtttgggtccaaattgcacttgtaaatgatggcaatccagcgaattcgtaacctgggtacgtgctgccaccacgccaacagaaaggggagtggcctacggcggccgtgcgtgcccacaagaagctagggaaaccgggggagaaacggaaggccggggcgcctctggtttcgtcgtctccgcccgtttgtttccccctcttccatggcgtggcaggcagggtcatctcggcacctggctggctataagtagctcacctggctgcatccatcactgcaatcaagcacgcatccacgaaatccaagagcagcagcagcagcagaccaagatcgagggagggaggaagacagacagacagacagagagatggagcggatgagctcgtcggtgcagtcctgggtggaggaacacaagctctcgtccatcggagccgtgtgggcgacggcggtgggcgcgtccgtggcgtacagccggcggagggcgccggcgcgggccacgagcctgcgcctcatccacgccaggatgcacgcccaggcgctcacgctcgccgtgctcgggggagccgcgctcgcgcaccgctattacggcagcagcgagaggaggcagaggcaggaggacctggactacggcttctaatcccagctgccgccggccaccgacgccgagggcaacgagaacgagcgctggagctggtagtggcagggcagactagcagtgagtgaccagtgagccttcagatgcatacatcagatcagagagaaggaaggaagagggacaataaatagattaattagtactagtagcaataataataattgcatgcctgtttgccaatcaatgatacatgacgtggcgcctgatcctgttcgtcacggcccataaacccaggaagcagctagcccatgtatgtgtggcctgttatgcgttaccgtacttcgttttcactcgttaatagtactctagatttcaaaaaaaaaagtcccattttttgtaatccctgtttatagtacttttatagagagaga

SEQ ID NO: 2173 - DNA, 1064 bp, Zea mays
agagccccgaaggtttgaaattttaattaattaacgattcttgtttgtttgggtccaaattgcacttgtaaatgatggcaatccagcgaattcgtaacctgggtacgtgctgcggccaccacgccaacagaaaggggagtggcctacgccggccgtgcgtgcccacaagaagctagggaaaccggggagaaacggaaggccggggcgcctctggtttcgtcgtctccgcccgtttgttcccccctcttccatggcgtggcaggcagggtcatctcggcacctggctggctataagtagctcacctggctgcatccatcactggcacgcatccgcgaaatccaagagcagcagcagcagcagaccaagatcgagggagggaggaagacagacagacagacagagagatggagcggatgagctcgtcggtgcagtcctgggtggaggaacacaagctctcgtccatcggagccgtgtgggcgacggcggtgggcgcgtccgtggcgtacagccggcggagggcgccggcgcgggccacgagcctgcgcctcatccacgccaggatgcacgcccaggcgctcacgctcgccgtgctcgggggagccgcgctcgcgcaccgctattacggcagcagcgagaggaggcagaggcaggaggacctggactacggcttcaaatcccagctgccgccggccaccgacgccgagggcaacgagaacgagcgctggagctggtagtggcagggcagactagcagtgagtgaccagtgagccttcagatgcatacatcagatcagagagaaggaaggaagagggacaataaatagattaattagtactagtagcaataataataattgcatgcctgtttgccaatcaatgatacatgacgtggcgcctgatcctgttcgtcacggcccataaacccaggaagcagctagcccatgtatgtgtggcctgttatgcgttaccgtacttcgttttcactcgttaatagtactctagatttcaaaaaaaaaagtcccattttttgtaatccctgtttgtagtacttttagagagagaga

SEQ ID NO: 2174 - DNA, 985 bp, Saccharum officinarum
ctatataagtaggtcacctgctttcagcaatccatccatccatccctgcaatcaagcaagcaagcgtccaccaaatccaaacacagcagcctccgattccggcatccatcatcagcagacccgtttcgagaaagatccgtccatccaatcgaagatcgagctagggaggaagagagagagatggagaggatgagctcgtcggtgcagtcctgggtggaggaacacaagctctcaaccatcggagccgtgtgggcgacggcggtggtcgcgtcggtggcgtacagccggcgccgggcgccggcgcgggcgaccagcctgcgcctcatccacgccaggatgcacgcccaggcgctcacgctcgcagtcctcggcggagccgcgctcgcgcaccactactacggcaactccggcagcagcaagaagaggcagcaggaggaccttgactacggcttctactcccagctgccgccggccaccgacgccgacggcaacgagaacgagcgctggagctggtaacaccggagcagcagctttcacttcacttggtctggagaagatactagcaagaagacagaggaacaaacaataaattagtagcaataattggtggttaccaatgatgcgtgacgtggcgcctggctttcttcgtcctaatcctaatccatccaaccaagacgttccaggcccgtggttttgtttacttgacattatccattcacatcaatccatgtcgatcctgccggcggcatccatcggagttgcaggagcccgccggccccggcccatggttttttcttgttggtttgcaaccggagtttccggggacgaagaccgatcccgtgttcagcagcttgtatttccatgggcgctatcagaattttgtttgttgccttcgggatttttttcctgtacacctgtactgctttagcttgtaccatttcatttattggtttaatggtcaccatgaatgacgacaattatgttt

SEQ ID NO: 2175 - DNA, 763 bp, Saccharum officinarum
  misc_feature (673)..(673): n is a, c, g, or t
atccaccaaatccaagcacacagatagctagcagaccgtttcgagggaagatcaccgtcgatcgaatcgaatcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgccggcgcgggcgaccagcctgcgcctcatccacgccaggatgcacgcccaggcgctcacgctcgccgtcctcggcggagccgcgctcgcgcaccactactacggcaactcaggcagcagcaagaagaggcagcaggaggacctggactacggcttctactcccagctgccgccggccaccgacgccgacggcaacgagaacgaccgctggagctggtaacaccggagcagtagctttcacttcacttggtctggagaagatactagcaagaagacaggaacaaacaataaattagtagcaataattggtggttagcaatgatgcgtgacgtggcgcctggctttcttcgtcctaatcctaatcctaatccatccaaccaagacgttccaggcccgtggtttcgtttactttacattatccatccacatcaatccatgattccatgtttatccggccggnggcatccatcggaggtgcaggagcccgcccatggttttctcctgttggtttgctaccggaatctgcggggacgacgatcgatccagtgct

SEQ ID NO: 2176 - DNA, 899 bp, Saccharum officinarum
  misc_feature (688)..(688): n is a, c, g, or t
  misc_feature (694)..(694): n is a, c, g, or t
tcaagcaagcaagcatacaccaaatccaaacacagcagcctccgactccggcatccatcatcagcagacccgtttcgagggaggaagagagagagagagagatggagaggatgagctcgtcggtgcagtcctgggtggaggaacacaagctctcaaccatcggagccgtgtgggcgacggcggtgggcgcgtcggtggcgtacagccggcgccgggcgccgacgcgggcgaccagcctgcgcctcatccacgccaggatgcacgcccaggcgctcacgctcgccgtcctcgggggagccgcgctcgcgcaccactactacggcaactccggcagcagcaagaaggggcagcaggaggacctggactacggcttctactcccagctgccgccggccaccgacgccgacggcaacgagaacgagcgctggagctggtaacaccggagcagcagctttcacttcacttggtcgggagaagatactagcaagaagacagaggaacaaacaataaattagtagcaataattggtggttagcaatgatgcatgacgtggcgcctggctttcttcgtcctaatcctaatccatccagccaagacgttccaggcccgtggtttcgtttactttacattatccatccacatcaatccatgattccatgtctatccggccggcggaatccatcggagntgcagnagcccgcccatggttttctcttgttggtttgctaccggagtctccggggacgacgatcggtccagtgctcagcagcttgtatttccatggcgctatcagacttctgcttgttaccttcgggattcttctcctgtacttgtactacttagcttgtaccatttcatctattgatttaatggtcacgatgatgacgacaattatgttt

SEQ ID NO: 2177 - DNA, 946 bp, Zea mays
aatcaagcacgcatccacgaaatccgagagcagcagcagcagaccaagatcgagggagggaggaagacagacagacagacagacagacagagagatggagcgaatgagctcgtcggtgcagtcctgggtggaggaacacaagctctcgtccatcggagccgtgtggcgacggcggtgggcgcgtcagtggcgtacagccggcggagggcgccggcgcgagccacgagcctgcgcctcatccacgccaggatgcacgcccaggcgctcacgctcgccgtgctcgggggagccgcgctcgcgcaccgctattacggcagcagcgagaggaggcagaggcaggaggacctgaactacggcttctactcccagctgccgccggccaccgacgccgagggcaacgagaacgagcgctggagctggtattggcaaggcatactatcagtgagtgaccagtgagccagtgacttccgccttcagatgcatacatccatcagagagaaagaaagaagacggacaataaatagattaattagtactagtagcaataataataattgcatgcctgtttgccatcaatgatacatgacttggcgcctgattctgttcgtcacggctcataacccatgaagcaactagcccattgttgggttgccctgttttgccgtaccgtacctccgtttcactccctaataatcccttgggttttccaacgtttcaccctcttttctcctttaccgtaactgtctcctatttggacgtttcattaccaaagtcgtcccattttcttgtttgtgggggcgccttttagagaccacacccatgtgcgcgccccccagcctactcttttataaggcactaataaattttccgggccgcttatacaccttgcatgtggaaacctttgggtaccaaaatagtgggagagacaaccctttacacaggggag

SEQ ID NO: 2178 - DNA, 737 bp, Saccharum officinarum
  misc_feature (649)..(649): n is a, c, g, or t
gcctctggtttcgtcgtcgtctccgcccgttttcccccttctccatggcataggcaggcagggtgttcgaacacatacactccactccgtcagctataagtaggtcacctggctgctgctaccaccaatccatccatccatccctgcaatcaagcacgcatccaccaaatccaaacacacagatagctagcagaccgtttcgagggaagatcaccgtcgatcgaatcgaatcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgaccagcctgcgcctcatccacgccaggatgcacgcccaggcgctcacgctcgccgtcctcggcggagccgcgctcgcgcaccactactacggcaactcaggcagcagcaagaagaggcagcaggaggaactggactacggcttctactcccagctgccgccggccaccgacgccgacggcaacgagaacgagcgctggagctgggtacaccggagcaacagctttcacttcacttggtctggagaagattctagccagaagacagagggacaaacnataaattattagcaataattggtgggttacaatgatgcatgacgtggcggcctggtttcttcgtcctaatcctaatccatccaccaag

SEQ ID NO: 2179 - DNA, 783 bp, Saccharum officinarum
  misc_feature (529)..(529): n is a, c, g, or t
  misc_feature (667)..(667): n is a, c, g, or t
  misc_feature (670)..(670): n is a, c, g, or t
  misc_feature (676)..(676): n is a, c, g, or t
  misc_feature (679)..(679): n is a, c, g, or t
  misc_feature (696)..(696): n is a, c, g, or t
ggagcctctggtttcgtcgtcgtctccgcccgttttcccccttctccatggcataggcaggcagggtgttcgaacacatacactccactccgtcagctataagtaggtcacctggctgctgctaccaccaatccatccatccatccctgcaatcaagcacgcatccaccaaatccaaacacacagatagctagcagaccgtttcgagggaagatcaccgtcgatcgaatcgaatcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgaccagcctgcgcctcatccacgccaggatgcacgcccaggcgctcacgctcgccgtcctcggcggagccgcgctcgcgcaccactactacggcaactcaggcagcagcaagaagaggcagcaggaggacctggactacggcttctactcccanctgccgccggccaccgacgccgacggcaacagagaacgagcgctggagctggtaacaccggagcagcagctttcacttcacttggtctggagaagatactagcaagaagacagaggaacaaacaataaattagtagcnatnattggnggntaccaatgatgcatgangtggcgcctggtttttttcgtcctaattctaatccattcagcccagacgtttcaggccccggggttcgtctactttacattatccat

SEQ ID NO: 2180 - DNA, 745 bp, Saccharum officinarum
  misc_feature (257)..(257): n is a, c, g, or t
  misc_feature (268)..(268): n is a, c, g, or t
  misc_feature (514)..(514): n is a, c, g, or t
  misc_feature (548)..(548): n is a, c, g, or t
  misc_feature (571)..(571): n is a, c, g, or t
gcctctggtttcgtcgtcgtctccgcccgttttcccccttctccatggcataggcaggcagggtgttcgaacacatacactccactccgtcagctataagtaggtcacctggctgctgctaccaccaatccaatccatccatccctgcaatcaagcacgcatccaccaaatccaaacacacagatagctagcagaccgtttcgagggaagatcaccgtcgatcgaatcgaatcgaatcgaagatcgagggaggaagngagagatgganaggatgagctcgtcggtgcagtcgtgggtggaggaacacaagctctcaactatcggagccgtgtgggcgacggcggtgggcgcgtcggtggcgtacagccggcgccgggcgccggcgcgggcgaccagcctgcgcctcatccacgccaggatgcacgcccaggcgctcacgctcgccgtcctcggcggagccgcgctcgcgcaccactactacggcaactccggcagcagcaagaagaggcagcangaggacctggactacggcttctactcccagctgncggcgggcaccgacgccgacggnaacgagaacgagcgctggtactggtatcaccggaacagcatgcttcaactcacttgttttggagaagatacttccatgaagactatggactaactataaattagtagcaataattggtgggttacctatgatgcattgacgggggcctgggatttgttacgtccaattcctaat

SEQ ID NO: 2181 - DNA, 586 bp, Saccharum officinarum
aagcacgcatccaccaaatccaaacacacagatagctagcagaccgtttcgagggaagatcaccgtcgatcgaatcgggtgcgaagatcgagggaggaagagagagatggagaggatgagctcgtcggtgcagtcgtgggtggaggaacacaagctctcaactatcggagccgtgtgggcgacggcggtgggcgcgtcggtggcgtacagccggcgccgggcgaccagcctgcgcctcatccacgccaggatgcacgcccaggcgctcacgctcggcgtcctcggcggagccgcgctcgcgcaccactactacggcaactcaggcagcagcaagaacaggctgcaggaggacctggactacggcttctactcccatctgccgccggccaccgacgccgacggcaacgagaacgatcgctggatctggtaacaccggaccatcagctttcacttcccttggttctggagaagatactacccagaagacagaggaccaaacaataaattagtagccataattggtggttaccaatgattcatgacgtccccctggtgtgcttcctcctaatcctaatccatccaccca

SEQ ID NO: 2182 - DNA, 969 bp, Panicum virgatum
ggcaaaaaagaacagatcaccaaatccaacacaggagtggagtctcgccttgctcgcagcagcagcagcatctccatggaatccaagatggagcgagtgagctcgtcgctgcagtcgtgggtggaggaccacaagctctccaccatcggaggcgtgtgggcgacggcggtgggcgcgtcggtggcgtacagccggcggagggcgccgcagcgggccaccagcatgcgcctcatacacgccaggatgcacgcgcaggccctcaccctcgccgtcgtcggaggcgccgccctcatgcactactacaacaggagcaacagcaacaagaggaaagaggacctcgactacgacttctactcgcagctgccggcggccaccgacgccgacggcaacgagaacgagcggtggagctggtaaaatggtaacctcacctcacctcacctccctcttgcggcattgctgggctgccttgggaggagaggatcggaggagaaaagaataaattagtggcaataattgaggcgtgacgtggcgggtttatcctaacccatccagctaattaagatgggcccgtggtttcgtctactttacattatccatctccatccatccggacggcagcacgcagctagctttggtggaggcgcccatggtttggtttggtttctggttccccagtgctggacacgacgatgcatgcattcctccacccggtagatatttctcacaagaaaaatgaaagcaactagttcgtgtcttgcttgtcattatctttttttttattttctgaactttcttgtcattatcaaagcaagaagcttctagagtgctttcatgggctccacagcatatagcaagtgaccgctgctgcctcctcctcctgtaatctgttcaatgatgatgacgacaatgaatgagaatgatgtttcattttcctcaaatatatatatatattatatatatatatttgag

SEQ ID NO: 2183 - DNA, 809 bp, Cynodon dactylon
cacttgctttatttgcagtcccagtcagtttcatctccaccataccaagcatccaaacaacaacagtccaagaagagattggtccctgttcttcgtgctgctgaggagcatccaacaacatggagtcgtcgacgatggagaggatgagctcgtcggtgcagttctgggtggaggaacacaagctcgccaccgtcggaggcgtgtgggccactgcgattggcgcgtcggtggcgtacagccggcggaggacgccgcagagggcgacgagcctgcgcctgatccacgccaggttgcacgcccaggcgctcacgctcgccgtcctcggaggagcagcactggcgcaccactactacaatggcaagaacgccggcaagaacagagaagcagatctggactacgacttctactcgcagctgccgtcggccacggacgccgacggcaacgagaacgagcgatggagctggtaaaagtaaaacctgtcgttcacaagttcacagttgcgtcggggaagaggataagatcgttcaccaataaattagttgcaataattgagagcgtgcgtgacgtggcggattagtcctagtccatgatccagctaagacgggcccatggtttcgcttagtttactctgtattatccatccattcggctggccggtagcgtaggagcttaggaggtgcccatggttttctggttcctcggaggagccggagaagacacaaaatggtgcatttccttgtcaaagcaggttgtcagagtgcttccaggggcagcattacatatctctatcatgcttctcttgtactact

SEQ ID NO: 2184 - DNA, 1716 bp, Setaria italica
aggccatacgcctcggctccagagagttcttagtagtcacgagtgaagtgagagaccagtagaccacctgcaggctgcagcggcaatggctcgcctcgccggccttgctgcccttcttctcctactccaccttgcctctgccgcctctgcaagtagtaacgtccttcttggacgaaagggcagcagcgtcgccgctgggcagtcggccgcagcggaggaggaggagaaggcggcagcgtcgaggttcgccgtcatcttcgacgccgggagcacggggagccgggtgcacgtcttcaagttcgacagcaagctcgacctcgtcccgataggcgacgacatcgagttcttcgccaagataaagcccgggctgagctcatatgctgggcgacctcaagaagctgcaagctccatactccccctccttgagcaggctaagaagattgtccctaccagccttcagaaatacactccgcttaaacttggggcaacggctggtctaagattaattggagataagaaagcagaggagattcttgaagcggtccaggatcttgtccacaccaagagcaaatttcagtacaatcccaaatggatcactgttctcgagggaactcaagaaggatcttacctatgggttgctctgaattatctgttaggaaagttaggaggggactactctaagacagttggtgtgattgatttggggggtggatcagtgcaaatggcctatgccatttctacaaatgctgctgcaaatgccccagctgtgcctgatgggaaggatccatacattacaaaggagtacctcaaggggaaggattataacctctatgttcacagttacttgtactatggcacttttgcttcacgagtagagatcctgaaggcaaagaatgggccatttagccgctgcgtattgcgtgggtttagtggtaattacacctacaatgggaaggaatatgatgcaacagcctcacctgaaggcgcagtgtatgataagtgcagagaagagataatcaaggcactaaacttgagcgcaccatgtgaaactaagaactgcagctttaacggcgtgtggaacggaggcggtggagctggccaggacaatctctatgttgcatctttcttctttgacaaggcaacccagtatggtttcatcgagagtgaggcacccagtgcaaagtcgcggcattcaaagtagctgcagagaaggtttgttcgttgagcgtcaaagaagtcaaagctgcatatcctaatgcctttgatctgccatatgcgtgcatggatcttctctaccaatacacgttgctcgtagatggcttcggtttggatccaactaaggagattactctgattaatagagtgaagtatggagagtactatattgaggctgcttggcctctgggtactgctattgaagctgttgcgcccaagaagatgaccctgcaggatgcatgatttagtagtctctttccgggtctatactcttcctgggcatgtgttgtctacgtacaacatggtcgcatctttgctgatatacatggatttggcattgatcctatgtaataatctctggttaaaaccacttttgtggtgtactatgtatttctgaaattttagtcgagctgacgaggcgacacttttatcagaggcagtccactaattcagcagctgggcctaatcttcttttatttccccgagcttacttgacattgg

SEQ ID NO: 2185 - DNA, 1747 bp, Sorghum bicolor
agtccagtgtcgatccaccagacacgtacgagtgaagtgaccgaccacctgctgcccggccgggcatattgcagcagcggcaatggcttgcctcgccggtagcgttggcgttgctgcaattcttctcgtcttccacctcgcctccgctggtggaagcagcagcgtcgatcttgggcgaaaggccggcagcatcgccgccgccgccgacgagcagtcgccggcagtggaggaggcggcctcgagggggaggtacgccgtcatcttcgacgccgggagcacgggcagccgtgttcacgtcttcaaattcgacaagaagctcgacctcgtcccgatcggcgacgacatcgagttcttcaccaagataaagcccgggctgagctcatttgcggggaaacctcaagaggccgcaaactctatactgccccttcttgagcaggctaaggagattgtccctctccggcttcagaaagatactccgctcaaacttggggcaacagctggtctaagattaatcggagatgagaaggcagaggagattcttgaagcggttagagatcttgtccacaccaagagcaaatttcagtacaaccccaaatggatcactgttctcgagggaacgcaagaaggatcttacctatgggttgctctgaattatctgttaggtaagttgggaggggactactcgaagacggttggagtgatagatttgggaggtggatcagtgcaaatggcatatgccgtttctggaatgctgctgcaaatgccccagctgtacctgatgggaaggatccatacattacaaaggagtacctgaagggaaaagattataacctctatgttcacagctacttgtactatggcctgtctgctgttcgagtagagattctgaaggcaaagaatgggccatttagccactgcgtattgcgtgggttcagtggtacatacagctacaatgggaaggactatgatgcaacggcgtcacctgaaggcgcagtgtatgacaagtgcagagaagagataataaaggcactaaaccagagtgcaccatgtaatgcaaagaactgcacctttaatggcgtctggaatggaggcggtggagctggccaggacaatctctacgttgcatccttcttctttgacaaggcttcacaggttggcttcattgacagtgaggcacccagcgtgaagtccaccccatcggcattcaaagctgctgcagagaaagtttgtttgctgagcgccgatgaagccaaagcagggtaccctgatctctatgatgtgccatacatatgcatggatctcatctaccagtacacattgcttgtagatggcttcggtttggctccaacgaaggagattactttggtgtccagagtgaagtatggagagtttgacgttgaggcagcatggcctctgggcactgccattgaagctgttgcacccaagaagatgaaccaggatgcataagctagctagtcctttgtaataatctctgatgagaaatcactctgtcgtgccgatgttctgaaataatttcagtctagttcatgacgataaactttatcggatctaagactgatgatgagaagctcttctaagagagaataatgtagatcatttagtgtccttgcaaaacaagtcaacaagtccccattcatcttgagtttcatgattcagtttacatggttttgacattggctgaacaattcgatgcaaaaaagacattggttgtgtccttgcattgcag

SEQ ID NO: 2186 - DNA, 1943 bp, Saccharum officinarum
caactgacaagtgagtggccggcggctcctccctgctgttgctacaactggccattgcagtggcagtggcaatggctcgcctcgccggcagcgttgctgccttgcttctcgtcgtcttccacctcgtctccgctacctctggaagcagtagcggcgtcgttcttgggcgaaagggcagcagcatcgccgccgcccagcagtcgccggcggtggaggaggcggtctcgagggtacgaggaccaacggggaggtacgccgtcatcttcgacgccgggagcacgggcagccgtgtgcacgtcttcaagttcgacaaggagctcgacctcgtccccatcggcgacgacatcgagttcttctccaagataaagcctgggctgagctcatttgcagggaaacctcaggaggctgcagactctatactcccccttcttgagcaggctaagaagattgtccctctccggcttcagaaaaatactccgctcaaacttggggcaacagctggtctaagattaatcggagacgagaaggcagaggagattcttgaagcggttagagatcttgtccacaccaagagcaaatttcagtacaatcccaaatggatcactgttctagagggaactcaagaaggatcttacctatgggttgctctgaattatctgttaggtaagctgggaggggactactcgaagacggttggtgtgatcgatttgggcggtggctcagtgcaaatggcatatgccatttccacgagtgctgctgcaaatgccccagctgtgcctgatgggaaggatccatatattacaaaggagtacctcaaggggaaagattataacctctatgttcacagctacttgtactatggcatgtctgctgttcgagtagagatcctgaaggcaaagaatggaacatttagccactgcgtattgcgtgggttcagtggtacatacagctacaatgggaaggactatgatgcaacagcgtcacctgaaggcgcagtgtatgacaagtgcagagaagagataataaaggcactaaacttgagtgcaccatgtaaagcaaagaactgcacctttaatggcgtctggaacggaggcggtggagctggccaggacgatctctatgttgcatctttcttctttgacaaggcttcacaggttggcttcattgacagtgaggcacccagcgtgaagtccaccccatcggcattcaaaactgctgcagagaaagtttgtttgctgagcgccgatgaagccaaagcagggtaccccgatctctatgacgtgccatacatatgcatggatctcatctaccagtacacattgcttgtagatggctttggtttggctccaacgagggagattactttggtgtctagagtgaagtatggggagttctacgttgaggcagcatggcctctaggcactgccattgaagctgttgcacccaagaagatgaaccaggatgcataagttagtcttttgtaataatctctgatgagaaatcactctgtcgtgccaatgttctgaaataatttcagtctagttcatgaggataaactttatcagagctaagactaatgatgagaagctcttatataagagagaataataatgcatttcatttaattagtgcccttgcacaacagagtggacacagcagtcagtcgctcttttgtcctgtctgcctcagcccttcgtgggcgggttgtttaagagattccgagtatcgagcccgtgctgcgacagttagtgtttttcttatggcacctaaatccattcgctgtccgtgcgtattaaccttgctaagtgggaaaacccttgtcttgccccaccttatctccttgcattgtataccctttttgtcagcgtgccgtatactcacagtgccctcctcacttatccttctcttgtctatctcttctcgattgcgcatgccattcgcct

SEQ ID NO: 2187 - DNA, 1995 bp, Zea mays
catcgaggccgccccgtccatccgtcgacacgtgtcggagcacccttctataagtaaccccgggtacagctgcgcgatgttccattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaacaagaagggtgttatcgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgacgcgagcgcggccaccccgcgcctgcgtgctcctctaggccactgaccactgacatggacattctggtcgtcgtgtagctcggttcaggacgaatcgagagccggccggtctaggtgtagtgctgcgaaaccaacaccaccgtgcaggcacactctccgcgggcggcagatcgacggacaatcctgcgcccgtaggtatataccggtcgtcgatcaggtgttcatcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgt

SEQ ID NO: 2188 - DNA, 1917 bp, Zea mays
gttccattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaacaagaagggtgttatcgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgacgcgagcgcggccaccccgcgcctgcgtgctcctctaggccactgaccactgacatggacattctggtcgtcgtgtagctcggttcaggacgaatcgagagccggccggtctaggtgtagtgctgcgaaaccaacaccaccgtgcaggcacactctccgcgggcggcagatcgacggacaatcctgcgcccgtaggtatataccggtcgtcgatcaggtgttcatcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgt

SEQ ID NO: 2189 - DNA, 5217 bp, Sorghum bicolor
aaaatgtcgtcgtcctcggcgatgccgccgccggcgtcgccgcgggagcacgtggagaggatccggcgggagcgctactacatcgggcgcggcgagcagaacccgctggcggaggacatgcaccaggccgtcaactacctctcgcaggaactctactccaaggacgtccacttcctcatggagctcgtgcagaatgctgaagataatgaatacccttctgaagtagcaccttcgttggagtttctcattacatcaaaggatattactggatgtggtgcatcctcaactttgctcatcttcaataatgagaggggattctcttcaacaaatatagagtcaatttgtcgtgttgggaaatcaacaaagaagggaaataggcatcagggttacattggagagaaaggtattgggttcaaaagtgtgttcttgatatcaagtcagccccacatattcagcaatggttatcagatcaagttcaatgagaaaccttgtgcagaatgcaatattgggtacattgtacctcagtgggtggaatccacgcctagcctttctgacatcgaagcattatatgggtgctcaaaagtcctacctacaactaccatcatcttaccattgaagagtgagaagactgatgcggtgaagagtcagttgtcaagcatgcatcctgaaatgctactgttcctgacgaagatcaggaaactctctgtccgggaggataaatctgatcccaacaatacaacagttagtgagatctccatatccagtgaaaggaactaccaagccaggaagaacatgcatgctgagtcgtacacactccatttatcttctgaagagaccgggaaagatgaagctgaatgtggttattatatgtggaggcagaaattcccagtaaagccagagaacagagtcgataagcgtgctgaaattgatgaatgggtgataaccctggccttcccacatggagagcgtctgtcccgtgggaagcagctatcacctggcatctatgctttcctcccaactgagatggtaacaagcttccccttcatcattcaggctgacttcctcctaggatcatcaagggaggcaatactgtttgataatccatggaataagggaattcttgactgtgtcccaagtgctttcatgaatgcttttgtaacacttgtgaagtccaaagctgatgcgccagcaatgtcgctgccatcaatgttcaatttcctacctgtcagttcttcactaatcccactgcttgagccggttaggtctggcatcaaaaacaaggttctcaccgagaatatagttccattagaatcttatgcttcacagaagatattctgtaaacccagtgaagttgcacggctgaagccagccttttgggctatccttggccaagcacgggaattcggtgtagatttgaagagtctgtcaactcatggaacctacattcttagttctcattttgacaaaagtagatacaacagtgtgcttgagtttcttggtatcaaaagcgtgagcactgaatggtacgcaaaatgcattgaagggtctaaccttgtcaaggaggtacatgagcagctttacctggaaattttacactttgtcgcgagtaattgggaaaactgtttttctggtacaaatatgatgtctgttcccctactgaaatatgcctgtcattgcttttgcacactttctgtaccactcatttaagatgaattacatagagaagtactgcttatcagaactctgccgttacatgccagtaattgacagcggtggctgtgttgtcaaggaaagaaaaagcattatagttccggctaaggggagcaaatgggctgatttgctgggttcaaacccatggaggaatatagggtacattgagttgctagcagattacaaatcagtaggccattttgctgggaactacacatctgaggatcagctgttggaatttctcaagatacacctgcatgcctcagatgtgccattgatacgcccaccaaatgcgaggttccatactgtctcatcacctctcactgtggacaatacattcttgctactggaatggatacggaatatcaggtcaaatggtgtaactttaccagatcaattcctggcttgtgtaaaagaagggagttggctaaagacatcggttgggtacaagccaccaaatgaatcatttctgtccagtgctaactggggaagtcttttgcaaagtggaacttcattcattgatataccaatgattgaccaacaattctatcgaaacaagctgcatatgtacaaacaggaactcaaggcaattggggtgagatttgaatttaaggatgcatcatcttacattggaagccgcctcatgtctatggctgcaagcaacgtgttaaccagagactgtgtgtactccttgcttcggctcattcggttcctacgagagaaggttctatctccaagtcaattgattgacagtgtcaaagatggaggttggatgaagagtactcttggctataggcgtccttctgattgtatcatcaaagattcagaatgggcagtggcatcttgtatcagtgaccaaccattccttgatgtcgagttctatggagagggcatcctttcatataaatcagagttggagttgcttggtgttattgttgggttcaaaaacaattaccatcttgttattgataacttcaagttcagatcctctgctattacttctgagtctactgtattaatcctcaaatgcatccgttatgttggttcatgtcaagatttcataaggaagcttagagatttgaaatgggtgaagactaatgtgggattttgtgctccaaatgtctcttttcttgtggattctgaatgggaatgccttgtgaagatcttcaaaggagttccaataattgatttaggattttatgggagtgtgatcagttcatacaaagaagagttgaagaaggccggcttgatcacacgatttgaggaggcatcgatggctatagccaatgttttcaagcgcatggtatcggagtcatcacttacgaaggctaatgtcctagctcttctactagcttaccggcagctgagaacacacaggccacttcctgttgagcttttcaactgcatgcgcacagagaagtggatacacacatcactagggtttaaatctccgtcaaatacaatcctatttgataatgcatggcaatatctatctcccatagcaatactaccgttcattgatgatggtgaaacttgtaatggtttggggacggatatatacggttataaagatgagcttagggagttgggtgttattgttgaagtgaaatttggtgccagatttgtccttgctggcctcagcattcctgatgatcctttcactatgtccaaagctaccattttgtcatttctggagtgtatcaagaactactttacctctgcaactaaacctccaaagggctttaaagaccagatttccaagaagtggttgaagacatccttgggctaccaatgtcctgatgaatgtattctcttcgatgcaaaacaatgttttctacagatggaagatggccctttcatcgatgaagcattctatggttcagacatagcttctttcaaacatcaccttgcgatgattggagtgactgtggatgttaattgtgcacaagatcttattgcccggtatctgaggaacaaaaaagatacagatactatttcccggatctacatgtatctgaagaaatgtaactggaagcctgagaaaaataacaacaacagaaattggatttggataccaaaggaaacagagggtggagactgggtgagctcaaaaagatgtgttctgcatgataagaacaatctatttggcctgaagctgcatgttctggacaaatattatgacagaaagctgcttgacttcttttcacttgctttcagtgtgaggcatggaccttgttctgaagactattgcaaactatgggccacatgggagagttcagtccatgagctagccatatccgattgctttgctttctggaaattcattgcaacgaactggaccaagaaaacagaggaacttctttctggctgtgtcaaggttccagtatgtactgatggcaagatcattttaacaaacaaggagaatgtgttcattcctgatgatctattgcttgcagatctgttcagcaagcatcctcagcaatcgctcttcatctggtatccttcttctaccctaccttccatgtctcgagcaaggtttaacagcatatatggcagtattggtgtcaggacaatctcagaagcagtggccaagaatgattccttcacttcagcgaatagccatttcaaaacagctgttctgagtaaggtgatccaggttggcttgctccaaatagtcctcgcattcctttccaaccctaattttgacattcctgctaaagataggcatcagctggtttcatgccttctgaatgtgactatcgaagagaccgatgaaccgatcacaatggcatatagtgtgagtttgtcctctggagagatggttgaggtgaaggctagacgaatgcttcggtgggaaagggagaattcaaagctgtacatgcagagaagtgatggtgcatccagctatgaagacaagattgaacttgcgacctactttgcacatgagatatctcatgggttgctctttcagatgccagatcagatatcttcactcactgaactcataaaaattggcagattagtggacttccagcaggccgctgttgcgttcttgctgaagtccaaaaacctgcagctgttccctgaagatgaagatttcctgaactcttctgtgctaggtggcagcaaaaaaccagtggacaactagcagcctgcagattttactcttctgtacttgttcaaggttgctgatggcctgcaattcctagaaaaatccggtgttgcgctgtgcagttgtgcctagaggtcctggagtatcatcaacgaacgtggtgtcttctatgatgcatatgtatctttagactaatatctcctgaatatccagtgcctcctggtacaaaactcgtcagttgtttcggtgcaaatgcttatctcagtgttaaatgacaccaagtacttgaattactgttactattattatcgtcaatgccttgtgtgtgctctgttgatttatggtcctgctacatgaattgtgtttgttttagatttgtggcagtgacagtgatc

SEQ ID NO: 2190 - DNA, 4585 bp, Zea mays
cgccccctccctcctcagatccggccatctcctgcccgcctcgccgccggtcccgcggcccggaaccctaaagctcacccccgtggcggtgcccccggtcgcgtggggagaatggaggcggcgctggaggcggcgcgcgccaaggacaccaaggagcgcctggccggggtcgagcggctgcacgaggcgctcgacgccgcggcgcgccgcgggctgaccgcggccgaggtcaccgcgctcgtggacacctgcatggatctgacgcgggacgccaacttccgcatcgcccagggcggcctccaggcgctctccgccgccgccgtcgtcgccggcgaccacttcaagatccatctcaacgccctcgtcccggccgccgtcgaacgcctcggcgacggcaagcagcccgttcgcgacgccgcgcggcagctcctcattactctgatggaggtttcttcaccaacaatcatagttgaaagagctggtagttatgcatggactcataagagttggagggtgcgggaagagtttgtacgtacggtggcaactgcaattgggctatttgcttctactgagatttccttgcaacgggttttgctttcacctgtcctgcaattgatgaatgattcgaaccaaagtgtccgagatgctgctatctattgtattgaggagatgtacaaacacatgggatcacaatttcatgaagagttgcagcgccataatctgccttcatatatgctaaaagaaataaattcgagattggataaaatagaaccaaaggttcgatcatctgatacagcaatgcagtataaggctgtagagtctagatctgttagtgccaatcccaaaagaggcagtccaaggacaaaaagcacaccaagggaaagtacactatatggaggtgacaccgatgttacagaaaaccctgtggaaccagtaaaagttcattctgagaaagaattacttcgggaatttgagaagatcgcagctaccctttctccagaaaaggattggtctttacgtattgctgccttgcaaaggattgaagccctggtttatggaggtgccattgattatccatcatttcttatgctcttgaagcaactggttcctccattgtctaatcagctgtgtgatcgacgttctagtattgtcaaacaggcatgccacctacttaatatactatccaaagaactgctcggtgattttgagccatgtgctgaactattcatcccgatgctttttaagcttgttgtcataaccgtgcttgtgatcgctgaatctgcagatacatgcataaaaactattctgcggaattgcaaggttgctaggattcttcctcgcatagttgacacagcaaagaatgaccggagtgcaatcctccgtgcaaggtgctgtgagtatgcacttctgatactggagtattgggctgatgcctcagaaatacaacgttcagctgatttatatgaggatatgataaaatgctgtgtcgcagatgcgatgagcgaggttagggcaactgcaagaacttgctatagaatgtttgcaaagacatggcctgagcgttcacgccgtctttttatgttatttgatcctgcgatacagaggataataaacgatgaagatggtggtgtgcataaaagatatgcttctccctcattgcgtgatagggttgtgcaaccttcacgtgcttcctctcattcaagtggtacatatgtacctggatatggcacttcagctattgttgcaatggacaagagtgcagctatttcttcagattcatcttttccatcaaccaatcttcggttatcacagtcaaagacgattggcagaagttctgagagaagcctggagagcgtgcttagctccagtaaagaaaaagtttctgccattgaaagtttgctgaaaggtaactcagcactgttggactcatcccttcctaccatcccacctagttcgcgaaatggaggttcccgcttattggaaacgatgacaacacacttgcccaccaaagaaagatcaaggtcaccatacttgagtaatatgtcatctgagtccatgtctggcttatcactgccttactcaagaagatcttcggagaggcttcaagaaggaggccgcatggatgagagctatgatatccgttcaactaggcgaatgcctcaaatgcacttcgacagaaactatgttgatatgccttacagggatgccagccacagagattcacataacaacaatgtcccaaattttcagagacctcttctaaggaaacaagtaatgtcaagggcttctgcaagtggcagacacagctttgatgatagtcatgtaccatcaggtgacgtgcctagctatacagattctctggcttctctaaatgatgcactttctgagggtctcagccctagttctgactgggtagcaagagtttcagctttcgagtttattagaaatttattgaaacaaggccagaaaggcattcaagaaattactcagaattttgagaaggttatgaagctgtttttccgtcatttggatgatcctcaccataaggttgcacaggcagctttctctacacttgcagagattatcccagcttccaagaagccatttgaaagttatgtagagcgaattctaccttatgtattttcacggcttattgatccaaaagagttggtgaaaaaaccatgctccataacattggaggttgttggtcgaacatatgctattgatatgttactacctgcactagtacgctcattagatgaacagagatctccaaaggcaaaattggccgttcttgagtttgcaaataaatcattcagcaagtacactgtggactctgatggttatagtaacagtggcttccttaaactatggctttcaaaattggcacctttggtaaatgaaaagaatgcaaaattaaaggaggcatctatttctggtatcatatccgtttattctcattttgattcaacagcagtgctaaattttattctcagtttgtcagttgaagatcaaaacctcttgaggagagctctgaagatcaaaacccctcgtatcgaggttgatctggtgaactacttgcagagcaagaaagaacgtccacgccccaaatcttatgaccaggtggattttggaacttcggaggatggctatgcactgacatccaagaagagctatccatttggacggttttcttctagttcccttgatgctgaagggggaaagatgatcagttcgatgcacgaaccagtgctgcataatgtttctataggtcgaacaacttctgatatgagcatggatcatgctattcaaagtttggagtcatctacaggagctgaagttcatttaactaggagtagggaaccaaagaataacattaactcagttgtggaagctgctcgctcttggacaaactacactgaaaaaactgatgcctctttagatggtgaaactgctaccagtactcctcggttagatgtcagccggtttgtaacttctgatgggcataatactgttggctcaaccactgaagaaagtgttcaagagggtgatatgattgtgaatcttagttctataaagaccagccttcaaatggacaacggtctgagcgtaccacaacttctctatcagataagcaatgacactgaagtttcaagctcagaaaagcgggaagcactacaacaattggtcgatgcttccctcgataacaacagctccatttgggcaaagtacttcaatcaaatcttaaaggttgtgcttgaagtattagatgactctgattcatccatgagggagcttgctttatctttgattactgagatgctcaactaccagaaagatgcaattgaagactctatggagattgtttttgaaaaactcctgcatgtgaccaaagatgctgtggccaagatttcaaatgaggcaaaccaatgcttaaatgttctattggcaaaatacaaccctttcacatgtcttgctattactgtacctttattggtcagtgatgatgagaagatgcttgttgtgtgtatcaactgcttgacaaagcttgttggacgcctttctcaagaggaattgattgttcaattgcctacatttctgccagcattatttgatgcttttaacaaccaaagtccagatgtccgaaagactgttgtgttctgtctggtggatatctacatcatgcttgggaaagcatttgctccatacttggaagggcttagcagcacgcagctccgcctagtaaccatctacgctaaccggatttcacaggcgaggtccggcaagccaatcgattctaaccaatgaggttgtaacattgttattatttgtggtctatatgagcattgctccggtagggtggttttcttgtcatttgtttgtgtatgtgtatagtataaacaagcgcctcccatctgttaagagctcctggtttttgccctgtgtgattatgcattccctctttacgccttttcctctcttttccccctttggtagcttgtggagagtgttaatgagtgtggcttcttttgtactacttggtacatactctgtacaaagaaaggaaagtgtagtttcgtggaga

SEQ ID NO: 2191 - DNA, 4790 bp, Zea mays
cccacctcacccctcccgccccctccctcctcagatccggccatctcctgcccgcctcgccgccggtcccgcggcccggaaccctaaagctcacccccgtggcggtgcccccggtcgcgtggggagaatggaggcggcgctggaggcggcgcgcgccaaggacaccaaggagcgcctggccggggtcgagcggctgcacgaggcgctcgacgccgcggcgcgccgcgggctgaccgcggccgaggtcaccgcgctcgtggacacctgcatggatctgacgcgggacgccaacttccgcatcgcccagggcggcctccaggcgctctccgccgccgccgtcgtcgccggcgaccacttcaagatccatctcaacgccctcgtcccggccgccgtcgaacgcctcggcgacggcaagcagcccgttcgcgacgccgcgcggcagctcctcattactctgatggaggtttcttcaccaacaatcatagttgaaagagctggtagttatgcatggactcataagagttggagggtgcgggaagagtttgtacgtacggtggcaactgcaattgggctatttgcttctactgagatttccttgcaacgggttttgctttcacctgtcctgcaattgatgaatgattcgaaccaaagtgtccgagatgctgctatctattgtattgaggagatgtacaaacacatgggatcacaatttcatgaagagttgcagcgccataatctgccttcatatatgctaaaagaaataaattcgagattggataaaatagaaccaaaggttcgatcatctgatacagcaatgcagtataaggctgtagagtctagatctgttagtgccaatcccaaaagaggcagtccaaggacaaaaagcacaccaagggaaagtacactatatggaggtgacaccgatgttacagaaaaccctgtggaaccagtaaaagttcattctgagaaagaattacttcgggaatttgagaagatcgcagctaccctttctccagaaaaggattggtctttacgtattgctgccttgcaaaggattgaagccctggtttatggaggtgccattgattatccatcatttcttatgctcttgaagcaactggttcctccattgtctaatcagctgtgtgatcgacgttctagtattgtcaaacaggcatgccacctacttaatatactatccaaagaactgctcggtgattttgagccatgtgctgaactattcatcccgatgctttttaagcttgttgtcataaccgtgcttgtgatcgctgaatctgcagatacatgcataaaaactattctgcggaattgcaaggttgctaggattcttcctcgcatagttgacacagcaaagaatgaccggagtgcaatcctccgtgcaaggtgctgtgagtatgcacttctgatactggagtattgggctgatgcctcagaaatacaacgttcagctgatttatatgaggatatgataaaatgctgtgtcgcagatgcgatgagcgaggttagggcaactgcaagaacttgctatagaatgtttgcaaagacatggcctgagcgttcacgccgtctttttatgttatttgatcctgcgatacagaggataataaacgatgaagatggtggtgtgcataaaagatatgcttctccctcattgcgtgatagggttgtgcaaccttcacgtgcttcctctcattcaagtggtacatatgtacctggatatggcacttcagctattgttgcaatggacaagagtgcagctatttcttcagattcatcttttccatcaaccaatcttcggttatcacagtcaaagacgattggcagaagttctgagagaagcctggagagcgtgcttagctccagtaaagaaaaagtttctgccattgaaagtttgctgaaaggtgtcagcatgtcagggcaaaatttctctgctgcacgctcaacaagtttggatcttggagttgatcctccatcatctcgtgatcctcctgtgctgcttgcagcaccagcatcaaatgttctatcattgcagaactcagcactgttggactcatcccttcctaccatcccacctagttcgcgaaatggaggttcccgcttattggaaacgatgacaacacacttgcccaccaaagaaagatcaaggtcaccatacttgagtaatatgtcatctgagtccatgtctggcttatcactgccttactcaagaagatcttcggagaggcttcaagaaggaggccgcatggatgagagctatgatatccgttcaactaggcgaatgcctcaaatgcacttcgacagaaactatgttgatatgccttacagggatgccagccacagagattcacataacaacaatgtcccaaattttcagagacctcttctaaggaaacaagtaatgtcaagggcttctgcaagtggcagacacagctttgatgatagtcatgtaccatcaggtgacgtgcctagctatacagattctctggcttctctaaatgatgcactttctgagggtctcagccctagttctgactgggtagcaagagtttcagctttcgagtttattagaaatttattgaaacaaggccagaaaggcattcaagaaattactcagaattttgagaaggttatgaagctgtttttccgtcatttggatgatcctcaccataaggttgcacaggcagctttctctacacttgcagagattatcccagcttccaagaagccatttgaaagttatgtagagcgaattctaccttatgtattttcacggcttattgatccaaaagagttggtgaaaaaaccatgctccataacattggaggttgttggtcgaacatatgctattgatatgttactacctgcactagtacgctcattagatgaacagagatctccaaaggcaaaattggccgttcttgagtttgcaaataaatcattcagcaagtacactgtggactctgatggttatagtaacagtggcttccttaaactatggctttcaaaattggcacctttggtaaatgaaaagaatgcaaaattaaaggaggcatctatttctggtatcatatccgtttattctcattttgattcaacagcagtgctaaattttattctcagtttgtcagttgaagatcaaaacctcttgaggagagctctgaagatcaaaacccctcgtatcgaggttgatctggtgaactacttgcagagcaagaaagaacgtccacgccccaaatcttatgaccaggtggattttggaacttcggaggatggctatgcactgacatccaagaagagctatccatttggacggttttcttctagttcccttgatgctgaagggggaaagatgatcagttcgatgcacgaaccagtgctgcataatgtttctataggtcgaacaacttctgatatgagcatggatcatgctattcaaagtttggagtcatctacaggagctgaagttcatttaactaggagtagggaaccaaagaataacattaactcagttgtggaagctgctcgctcttggacaaactacactgaaaaaactgatgcctctttagatggtgaaactgctaccagtactcctcggttagatgtcagccggtttgtaacttctgatgggcataatactgttggctcaaccactgaagaaagtgttcaagagggtgatatgattgtgaatcttagttctataaagaccagccttcaaatggacaacggtctgagcgtaccacaacttctctatcagataagcaatgacactgaagtttcaagctcagaaaagcgggaagcactacaacaattggtcgatgcttccctcgataacaacagctccatttgggcaaagtacttcaatcaaatcttaaaggttgtgcttgaagtattagatgactctgattcatccatgagggagcttgctttatctttgattactgagatgctcaactaccagaaagatgcaattgaagactctatggagattgtttttgaaaaactcctgcatgtgaccaaagatgctgtggccaagatttcaaatgaggcaaaccaatgcttaaatgttctattggcaaaatacaaccctttcacatgtcttgctattactgtacctttattggtcagtgatgatgagaagatgcttgttgtgtgtatcaactgcttgacaaagctttgatttagtgcagagagcatcatgtgattgtgtatcagtcttgattctaaatttgagcttgttggacgcctttctcaagaggaattgattgttcaattgcctacatttctgccagcattatttgatgcttttaacaaccaaagtccagatgtccgaaagactgttgtgttctgtctggtggatatctacatcatgcttgggaaagcatttgctccatacttggaagggcttagcagcacgcagctccgcctagtaaccatctacgctaaccggatttcacaggcgaggtccggcaagccaatcgattctaaccaatgaggttgtaacattgttattatttgtggtctatatgagcatttctccggtagggtggttttcttgtcatttgtttgtgtatgtgtatagtataaacaagcgcctcccatctgttaagagctcctggtttttgccctgtgtgattatgcattccctctttacgccttttcctctcttttccccctttggtagcttgtggagagtgttaatgagtgtggcttcatttgtactacttggtacatactctgtacaaagaaaggaaagtgtagtttcgtggaga

SEQ ID NO: 2192 - DNA, 4903 bp, Oryza sativa
tggcattcgtgtctcgctgcgcttacactccccttctccttcctccagatccggccactcccctcccctccccctcctcgactcgcctcgccgctcgcctccgggctcgaaaccctaggtttggtcgctcggggtgtagtgggtgggggcgggggggaaatggaggcggcgctggaggcggcgcgcgccaaggacacgaaggagcggctggccggggtggagcggctgcacgaggcgctggacgcggcggcgcggcagcgcgggctgacggcgggggaggtgacggcgctggtggacacctgcatggatctgatacgggacgccaacttccgggtcgcgcagggcggcctgcaggcgctctccgccgccgccgtcgtcgccggggaccactttaagatccacctgaacgcgctcgtcccggccgccgtcgagcgcctcggggacggcaagcagcccgtccgcgaggccgcccggcagctcctcatcaccctcatggaggtttcttcgccgacaatcatagttgaaagagctggaagttatgcatggactcacaagagttggagggtccgggaagagtttgtacgtacagtggcaaccgcggttgggctttttgcttcaaccgagctcccattgcaacgagttcttctttcacctgtcttgcaattgatgaatgattcaaatcaaagtgttcgagatgctgctatctattgcattgaggagatgtacacacatatgggatctcagttccatgaagagttgcagcgccataacttacctccgtacatgctaagggagataaattcaagattggaaagaatagaaccaaaggttcccacatctgatggtaatatcatgcaatataaggctgtcgaatctagatctgttagtgttaatccgaaaagaggcagtccaaggacaaaaagcacaccacgggaaagtacattattcggaggggacacggatataacagaaaaaccagtggaaccagtaagagttcactcagagaaagaattacttcgggagtttgagaagattgcagctacccttgttccagaaaaggactggtccgtgcgtattgctgccatgcaaaggattgaagctttggtgtatggaggtgctattgattatccatcttttcttatgctcttgaagcagttggttccacctctatcaactcagctgtctgatcgacggtctagcattgtaaaacaggcatgccatctactcaatgtactatccaaagaactccttggtgattttgagccatgtgctgaactatttattccgatgctttttaagcttgttgtcataacagtgcttgtcatagctgaatcagccgatacatgcataaaaaccattctacggaactgcaagatttcacgaattcttcctcgcatagctgacacagcaaagaatgaccgaagtgcagttctccgtgctaggtgctgcgagtacgctcttttaatactggagtattgggctgatgccccggagatacaacgttcagctgatttatacgaagatctaataaagtgctgtgtagcagatgcgatgagtgaggtccgtgcaactgctagaagttgttatagactgtttgcaaagacatggcctgagcgttcacgtcggctttttatgtcatttgatcctgctatacagaggactataaacgatgaagatgggggtgtgcacaagcggtatgcttcaccctctcttcgtgagagggttgtgcagccttctcgttctttatcacatgcaagtggtacaagtgcacttggatatggcacttcagctattgttgctatggacaaaactgctgctatttcttcagattcatccttttcatcaaatactcttcgtttgtcacagtcaaagactgttgggagaagttctgaaagaagcctagagagtgtgcttaactcaagcaaagaaaaggtttctgccattgaaagtttgctgaaaggtgtaagcatatcagataggcaaaatatctcagctacccgctcaaccagcttggatcttggggttgatcctccatcgtctcgtgatcctcctgttccgcttgcagcaacagcttcaaatcatctgtccttacagaattcagcactgctcgactcatctgttcctagcaccataaatgctagtgcacgaaatggaggctcccgcttattggagtcaatgacaacccagttgggcaccagagagcgatcaagatcaccgtacttgggtaatatatcatctgagtccatgacaagcttatcactgccttttccaagaaggtctttggagaggccacaagaaggaggccgcatggatgagggtagtgatatccggtcaactaggagattcccccaaactcaaaactatgttgacatgccctacagagatgccatccacagagattcacataataatcatgttccaaatttccagagacctcttctaaggaagcaagtaatgtcaagggcttctgccagcatcaggcacagctttgacgatagccaagtacagtcaggtgacgtgtctggttatacggatgcactggcttcactaagtgatgctctttctgagggtctcagccctagttcggattgggtagtgagagtctcagcttttgaatttattcggaatcttctgcaacaaggccagagaggtattcaggaaattacacagaattttgaaaaggtcatgaagctgttttttcgtcatttggatgaccctcatcataaggttgcacaagcagccttttctactcttgcagaacttattccagcttgcaagaagccatttgagagttatgttgaaagaattttgccatatgttttttcccggcttattgatccaaaagaattggtaaaaaaaccatgctcatcaaccttggatgttgttgggagaacatatgcaattgatatgttgctacctgccctagtgcgctcactagatgaacagaggtccccaaaggcaaagttggctgttcttgagttcgcaaataaatcgttcagcaagtacactgtagattctgaaggttatagtaacagtgggttccttaaactgtggctttcaaaattggcacctttagttcatgaaaaaaatgcaaaactgaaggaggcatccatttctggtatcatatctgtttattctcattttgattcaacagcagtgctaaattttattctaaacttatctgttgaggagcaaaacctcttgaggcgtgcactgaagcaatacacacctcgcattgaagttgatttagtgaactacttacagagcaagaaagatcgtccccgtcccaaatcttatgatcaagcagattatggaacttcttccgaagatggttacgcgcttgcatcaaagaaaagctatccatttgggcggtattcctctagttcccttgatgctgaaggtgggaaatggatgaattcagtgcaagagtcaacaccgcgtaatgcgcctatggcgagaactacttctgatatgagcatagatcatactagtcaaagcatagaactggacactggaagtgaagttcttttaactagaagtagagaatcaaagaataatactagctcactagtggaaactgctcgttcttggccaaactatcctgaaaaaactgatgcgcctttggatgatgaaactgctatcagtactcctcgcttagacttaagccatcgcgctgcttctgatgggcacaatgctgttggttctactgctgaagaaaatgttcaagagggagatattgctgtgaaacttagttctataaagactaccctacatgctgacaacgaactgagcataccacaacttcttcatcagataagcaacggtaccgaagtttcaagtttggaaaagcgggaagcattacagcagttggttaaagcttctgttgataatgacatctccatttgggcaaagtatttcaatcaaatcttaacggctgtgcttgaggtgctggatgattctgattcatctactagggagattgctctgtctttagttgccgagatgctcaacaatcagagtggtgctatggaagaatctattgaaattgttctggagaaacttctgcatgttaccaaagacatggtggcaaagatttcaaatgaggcaaaccagtgcttaaatgttctgttagcaaaatatgatcctttcagatgtcttgctgttgtggtgcctctattggtcagtgatgatgaaaagacacttgttgtgtgtatcaactccttgacaaagcttgttggacggctttccgaggaggaattgatgaatcagttgcccacatttttgccagcactgtttgatgcttttagtaaccaaagccctgatgttcgaaagactgttgtattctgcttggtggatatctacatcatgcttgggaaggcattcgtcccgtatttggaagggcttaacagcacgcagctgcgccttgtaactatctacgcaaaccggatttcacaagcaaggtctggcgctccgattgatgctaaccaatgacctgaggtgcaacacaacgccctgttattatttgtgttctgtatgaatacctgtttggcaggggtgcatttttgggtttcatttgtttgtgcatgtgtatagtataaacaaagccccttgtgtatcgagctcctgcccttctttttctctttgtgtgattatgtattccttttttttttcaacctcttctttttgtcagcatggtgagtgttaatgagtgttttccttttgtaccacttagtgcttacactgtacaaagaaaaaggatagtgtaggttcatggagagacctagtgtctgccccattttcatttgctgtatgatttccgttggaattgctaggtgtgaattctcagttgtcagcctcgttcttggttttgccttgcttatggaggtcccaatctagcccaaaa

SEQ ID NO: 2193 - DNA, 4639 bp, Brachypodium distachyon
ctcgcacgcggaaatggaggcggcgctggaggcggcgcgcgctaaggacaccaaggagcggctggccggggtggagcgcctgcatgaggcgctggaagcggcggcgcggcgcgggctcacgtccgccgaggtcaccgcgctggttgacacctgcatggatctgacgcgggacgccaacttccgcgtcgcgcagggcgggctgcaggcgctctccgccgccgccgtggtcgccggcgaccactttaagatccacctgaacgccctcgtacccgccgccgtagagcgcctcggagacggcaagcagcccgtccgcgatgccgcgcggcagctactcatcaccctcatggagatttcttcaccaacaatcattgttgaaagagctggaagttatgcatgggctcataagagttggagggttcgggaagagttcgtacttacagtggcaactgcagttgggctttttgcttctacagagcttctcatgcaacgggttttactctcacctgtattgcaattgatgaacgattcgaaccaaagtgttagagaagctgctatatcttgtattgaggaaatgtacaagaacatgggatctcagttccatgaagagttgcagcgccataatctgcctccatacatgctaaaagaaataaattcaagattggatagaatagaaccacaggttccctcatctgatggtgctgcaacgaaatacaaggttgcagaatctagatctcttagtgttaatcctaaaagaggcagtccgaagacgaagaacacagcgagggaaagtacattatttggaggtgacacagacataacagaaaaaccagtggaaccaataagagttcactcagagaaagaattacttcgggagtttgagaagatcgcagctacccttgtcccagaaaaggactggtcagtacgtattgctgccatgcaaaggattgaagcactggtctatggaggtgctattgattacccgtcatttcttatgctcttgaagcagctggttccaccattgtccactcagctatctgatcgacggtctactattgtaaaacaggcatgccatttgcttaatgtactatccaaagaactccttggtgactttgagccatgtgctgaacaatttattccaatgctttttaagcttgtcgtcataaccgtgcttgtcatagctgaatcagcagacacctgcataaaaactatcctgcgaaactgcaaggttgcacgaattcttcctcgtgtagctgacacagctaaaaatgaccgaagtgcagttcttcgtgctaggtgctgtgaatatgcgcttctaatattggagtattgggctgacgccccggaaatacaacggtcagctgatttatacgaagatctaataaagtgctgtgtagcagatgcaatgagtgaggtccgtgcaactgcaaggacttgctacagaatgttcacaaagacatggcctgagcgctcacgtcgtctttttatgttattcgatcctgctatacagaggacaataaatgacgaggatggtgtgcacaaacgttatgcttccccctcgctgcgtgagagggttgtgcagccttctcgtgctacatctcatgcaagtggtacacatatacctggatatggcacttcagctattgttgcaatggacaagagtgcagctatttcttcagatccatctctttcattgaacaatcttcgtttatcgcagtcaaagacaagcagcagaatttctgaaagaagcctagaaagtgtgcttagctcaagcaaagaaaaggtttctgctattgaaagtttgctgaaaggtgtaagcatatcagatagacaaaatttctcagttgcacgctcaacaagcttggaccttggggttgatcctccatcatctcgtgatcctcctattcctcttgcagcaccagcttcaaaccatgtatccttgcagaactcagggctcgtggattcaaccatttctagtacacgaaatggaggttcccgcttactggatgcaatggcaacacagttaggaaccaaagagcgatcaaagtcaccatatttgagtaatgtatcatctgagtccacgacaggcttatcactgccttatttaagaagatcttcagagaggcttcaagatggaggccgcatggatgagagtaatgatatccgttcaactaggcgatttccacaaatgcacatggagaaaaactatgttgatgtgccttatagggatgccgccgctcacagagattcacacaatagcaatgtcccgaatttccagagacctcttctaagaaaacaagttatgtcaagggcttctgcaagtggcagacacagctttgatgatagccaagtaccatctggtgatgtggctagatatacagatactctggcttctttacatgatgcactttctgagggtctcaatcctagttcggattgggtagcaagagtctcagctttcgattttatccggaatgtactgcaacaaggtcagaaaggaattcaagaaattttgcagaattttgaaaaggtcatgaagctgtttttccgtcatttggatgatcctcatcataaggttgcacaagcggctttttctacacttgcagagattattccagcttgcaagaagccatttgagagttatgtcgaaagaattttgccacatgtcttttcccgcctaattgatccaaaagagttggtaaaaaaaccatgttcgttgactttggagattgttggtcgattatatgctattgatatgctgctacctgccctagtacgatcactagatgaacagaggtctccaaaggcaaaattggctgttcttgaatttgcaaacaaatcgttcagcaaatacactgtagattcggaaggttatagtaacagcggcttccttaagctatggctttcaaaattggcacctttagtaaatgaaaagaatgcaaaactgaaagaggcatctatttctggtatcatttcggtgtattctcagtttgattctactgcagtactaaattttattttaagtttatcagtcgaagagcaaaaccttttgaggcgggccctgaagcaaaaaacaccgcgtattgaggttgatctggtgaactatttgcagagcaagaaagaacgcccccgtcctaaatcttatgaccagacagattttggaacatcttctgaagatggttatgcacagacattgaagaagagctatccttttggtcggtattcttctagttcccttgatgctgaagggggaaagaagatgaatacagtgcaacagtccacacagcataatgtttcgatgggcagaacaacatccgatatgagcatagatactagtcaaagcttggaaccggctacaggaactgaagttcttttaactagaactagagaatcaaagaatcatacgagctcaattgtggaagataatcgttcctggacaaactatcctgaaaaaactgatgccgccttagatgttgaaactgctattggcactccacgcttagatttcagtcaattccgcactcctgatgggcatgatgctgttggctcagcgactgcaaaaggcgttcatgaggaagatatggttataaaccttagttctataaagaccaacccacttgctgacaacatgctgagcataccacaacttcttcatcagataagcaacgatactgaagtatcaactgtggaaaagcatgcagccttacaacaattgattaaagcttctctgggtaatgacagctccatatggtcaaagtacttcaatcaaatactaacgtctgtacttgaggtgctgggtgactctgattcatctactagagagcttgctctgtcattagttgctgagatgctcaacaatcagaaagatgctatggaagaatctattgagattgtttttgaaaaacttctgcacctgaccaaagatgtggtggcaaagatttcaaatgaggcaaaccgatgcataaatgttctgttggcaaaatatgatcctttcagatgtcttgctgttgtagcacctttttttgtcagtgatgatgaaaagatgctcgttgtgtgtatcaactgtttgacaaagcttgttgggcacctttcccaggaggaattgataaatcaattgcctgcatttttgccagcactgtttgatgcttttagtaaccaaagtccagatgttcgaaagagtgttgtattctgtctggtggatatctacataatgcttgggaaagcatttgttccatacttggaagggcttagcagcacgcagctgcgcctggtaactatctacgcaaaccggatttcgcaagcaagatctggcgcgccaattgatgctgaccaatgaggtgtaacatcttgttattatttctgttctatatgaacatttgtttggtaggggtgagattttggggggtctcgtttgtttgtgtatgtgtatagtataaacaaacgattcccttgtatttggagctcctggcttcgttcttttgtgtgattatgtattccctctcatttttcctctcttttttttggttagcatgggagagtattaacgagtgttgtcttcaggtgtactacttagttacactgtacaaagaaaggaaatgtaacttgatgaagaaactttgtgcaagttcttgggccattctca

SEQ ID NO: 2194 - DNA, 2683 bp, Zea mays
agagctccacaacagttaccacgcctttcgctttttcttttgtcctccactccacttcccctcttcacgagaggagagagagagagagagagagtgcgtgcgaatgcggagttactcggggactggtacgagcggagcaggggtgggcggtgggggaagcgagtggaagattgggagccaagagcacggagagtgccccgggatcttcacctcccatcattcgagggtggagtgctgtctgcgcagaaatctgctcaccgggtgccaggaaacaggtggctgtagagaattgcttggggattcgtcaagaaacgacccagtaggtggttgtgcacttgttatgctgagactgaatggaggctgtagacaagattgctgagcccaaagacccttttgtgctcactgcccagaaggttcagagctcggagccaccgatacctataaaggcgtcatgtgaagggaatgactcccaacagcaagaagagacggatttgccagatgatggcgaagagagcttccggagcatggattcctctgatgaaggtgtccggagctccttctctggggctagtcaccctccagagcctattgacatggatatcatgaagacagtctatgttgcaatcgacgagaagtccgagccaccggttagtttagtgcgaggagtctcggtgaaggggcctttcatagatgacctctcgatccgtgttacaggcgcaaaggcaaatctggtggtaggtgcaggcggtgctgaaggtatggctgaagagaggaaggtatctgcttctgcagtggcatcagtcaccacagcaaggtcgtctcaggctacctctttgcctcaggactcggaggagaaggagtgcgtctgggacgcttcgctccctccgagtggcaatgttagccctcatagtagtattgacagcatgggtgtggtcactgctatgagcaccctcaacagctgcacgagcacatataaaagcgagaccatagctggtgaagcaatgctcaatgttgagaggaactgtgagagtgtaaagggtgttcgaggcgacttactagaaagtgcaaaaactagcatgagtcgagcaagtgatagcagtgttgttagtgatgacagcagctggagccacatcactggaggtgccagcaagcctcacaaggggaatgatcctagatggaaggcaattcatgctgtacgaactcgtgatagcgtgcttggaatgagccattttagactactaaagcgtcttggttgtggtgacattggcagtgtttacctctcagaattaagtggaactcggtgctactttgcaatgaaggtaatggacaaggcatccttggcaagtaggaaaaagttaaatagggctcaaactgaaagggagattctacagcttcttgaccacccattcctcccaacgttgtatacacattttgaaaccgacaggttctcttgtttggtgatggaattctgtccaggtggtgatctgcatactttgcgacagagacaaccaggaaagcatttctctgagtatgctgcaaggttttatgccgcagaagtacttctagctctggagtatctacacatgttgggagtggtctatagagatctgaagcctgaaaatgttcttgtgcgcgatgatgggcacataatgctttcagactttgacctctcgctgagatgtgcagtctcacctacactcatcagaacatcagctttcgattctgatcccagaagagcaggtggttctttctgtgtacagcctgcttgcatagaacctacttcagcttgtatccagcctgcgtgcttcctccccaaattcttcggacagaagagcaagaagaagactcgaaaggcaaggtctgagttgggacataacgccggcaccctgcccgagcttgttgccgagccaacatcagctcggtcgatgtcatttgtcgggacccatgaatacttggcccctgaaatcatcaaaggcgaagggcacggaagcgctgtcgactggtggaccttcggcatcttcctgcatgagctgctgtacggcaagaccccgttcaaggggtcagggaaccgcgccaccctgttcaacgtggtaggccagcaactgaaatttccggagtcgccgtccacaagctactcgagcagagacctcatccgtgggctcttggtcaaggagccgcagagccgcctgggcgtgaagcggggagcgacagagataaagcagcatgccttcttcgagggtgtgaactgggctctcatccggtgcagcactcctcccgaggtcccgaggcctgttgaggccgagctgcctgtgaagtatggggtggcggaggcgatcgggagcaacagcaagcgggtagtcggagcagacgtgaagtcggccggaaaatacctggactttgagttcttttaagagcagtgcgtgcccagtggcagctattgtttgcgtactgtccgtgtatggtcggttttgatgtttgtgtgattcgatatggtgatttgtgcctcgccgtcgatgcacaattgtcaggtttgaatcgaccaaaattaggtaggtgtgtgttgccatttgcctgctttggcacatttcgagtttatgtatggaactatgtatagagtatgcattgcaatttgcagcaaacctgaaaagcagctaagaaggccctttcctccttgtttatgcaa

SEQ ID NO: 2195 - DNA, 2749 bp, Zea mays
agagctccacaacagttaccacgcctttcgctttttcttttgtcctccactccacttcccctcttcacgagaggagagagagagagagagagagtgcgtgcgaatgcggagttactcggggactggtacgagcggagcaggggtgggcggtgggggaagcgagtggaagattgggagccaagagcacggagagtgccccgggatcttcacctcccatcattcgagtgtggagtttgtcctacttccgggagttgcttcgcttggtggcgcccagaattagcctggaagcagggtggagtgctgtctgcgcagaaatctgctcaccgggtgccaggaaacaggtggctgtagagaattgcttggggattcgtcaagaaacgacccagtaggtggttgtgcacttgttatgctgagactgaatggaggctgtagacaagattgctgagcccaaagacccttttgtgctcactgcccagaaggttcagagctcggagccaccgatacctataaaggcgtcatgtgaagggaatgactcccaacagcaagaagagacggatttgccagatgatggcgaagagagcttccggagcatggattcctctgatgaaggtgtccggagctccttctctggggctagtcaccctccagagcctattgacatggatatcatgaagacagtctatgttgcaatcgacgagaagtccgagccaccggttagtttagtgcgaggagtctcggtgaaggggcctttcatagatgacctctcgatccgtgttacaggcgcaaaggcaaatctggtggtaggtgcaggcggtgctgaaggtatggctgaagagaggaaggtatctgcttctgcagtggcatcagtcaccacagcaaggtcgtctcaggctacctctttgcctcaggactcggaggagaaggagtgcgtctgggacgcttcgctccctccgagtggcaatgttagccctcatagtagtattgacagcatgggtgtggtcactgctatgagcaccctcaacagctgcacgagcacatataaaagcgagaccatagctggtgaagcaatgctcaatgttgagaggaactgtgagagtgtaaagggtgttcgaggcgacttactagaaagtgcaaaaactagcatgagtcgagcaagtgatagcagtgttgttagtgatgacagcagctggagccacatcactggaggtgccagcaagcctcacaaggggaatgatcctagatggaaggcaattcatgctgtacgaactcgtgatagcgtgcttggaatgagccattttagactactaaagcgtcttggttgtggtgacattggcagtgtttacctctcagaattaagtggaactcggtgctactttgcaatgaaggtaatggacaaggcatccttggcaagtaggaaaaagttaaatagggctcaaactgaaagggagattctacagcttcttgaccacccattcctcccaacgttgtatacacattttgaaaccgacaggttctcttgtttggtgatggaattctgtccaggtggtgatctgcatactttgcgacagagacaaccaggaaagcatttctctgagtatgctgcaaggttttatgccgcagaagtacttctagctctggagtatctacacatgttgggagtggtctatagagatctgaagcctgaaaatgttcttgtgcgcgatgatgggcacataatgctttcagactttgacctctcgctgagatgtgcagtctcacctacactcatcagaacatcagctttcgattctgatcccagaagagcaggtggttctttctgtgtacagcctgcttgcatagaacctacttcagcttgtatccagcctgcgtgcttcctccccaaattcttcggacagaagagcaagaagaagactcgaaaggcaaggtctgagttgggacataacgccggcaccctgcccgagcttgttgccgagccaacatcagctcggtcgatgtcatttgtcgggacccatgaatacttggcccctgaaatcatcaaaggcgaagggcacggaagcgctgtcgactggtggaccttcggcatcttcctgcatgagctgctgtacggcaagaccccgttcaaggggtcagggaaccgcgccaccctgttcaacgtggtaggccagcaactgaaatttccggagtcgccgtccacaagctactcgagcagagacctcatccgtgggctcttggtcaaggagccgcagagccgcctgggcgtgaagcggggagcgacagagataaagcagcatgccttcttcgagggtgtgaactgggctctcatccggtgcagcactcctcccgaggtcccgaggcctgttgaggccgagctgcctgtgaagtatggggtggcggaggcgatcgggagcaacagcaagcgggtagtcggagcagacgtgaagtcggccggaaaatacctggactttgagttcttttaagagcagtgcgtgcccagtggcagctattgtttgcgtactgtccgtgtatggtcggttttgatgtttgtgtgattcgatatggtgatttgtgcctcgccgtcgatgcacaattgtcaggtttgaatcgaccaaaattaggtaggtgtgtgttgccatttgcctgctttggcacatttcgagtttatgtatggaactatgtatagagtatgcattgcaatttgcagcaaacctgaaaagcagctaagaaggccctttcctccttgtttatgcaa

SEQ ID NO: 2196 - DNA, 2378 bp, Brachypodium distachyon
tgtgtacttgttatgctaaggtttgaatggagatagtagataagatcgcggagcccaaagaccctttggtggtcactgctcgaaaggtgcagaacttggagctgccggtgataccaataaaggcatcatggaaaggcaagagctcccagcagcaagatgagaaggatttgccagatgacggcgaggagagcttccggagcatggattcctcagatgagggtggccggaattctttctctggggccagtcaccctctagaaccaattgatatggatcttatgaagacggtctatgttgcaattgatgaagagaagcctgagccaccagtgtgtctggtgcgaggactatcagtgaaagcgccgttcatagacgacctttcaatccgtgttacaggcatgaaggcgaatgcagtggtttgcgcaggcagtgctgaaggcttggcagaagagaggaagatgtctggtgctgcagtggcatcactggccacggcgcgctcatcacaggctacggaaactgtgtccctgcctccggattcagaggagaaggaatgtgtctgggatgcctcactccctcccagcggaaatgtcagtccacacagtagcattgacagtatgggtgtagtcgctgccatgagcatcgtgagcagttgtagtaatacatataaaagtgaagccatagctagtgaaaccatgtttactgtggaaaggaattatggaagtgtaaagggtagtgttagaggcaactctctagaaagtgcaaaaacgagcatgagccgagcaagcgacagcagtggtgtcagcgatgatagcagctggagccatatcaccggaggtgccagcaagcctcataaggggaatgatcctagagggaaggcaattcatgctgtccgtgttcgagatggcgcgcttgggatgagccattttagactgctgaagcgtctaggctgtggtgatattggcagtgtttacctttcagagttaagtgggactagatgctactttgcaatgaaagtaatggacaaggcatgcttggccagtaggaagaagttgaacagggctcaaactgagagggagattctccagcttctggatcatcctttcctgccaactctgtatacacattttgagaccgacagattctcgtgtttggtcatggaattttgtccaggcggcgatctgcacactctgcgacagaaacagccaggaaaacatttctccgagtatgcagcaaggttctatgctgcagaagttcttctagctattgagtatctacacatgctgggagtcgtttacagggatctgaagccagaaaatgttctggtgcgcgatgatggccacataatgctttcagattttgatctctccttgagatgtgcagtctcacctacactaatcagaacatcagcttttgattctgatcccaaaagagcgggtggttcattttgtgtgcaaccgacttgtatggaacctacttcagcctgtattcagccagcatgtttcatgcccaagttgtttggtcagaagagcaagaaaaagactagaaaaactaggtctgagctggggcagagtgctactaacctgcctgagctccttgcagagccaacctcggctcgatcaatgtcgtttgttgggactcatgagtacctggccccagaaatcatcaaaggcgaagggcatggaagtgccgtcgactggtggacctttggtattttcttgcatgagcttctatatggcaagacaccattcaaggggtcaggcaaccgtgccacactgttcaacgtggttggtcagcagctcagattcccggagtcaccgtccacaagctacgctagcagggacctcatcaggggcctcctggccaaggaaccgcagcagcgccttggcgtgaagaggggcgcgacggagataaagcagcatccattctttgagggcgtgaactgggccctgatccggtgcagcacgcctcctgaggttccgaggcctgtcgaggcggagcttcctgtgaagtatggggtgtcggaggcgatcccgagcaacaagagggtggttggggccgacatgaagtctggcgggaagtaccttgactttgagttcttttagagttgtgccagcaggcggagctattgtttgcatagtgttgttgttgggtcagttcgttgttgttgttcggtacactgccgtttgtctcaccactgttacaaatttatctcatccgaactgaccaaaattagatagatgtgggtttgcctgcttgatttcttcttcatgttctggtgttaagtgtgctatagactgcatcgtagaaagatgctgaagagtgacatatttggagtctggtcaagcaagctccacagactttcactctgagatatgggcgtt

SEQ ID NO: 2197 - DNA, 3033 bp, Oryza sativa
ttctccactcgaccacaccacgccactcctcccctcctcatcgcgagagagaagagaagagaggcgagacgcgaggcacgagagtgcgtgtgggtgcggagttactcgaggagtggtagtaccagcaggcagcagcagtaacactggttggcggtggccactggcggcgagcgaggcagtggagaagaaccaagaaccccgagttctccctagggatctcccccttccctgcattcgagggtggagtttgtcctacttcagagggagtctcagtcgctacgcttggtgcccaataattagcctggaagcaggtgaagtgctctccgcctctccgtgctgaaatctgattctctggtctccaggaatcctgttggtagggcagttcagtaggagataattgcttgcagatttgccttgtttggttgaactgggaagagggggtcaattagtggctgtgcacttgttatgctaaaattgaatggagatagtagataagattgctgagcccaaagaacctttgatggtcactggtaggaaggtgcagagcttggaggcaccaataccgataaaggcgtcatggaaagggaagagctcccagcagcagcagcagcagcagcaggatgagaaggattttccagctgatggtgaggagagttttctgagcctggattcctcagacgaaggtggccggagttctttctcaggggccagtcaccccctggaaccaattgatatggatcttatgaagacggtctatgtcgcaattgatgaggagaaatccgagcaaccggtgtgtttagtgcgaggagtatcggcgaaagggccattcatagatgacctttcgatctgtgttacaggcatgaaggccaatgcagtggtaggtgcaggcagtgctgatggtttggctgaagagatgaaggtgccgggtgctgcggtgccatcattggcaacggcgcggtcatcgcaagctacagaagctgtgtccttgcctccagattcagaggagaaggactgtgtctgggatgcctcgcttcctcccagcggcaatgtgagccctcacagtagcattgacagcatgggtgtagtcacggcgatgaacactatgagcagctgtaccagcacatataaaagtgaagccgtatccagtgaaccagtgcctacgatggagaggaactgtgggagtgtgaagggcagcgttagaggtgactctctagaaagtgcaaaaaccagcatgagtcgagcaagtgatagcagtggtgttagtgatgacagcagctggagcaatatcactggaggtgctagtaagcctcacaagggtaatgatcctagatggaaggcaatacatgctgtacggactcgagatggtgtgcttggaatgagccatttcagactgctcaagcgtctaggctgtggtgacattggcagtgtttatctctcagagttgagtgggacaaggtgctactttgcaatgaaagtaatggacaaggcttccttggcaagtaggaagaaattgaacagggcacagactgagagggagattctgcagcttctggatcatccattccttccaactctgtacacacattttgagaccgacagattctcgtgtttggtcatggaattctgtccaggtggtgatttgcacacgctgcgacagagacaggcaggaaaacatttctccgagtatgctgcaaggttttatgctgcagaagtacttctagctctggagtatctacacatgttgggagttgtttacagggatctgaagccagagaacgttcttgttcgtgatgatggtcacataatgctttcagatttcgacctctccttgagatgtgcagtctcgcctacactgatcagagcatcagcttttgattctgatccaagaagagctggtggttcattctgtgtacaacctgtttgcatggaacccacttcagtctgcattcaacccgcatgcttcatgcccaaattgtttggtcagaagagcaagaagaaaactaaaaagacaaggtccgagctgggaccgagtgccacgaccatgcccgaactagttgctgagccaacatcagcccgatcaatgtcgttcgttggcacccacgagtatttggctccagaaatcatcaaaggcgaaggccatggaagcgccgttgattggtggaccttcggtatattcttgcacgagcttctatacggcaagacgccgttcaaggggtcaggcaaccgtgctaccctcttcaacgtggtcggtcagcagctaaggttcccagagtcgccgtcgacaagctacgcgagcagagacctcatcaaggggctcctggtgaaggaaccgcagcaccgcctgggcgtgaagaggggcgccacggagatcaagcagcacccgttcttcgagggcgtgaactgggctctcatccggtgcagcacgcctcccgacgttcccaggcccgtcgaggccgagctgcccgtgaagtacggcgtggcggaggcgattgggagcaacagcaagaggatggtaggcgcggacatgaagtccggtgggaaataccttgactttgagttcttctagggttgtgctgtacttgcctagtgacaagagaagctgttggttgcaaaactgctggggctggtcagtttggtgttgtgattcgatgtgcttgacctggtggtgtttgtcgcaccacggcagcaaaattatcggatctgaaattctgaattggccagaattaggttgatatatgtttgcatgtttgaattcttctccccctgtgctgtttctgtagtgtagtgctatctaacagtctggtttgaaacatgggctaacaattgcgttccaggaaggcctcaacgatggatatttctggaactagtagcgtataagctcagtctgtttaatagtcgcagatcaaagttcaatgtgcattctttcttgtgccatttaccgtggaattatggatcgaccttttactacactgacaacgttgagttttcgttggaacgtatcgaacataatttctgaattagtcctcattagtc

SEQ ID NO: 2198 - DNA, 2781 bp, Triticum aestivum
ctgggtgcggagtcactctggctgggactggcgctagcagcagcggcggcggcactggtgagcggtggtggcgaggaggagccggccaagagtgcggcgcgtcgtcaccgaggccgaggcgcccgtcatctctggactctggggatctccgctttcccccgttcgagggtggaggattggacctgttcctactcccgggggtctgctttcgctgggttttccgataatttgcccaggagcaggtgaagtgctgtctgtgctgaaatttgccatcccggtgcagaagtcctgccgtcgttggtgccttgttgaggagagaatcgcttgggatttgccttgtcttgttcggctcttgcttggtggttttgcacttgttatgctaaggtctgaatggagctagtagataagattgcggagcctgaagaccctctggtggtcaccgctcggaaggtgcagagcctggagccgccactgccgattccgataaaggcctcatggaaagggaagacctcccagcagcaggatgagaaggatctgccagatgatggggaggagagcttccagagcgtggattcctcggatgagggtggccggagttctttctctggggccagtcaccccctggagccaattgatatggatcttatgaagacggtgtatgtcgcaattgacgaggagaagcctgagccgccggtgtgtctggtgcgaggactatcagcgaaagggccgttcatggatgacctctcgctccgtgtcacaggcctgaaggcaaatgcagtggtctgtgcaggcagtggtgaaggcttggctgaagagaggaaggtgtctggtgctgcagtggcgtcgttggccacggcgcgctcgtcacaggctacggaaactgtgtccttgcctccagattcggaggagaaagactgtgtctgggatgcatcgctccctcccagcggcaatgtcagccctcacagcagcattgacagcatgggagtggtcactgccatgagcatcgcgagcaaccgcagtaacacatataaaagtgaagccatagctagcggaaccatgcttactgtagagaggaactttggaagtgtaaagagtagtgttcgaggtgactctttagaaagtgcaaaaacaagcatgagccgagcaagtgacagcagtggtgttagcgatgatagcagctggagccatatcactggaggtaccagcaagcctcacaaggggaacgaccctagaggaaaggcgattcatgctgtgcggattcgagatggcgtgcttgggatgagccactttagactgctcaagcgtctaggctgtggtgacattggcagtgtatacctctcggagttaagtgggactaggtgctactttgcaatgaaagtgatggacaaggcatccttggccagcaggaagaagttgaatagggctcaaactgagagggagatcctacagcttctggatcatccattcctaccaactctgtatacacattttgagactgataggttctcttgtctggtcatggaattttgtccgggtggcgacttgcacactctgcgacagaaacagccaggaaaatatttctccgagtatgcagcaaggttttatgctgcagaagttcttctagctattgaatatctgcacatgctgggagttgtttacagggacctgaagccagaaaatgttctggtgcgtgatgatggccacataatgctttcagatttcgacctctccctgagatgtgcagtgtcacctacattaatcaggacatcggcctttgattctgaccccagaagggcgggtggttcattctgtgtgcaacctacttgcatggagcctacttcggcctgtattcagccagcttgtttcatacccaaattgttcggtcagaagagcaagaaaaagaccagaaagacaaggtctgagctaggacagagtgccatcaacctgcccgagctcctcgcagaaccaacgtcagctcgatccatgtcatttgttgggactcacgagtacttggccccagaaatcatcaaaggcgaaggccatggaagtgcggtcgactggtggacctttggtatcttcttgcacgagcttctatacggcaagacaccattcaaggggtcaggcaaccgtgccacgctgttcaacgtggtcggtcagcagctgaagttccccgagtcgccgtcgacgagctacgccggcagggatctcatcagggggctcctggccaaggagccgcagcagcgcctcggcgtgaagaggggcgcgacggagatcaagcagcacccgttcttcgagggcgtgaactgggccctcatccggtgcagcacgccccccgaggtcccgaggcccgtcgaggctgagctgcccgtgaagtacggggtgtcggaggcggtcgcgagcaccaacaagagggtggtcggcgcggacgccaagtccagcgggaagtaccttgactttgagttcttttagagtttgcgccttagcggcggagcttgttgtttgcatactgttggtgttgttgggtcagtgtggtgttgtgattttcacggtgctgtttatgtcagtcaccgctgttacaaatttcttgcatctgaactggccgaaattagctaggtgtgtttgatctgaataacctgatgggaatagcctgtctctgtttctgaacatgttttgcgtgctacagattttgcattgcagaaacactctgaagagtggcgtcttcggggttttgcgccatcactcggcgaatcgggcattcgaccgatttaaagaatataattg

SEQ ID NO: 2199 - DNA, 2853 bp, Hordeum vulgare
ccgggaaagtggataaagcgcgagagtgattagccgcggggaaacggtgcagcccacgcgcaaccttttcgccgctctccactttgtatattccttctcctcataaaacagaacgggaacaaatccagccccaccactcccacgcctttcgcttttccccctccgttccgctccgcctcgcctctcatcagtcagtcctcacaaggcgcagaaagagagggcgagagggagagcgtctgtgtgcggagttactctactctgggactggcgctagcagcagcagcggcggcactggtgcagcgcggtggtggcggggaggagccaccggccaagagcgcggagcgtcgtcgtcccgtcccggaggccgaggcgcccgtcgtctctggggatctccccttttcccccgttcgagggcgtggaggatcggaccccttcctgctccccgggggctgctttccctggcttttccataaattgcctaggagcaggtaaagcgctgctgtctctggtgaaatttgccagcccggtgcagggatcctgccgtccttggtgtcttgttgaggagagaatcgcttgggatttgccagaagctgtgcactctttgttgctggttgtgcacttgttatgctaaggtctgaatggagatagtagataagattgcagagcctgaagaccctctggtggtcaccgctcggaaggtgcagagcctggagccgccgctgccgattccgataaaggcctcatggaaagggaagacctcccagcagcaggatgaaaaggatctaccggatgatggtgaggagagcttccagagcgtcgattcatcagatgagggtggccgcagttctttctctggggccagtcaccccctggagccaattgatatggatcttatgaagacggtctatgtcgcaattgatgaggagaagcccgaaccgcctgtgcctctggtgcgaggactatcagcgaaagggccgttcattgatgacctctcgctccgtgtcacaggcatgaagccaaatgcagtggtctgtgcaggcagtggtgaaggcttggctgaggagatgaaggtgtctggtgctgcagtggcatcgttggccacggcgcgctcgtcacaggcgacggaaactgtgtccttgcctccggattcggaggagaaggactgtgtttgggatgcatcgctccctcccagcggcaatgtcagccctcacagcagcattgacagcatgggggtggtcactgccatgagcatcgcgagcaaccacagcaacacatataaaagtgaaaccatagctagcagaaccatgcttactgtagagaggaactttggaagtgtaaagagcagtgttcgaggtgactctttagaaagtgcaaaaacaagcatgagccgagcaagtgacagcagtggtgttagcgatgatagcagctggagccatatcactggaggtaccagcaagcctcataaagggaacgatcctagaggaaaggcgattcatgctgtgcggattcgagatggcgtgcttgggatgagccactttagactgctcaagcgtctaggctgtggtgacattggcagtgtatacctctcagagttgagtgggactaggtgctactttgcaatgaaagtaatggacaaggcatccttggccagcaggaagaagttgaatagggctcaaactgagagggagatcctacagcttctggatcatccattcctaccaactctttatacacattttgagactgatagattctcatgtctggtcatggaattttgtccgggtggtgacttgcacactctgcgacagaaacagccaggaaagtatttctccgagtatgcagcaaggttttatgctgcagaagttcttctagctattgagtatctgcacatgctgggagtggtttacagggacctgaaaccagaaaatgttctggtgcgtgatgatggccacataatgctttcagacttcgacctctccctgagatgtgcagtctcacctaccctaatcaggacatcggcctttgattctgatcccagaagggcgggtggttcattctgtgtgcaacctacgtgcatggaacctacttcagcctgtattcagccagcttgtttcatgcccaaattgtttggtcagaagagcaagaaaaagacaagaaagacgaggtctgaactgggacagagtgccatcaacctgcctgagctcctcgcagaaccaacatcagctcgatccatgtcattcgttgggactcacgagtacttggccccagaaatcatcaaaggcgaaggccatggaagtgcagtcgactggtggaccttcggaatcttcttgcatgagcttctctacggcaagacaccattcaaggggtcaggcaaccgtgccacattgttcaacgtggtcggtcagcaactaaaattccccgagtcaccgtcgacaagctacgctggcagggacctcatcagggggctcctggccaaggaaccgcagcagcgcctcggcgtgaagaggggcgcgacggagatcaagcagcacccgttcttcgagggcgtgaactgggctctcatccggtgcagcacgccccccgaggtcccgaggcccgtcgaggccgagctgcccgtgaagtacggggtgtcggaggcggtcgcgagcaccaacaagagggtggtcggcgcggacgccaagtccggcgggaagtaccttgactttgagttcttttagagtttgcgccttagcggcagagcttgttgtttgcatactgtttggtgttgttgggtcagcgtggtgttgtgatttttacggtgctgtttatgtcagtcacctctgttacaaattcctgcatcctgaactggccaag

SEQ ID NO: 2200 - DNA, 2707 bp, Triticum aestivum
ctgggtgcggagtactctggctgggactggcgctagcagcagcagcggcggcactggtgcgcggtggtgggacgagggagcggggaggagccggccaagagcgcggcgcgtcgtcccccgaggctgaggcgtccgtcatctctggactctggggatctccgcttttccccggttcgagggtggaggattggacctgttcctactccccgggggctgctttcgctgggttttcgacaatttgccctggagcaggtgaagtgctgtctgtgctgaaatctgccatcccggtgcaggaatcctgtcgtccttgtgtcttgttgaggagagaatcgcttgggatttgccttgtcttggtcggctcttgcttggtgtttgtgcccttgttatgctaaggtctgaatggagatagtagataagattgcggagcctgaagaccctctggtggtcactgctcggaaggtgcagagcctggagccgccactgccgataccgataaaggcgtcatggaaagggaagacctcccagcagcaggatgagaaggatctgccagatgatggcgaggagagcttccagagcgtggattcctcggatgagggtggccggagttctttctctggggccagtcaccccctggagccaattgatatggatcttatgaagacggtctatgtcgcaattgacgaggagaagcctgagccgccggtgtgtctggtgcgaggactatcagggaaagggccgttcatagatgacctctcgctctgtgtcacaggcctgaagccaaatgcagtggtctgtgcaggcagtggtgaaggcttggctgaagagaggaaggtatctggtgctgcagtggcttcgttggccacggcgcgctcgtcacaggcaacggaaactgtgtccttgcctccggattcggaggagaaggactgtgtctgggatgcatcgctccctcccagcggcaatgtcagccctcacagcagcattgacagcatgggggtggtcactgccatgagcatcgcgagcaaccgcagtaacacatataaaagtgaagccatagctggcggaaccatgcttactgtagagaggaactttggaagtgtaaagagtagtgtgcgaggtgaatctttagaaagtgcaaaaacaagcatgagccgagcaagtgacagcagtggtgttagcgatgatagcagctggagccatatcactggaggtaccagcaagcctcataaggggaatgatcctagaggaaaggcgattcatgctgtgcgaattcgcgatggcgtgcttgggatgagccactttagactgctcaagcgtctaggctgtggtgacattggcagcgtatacctctcagagttgagtgggactaggtgctactttgcaatgaaagtaatggacaaggcatccttagccagcaggaagaagttgaatagggctcaaactgagagggagatcctacagcttctggatcatccattcctaccaactctgtatacacattttgagactgataggttctcgtgtctggtcatggaattttgtccgggtggcgacttgcacactctgcgacagaaacagccaggaaaatatttctccgagtatgcagcaaggttttatgctgcagaagttcttctagctattgagtatctgcacatgctgggagtcgtttacagggacctgaagccagaaaatgttctggtgcgtgatgatggccacataatgctttcagatttcgacctctccctgagatgtgcagtgtcacctacactaatcaggacatcggcctttgattctgatcccagaagggcgggtggttcattctgtgtgcaacctacttgcatggagcctacttcagcctgtattcagccagcttgtttcatgcccaaattgtttggtcagaagagcaagaaaaagaccaaaaagacaaggtctgaccttggacagagtgccatcaacctgcccgagctcctcgcagaaccaacatcagctcgatccatgtcattcgttgggactcacgagtacttggccccagaaatcatcaaaggcgaaggccatggaagtgcggtcgactggtggacctttggtatcttcttgcacgagcttctatacggcaagacaccattcaaggggtcaggcaaccgtgccacgctgttcaacgtggtcggtcagcagctgaagttccccgagtcgccgtcgacgagctacgccggcagggacctcatcagggggctcctggccaaggagccgcagcagcgcctcggcgtgaagaggggcgcgacggagatcaagcagcaccccttcttcgagggcgtgaactgggccctgatccgatgcagcacgccccccgaggtcccaaggcccgtcgaggccgagctgccggtgaagtacggggtgtcggaggcggtcgcgagcaccaacaagagggtggtcggcgcggacgccaagtccggcgggaagtaccttgactttgagttcttttagagtttgcgccttagcggcagagcttgttgtttgcatactgttggtgttgttgggtcagtgtggtgttgtgattcttacggtgctgtttatgtcagtcaccgctgttacaaatttcttgcatctgaactggccgaaattagctaggtgtgtttgatctgcatgacctgatgggaatagcctgtctctgtttctgaacatgttttgcgtgctacagattttgcattgcaga

SEQ ID NO: 2201 - DNA, 2816 bp, Setaria italica
tcttcgttagggtttttttttatgcttttgtgtgggaaagatctgaatgcgggttgggtgcacttccgggtagcgagtgggggatttcgggtgcggttttgggattctgccgcggtgggggaatcgtgggatttaagcaacgtaggcgtaatttggtgggttgttgtttccgcaagggagtaatgtctaatccggtggattgaacggcactttagtgtttggacagggtggagttcgtcctactcccaggacttgcttcgcttggtgctgcacagaattagcgcggaagcaggtggagtgttctctgccctgaaatctgctcaccgggtgccaggaaacaggcggttgaagagaattgcttgggaattcgccaagacgcgaccaaatctttgcaggtgcttgtgcacttgttatgctgagactgaatggaggcggtagataagattgccgagcccaaagaccctttggtgctcactgctcggaaggttcagagcttggagccaccaataccgataaaggcgtcatggaaagggaagaactcccagcagcaagaagagaaggatttgccagctgatggtgaggagagcttccggagcctggattcctctgatgagggtggccggagctccttctctggagctagtcaccctccagagcctattgatatggatattatgaagacagtctatgttgcaattgacgaggagaggtccgagccaccggtgagtttagtgcgaggagtgtcgatgaaggggcctttcatggatgacctctcgatccgtgtcgcaggcacaaaggcaaatctggtggtaggtgccgaaggtttggctgaagagaggaatgtgtctggttctgcagtggcatcagtggccacagcacgctcatctcaggctacctctttgcctcaggactccgaagagaaggagtgtgtctgggatgcttcacttcctcccagcggcaatgtcagccctcacagtagcattgacagcatgggtgtggtcactgccatgagcactcttaacagctgtgcaagcacatacaaaagtgaagctgtagctagtgaaggaatgctcactgtggagagaaactgtgaaagtgtaaagggtgtccgaggcgacttgctagaaagtgcaaaaactagcatgagtcgagcaagtgatagcagtggtgttagtgatgacagcagctggagccatataactggaggtgccagcaagcctcacaaggggaatgatcctagatggaaggcaattcatgctgtacgaactcgagatagcgtgcttggaatgagccattttagactactcaagcgtcttggttgtggtgacattggcagtgtttacctctccgaattaagtggaactcggtgctactttgcaatgaaggtaatggacaaggcatccttggcaagtaggaagaagttaaatagggctcaaactgaaagggaaattctacagcttctggaccacccattcctcccaaccttgtatacacattttgagaccgacaggttctcttgtttggtgatggaattctgtccaggtggcgatctgcatactctgcgacagagacaaccagggaaacatttctcagagtatgctgcaagattctatgctgcagaagtacttctagctctggagtatctacacatgttgggagttgtctacagggatctgaaaccagaaaatgttcttgtgcgtgatgatgggcacataatgctttcagattttgacctctccctaagatgtgcagtctcacctacactcatcagaacatcagctttcgatactgatcccagaagagcgggtggttctttctgtgtacaacctgcttgcatggaacctacttcagcgtgtattcagcctgcatgcttccttcccaaattattcggtcagaagagcaagaaaaagattagaaagacaaggtctgagttgggacagaatgttggcaccctgcctgagcttgttgctgaaccaacgtcggctcggtcgatgtcatttgtcgggactcatgaatacttggcccctgaaatcatcaaaggtgaaggccatggaagtgctgttgactggtggaccttcggcatcttccttcatgagctgctgttcggtaaaaccccattcaaggggtcaggaaaccgtgccacactgtttaacgtggttggtcagcagctaaaatgagtcaccgtccacaagctactctagcagagacctcatcagggggctcctggtcaaggaaccacagaaccgcctaggcgtgaagcggggggcgacggagataaagcagcaccccttcttcgaaggcgtgaactgggctctcatccggtgcagcactccacctgaggtcccaagacccgtcgaggccgagctgccggtgaagtatggcgtggcggaggcgatcgggagcaacagcaagagaatagttggcgctgacgtgaagtcaggcggaaaatacctggacttcgagttcttttagagtagtgctgccccagtggtggctattgtttgcatgctgttggtgtatggtcagtttgatgtcgtgtgattcgatgtggtggtttgtgtctcagcatcgatgcaaaattctcagatctgaattggccagaattagatagatgtgtttgcctgctaaagtctcctcattctgcatttctgtagtgatagactccctctaaagctctgaactacttgttaacttgtgcagaagtaaaactgaaaccagtaaggatagcaaaacgttgtcatgatcaaacagatgcagaaatatgctgtaacagatgagaaatgcatcgtcctttctgcttgcttactggtttcagt

SEQ ID NO: 2202 - DNA, 2069 bp, Saccharum officinarum
tctctctcccctccccagctcctcctccctgtctgcttccctcccctgctgtggcactgcgcttggccgcttgccctctcccctcaccttctccacctccccctattccgcaaccgcacgagcagagttccctcaccaagaggagaaaaaaaagagagcgaaggaggcaaaccaggcggcgggacagcaacgcgacgtgcttgccattctctcgaggagctcatgcaaggtgtaagtcttactgcaagaagggcagctgtgcatgttgttaagacccaaatatagcctcacttgattacactgcacggggggttgaaaacttgagatacagttgatcttctggttaagagtatgggttcaaggtttgcatcacatcagctgagcaatggcctgtatgtttctggtcgacctgagcaacctaaggagaaggccccaaccatttgttccaccgcgatgccatatactgggggtgacatcaagaaatctggagagctggggaagatgtttgatctccatgttgagaagtcaagaaaatctggtcctctaggaaatgctccttcaaggaatacttcatttggaggtgctgcttccaactctggacccgtctccaatgctggtggtcggtccaactactctggttctctttcatcttcagttcctggtgctggcggatcagccagagcaaaatcaaactccggaccgctcaataagcatggagagccaacaaagaggtcatctggtccccagtctggaggagtgaccccaatggcacgccagaactctggcccgcttccacctgtgcttccgacaactgggcttatcacatctgggcctatctcttcagggccacttaattcgtctggtgctccaaggaaagtatctgggccacttgattctgctgcatcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggcttcattctgggtgctgttcacaatgcaattttgctgatagttgttgtggtgatatttggttttgttgctgcacttcttatctggaatgcttgctggggtaggagaggcgcaattgggtttgttaatcgctatcctgatgctgatctcagaactgccaaagatggacagtatgtaaaggttacaggggtggttacttgtggaaatttccccctcgaatcctcgttccaaagggtcccaagatgcgtatacacttctactagcttgtatgagtacaggggttgggattccaaagctgccaatacggagcatcggcgttttacctggggtttacgctcaatggagcgacatgcggttgatttctacatctcagattttcagtctgggcttcgagcattggtgaaaacaggatatggtgcacgtgtgaccccttacgtcgatgaatctgttataattgacatcaatccagacaacaaggatatgtcccctgaatttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcggagcccatctcaactggttgtcagtgggccaagtgcgttctcccaaccaaccttgacgggcttgttttaagatgcgaagatacttcgaacattgatgtgataccagtttaactggctgtggaagagtcgttgccaaagaaagtgcctgttaaatatttgagtctgtattgtttcatggaatgctagttgagaaaaatgtgcaaatgttgggtgtgattatggcaggttgagggtggttggttaagctggccgttggatgtatagtttttctcttttaattgtgttttgtcatttctttttctttttaattttcagctctgagatctgaaacttgtgtaaccagatgcctcttaatctaaatctgcgtggcatttagattg

SEQ ID NO: 2203 - DNA, 2080 bp, Saccharum officinarum
tctctctcccctccccagctcctcctccctgtctgcttccctcccctgctgtggcactgcgcttggccgcttgccctctcccctcaccttctccacctccccctattccgcaaccgcacgagcagagttccctcaccaagaggagaaaaaaaagagagcgaaggaggcaaaccaggcggcgggacagcaacgcgacgtgcttgccattctctcgaggagctcatgcaaggtgtaagtcttactgcaagaagggcagctgtgcatgttgttaagacccaaatatagcctcacttgattacactgcacggggggttgaaaacttgagatacagttgatcttctggttaagagtatgggttcaaggtttgcatcacatcagctgagcaatggcctgtatgtttctggtcgacctgagcaacctaaggagaaggccccaaccatttgttccaccgcgatgccatatactgggggtgacatcaagaaatctggagagctggggaagatgtttgatctccatgttgagaagtcaagaaaatctggtcctctaggaaatgctccttcaaggaatacttcatttggaggtgctgcttccaactctggacccgtctccaatgctggtggtcggtccaactactctggttctctttcatcttcagttcctggtgctggcggatcagccagagcaaaatcaaactccggaccgctcaataagcatggagagccaacaaagaggtcatctggtccccagtctggaggagtgaccccaatggcacgccagaactctggcccgcttccacctgtgcttccgacaactgggcttatcacatctgggcctatctcttcagggccacttaattcgtctggtgctccaaggaaagtatctgggccacttgattctgctgcatcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggcttcattctgggtgctgttcacaatgcaattttgctgatagttgttgtggtgatatttggttttgttgctgcacttcttatctggaatgcttgctggggtaggagaggcgcaattgggtttgttaatcgctatcctgatgctgatctcagaactgccaaagatggacagtatgtaaaggttacaggggtggttacttgtggaaatttccccctcgaatcctcgttccaaagggtcccaagatgcgtatacacttctactagcttgtatgagtacaggggttgggattccaaagctgccaatacggagcatcggcgttttacctggggtttacgctcaatggagcgacatgcggttgatttctacatctcagattttcagtctgggcttcgagcattggtgaaaacaggatatggtgcacgtgtgaccccttacgtcgatgaatctgttataattgacatcaatccagacaacaaggatatgtcccctgaatttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcggagcccatctcaactggttgtcagtgggccaagtgcgttctcccaaccaaccttgacgggcttgttttaagatgcgaagatacttcgaacattgatgtgataccagtttaactggctgtggaagagtcgttgccaaagaaagtgcctgttaaatatttgagtctgtattgtttcatggaatgctagttgagaaaaatgtgcaaatgttgggtgtgattatggcaggttgagggtggttggttaagctggccgttggatgtatagtttttctcttttaattgtgttttgtcatttctttttctttttaattttcagctctgagatctgaaacttgtgtaaccagatgcctcttaatctaaatctgcgtggcatttagattgatttggttttg

SEQ ID NO: 2204 - DNA, 2194 bp, Zea mays
accacccccactccaccctctctctccattgtctccattattttctctctcctccgtctccaccccctttattctctctctcccagctcctcctccctgtctgctcccctccacatccactgctgtggcgctctccctctcccgtctccccttaccttctccacctcccccattccgccaccgcacaagccgacctccctcaccaagaggagaaaagaaagggagagcgaaggaggcaaaccaggtgggacagcaacgcgacgtgcttgctattctctctaggagctcatgcaaggtgtaagtcttactgcaagaagggcagctgtgcatgttaagacccatacatagcttctcttgattacacagcacggggggtgaaaacttgagatacagttgatctcctggttcagagtatgggttcaaggtttgcatcgcatcagctgagcaatggcctgtatgtttctggtcgacctgaacaacctaaggagaaggccccaaccatttgttccactgcgatgccatatactgggggtgacatcaagaaatcaggagagctggggaagatgtttgatctccatgttgagaagtcaagaaaatctggtcctctaggaaatgctccttcaaggaatacttcatttggaggtgctgcttccaactctggacccgtatccaatgctggcggtcggtccaattactctggttctctttcatcttcagttcctggtgctggcggatcagccagagcaaaatcaaactctggaccgctcaataagcatggagagccaacaaagaggtcatctggtccccagtctggaggagtgaccccaatggcacgccagaattctggcccccttcctcctgtgcttccgacaactgggcttatcacatctgggcctatctcttcagggccacttaattcgtctggtgttccaaggaaagtatctgggccacttgattctgctgcgtcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggtttcattctgggtgctgttcacaatgcaattttgctgatagttgttgtggtgatatttggttttgttgctgcacttcttatctggaatgcttgctggggtagtagaggtgcagttgggtttgttaatcgctatcctgatgctgatctcagaactgctaaagatggacaatatgtaaaggttacaggggttgttacctgtggaaatttcccccttgaatcctcgttccaaagggtcccgagatgtgtatacacttctactagcttgtatgagtacagaggttgggattccaaagctgccaatacagagcatcggcgttttacctggggcttacgctcaatggagcgccatgcggttgatttctatatctcagattttcagtccgggcttcgagcattggtgaaaacaggatatggtgcacgtgtgaccccgtatgtcgatgaatctgttataattgacatcaatccagacaacaaggatatgtcccctgattttttgagatggctacgggagagaaacctttcaagcgatgatcgtacaatgcgcctaaaagaaggatacatcaaggaaggtagcactgtgagtgtgatgggggttgtccaaaggaatgacaatgttctgatgattgttcctccatcagagcccatctcaactggttgtcagtgggccaagtgcgttctcccaaccaaccttgatgggcttgttttaagatgcgaagatacttcaaatattgatgtgataccagtttaactggcggtggaagggtagttgccaaaaaaagtgcctgttaaatatttgagtctattgtttcatggaatgctagttgagaaaaatgtgcaaatgttgggtgggtgtgattatggtaggctgagggtggttggttaagctggcctttggatgtatagttttttcttcttcttttaattgtgttttgttgtttctttttaattttcagttctgagatctgaaacttgtgtaaccacatgccttttaatctaaatctgcgtggcatttagattgacttggctttgaaattagaaggacgctctcttttgtgctttgtgttaaaaaaaaactcggcc

SEQ ID NO: 2205 - DNA, 2133 bp, Zea mays
accacccccactccaccctctctctccattgtctccattattttctctctcctccgtctccaccccctttattctctctctcccagctcctcctccctgtctgctcccctccacatccactgctgtggcgctctccctctcccgtctccccttaccttctccacctcccccattccgccaccgcacaagccgacctccctcaccaagaggagaaaagaaagggagagcgaaggaggcaaaccaggtgggacagcaacgcgacgtgcttgctattctctctaggagctcatgcaaggtgtaagtcttactgcaagaagggcagctgtgcatgttaagacccatacatagcttctcttgattacacagcacggggggtgaaaacttgagatacagttgatctcctggttcagagtatgggttcaaggtttgcatcgcatcagctgagcaatggcctgtatgtttctggtcgacctgaacaacctaaggagaaggccccaaccatttgttccactgcgatgccatatactgggggtgacatcaagaaatcaggagagctggggaagatgtttgatctccatgttgagaagtcaagaaaatctggtcctctaggaaatgctccttcaaggaatacttcatttggaggtgctgcttccaactctggacccgtatccaatgctggcggtcggtccaattactctggttctctttcatcttcagttcctggtgctggcggatcagccagagcaaaatcaaactctggaccgctcaataagcatggagagccaacaaagaggtcatctggtccccagtctggaggagtgaccccaatggcacgccagaattctggcccccttcctcctgtgcttccgacaactgggcttatcacatctgggcctatctcttcagggccacttaattcgtctggtgttccaaggaaagtatctgggccacttgattctgctgcgtcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggtttcattctgggtgctgttcacaatgcaattttgctgatagttgttgtggtgatatttggttttgttgctgcacttcttatctggaatgcttgctggggtagtagaggtgcagttgggtttgttaatcgctatcctgatgctgatctcagaactgctaaagatggacaatatgtaaaggttacaggggttgttacctgtggaaatttcccccttgaatcctcgttccaaagggtcccgagatgtgtatacacttctactagcttgtatgagtacagaggttgggattccaaagctgccaatacagagcatcggcgttttacctggggcttacgctcaatggagcgccatgcggttgatttctatatctcagattttcagtccgggcttcgagcattggtgaaaacaggatatggtgcacgtgtgaccccgtatgtcgatgaatctgttataattgacatcaatccagacaacaaggatatgtcccctgattttttgagatggctacgggagagaaacctttcaagcgatgatcgtacaatgcgcctaaaagaaggatacatcaaggaaggtagcactgtgagtgtgatgggggttgtccaaaggaatgacaatgttctgatgattgttcctccatcagagcccatctcaactggttgtcagtgggccaagtgcgttctcccaaccaaccttgatgggcttgttttaagatgcgaagatacttcaaatattgatgtgataccagtttaactggcggtggaagggtagttgccaaaaaaagtgcctgttaaatatttgagtctattgtttcatggaatgctagttgagaaaaatgtgcaaatgttgggtgggtgtgattatggtaggctgagggtggttggttaagctggcctttggatgtatagttttttcttcttcttttaattgtgttttgttgtttctttttaattttcagttctgagatctgaaacttgtgtaaccacatgccttttaatctaaatctgcgtggcatttagattga

SEQ ID NO: 2206 - DNA, 2179 bp, Zea mays
cttcacacagccattttttctctctctctctcatgcatcgtctatctatattattttatctccccccgtctccacctccccctatattctctctctcccctcctctcctctccccagctacgccagtcctcctccctgtctgcttcggtgcttcgctcccgcactgcgcttggccgctttccctctccccgcaccttctccacctcccccattccgccaccgcacgagcagagctccctcaccaagaggaccaaaaaaaaaaaaaacgagggaggcaagccaggcgggacagcaacgcgacgcgcttgtcattcactcgaggagctcatgcaaggcgtaaatcttattgcaagaagggcagctgtgcatgttaagtctcaaatatagactcacttgataacactgcatgagaggttgaaaacttgaggtacagttgatattctggttcagagtatgggttcaaggtttgcatcacatcagctgagcaatggcctgtatgtttctggtcgacctgagcaacctaaggagaaggccccaaccatttgttccactgcgatgccatatactgggggtgacatcaagaagtctggagagcttgggaagatgtttgatctccatgttgagaaatcaagaaaatctggtcctctaggaaacgctccttcaaggaatacttcatttggaggcactgcttccaattctgggcctgtctccaatgctggtggtcggtccaactactctggttccctttcatcttcagttcctggtgctggtggatcagccagagcgaaatcaaactccggaccactcaataagcatggagagccaacaaagaggtcatctggtccccagtctggaggagtaaccccaatggcacgccagaattctggcccccttcctcctgtgcttccgacaactgggcttatcacatctgggcctatctcttcagggccacttaattcgtctggtgctccaaggaaagtatctgggccacttgattctgctgcatcgatgaaaatgcgggctacttcctttgctcacaatcaagctgttactaatctgaacactgaagatggttactcaattcagggaagctttccgaagccaatactctgggctgtgattttgctctttgtgatgggttttatagcaggtggcttcattttgggggctgttcacaatgcaattttgctgatagttgttgtggtcatatttggttttgttgctgcacttcttatctggaatgcttgctggggtagcagaggtggaattgggtttgttagtcgctaccctgatgctgatctcagaacggccaaagatggacaatatgtaaaggttacaggggttgttacttgtggaaatttccccctcgaatcctcgttccaaagggttccaagatgcgtatacacttctactggcttgtatgagtacaggggttgggattccaaagctgccaataccgaacatcggcgttttacatggggtttacgttcaatggagcgacatgcggttgatttctacatttcagattttcagtccgggcttcgagcattggtgaaaacaggatatggtgcacgtgtgaccccatacgttgatgaatctgttataattgacatcgatccagacaacaaggatatgtcccctgaatttttgagatggctaagagagagaaacctttcaagcgatgatcggacaatgcgcctaaaagaaggatacatcaaggaaggtagcactgtaagtgtgatgggggttgtccaaaggaacgacaacgttctgatgattgttcctccatcagagcccatctcaactggttgtcagtgggccaagtgcgttctcccgaccaaccttgacgggcttgttttaagatgcgaagatacttcgaacattgatgtggtgccagtttaattagcggtgaagagtcgttgccaaagaaagtgtctgttaaatatgagtctgaattgtttcatgcaatgttagttgacaaaaatgtgcaaatgttgggtgtgattatggcaggtggagggtggttcgttaagctggcttttggatgtatagtttctttttcttttagttgtgttttgtcatttctttttaattttcagctccgagatctgaaacttgtgtaaccagatgcctcttaatctaaatcagcgtggcatttagatcgatttgaaagcttaca

SEQ ID NO: 2207 - DNA, 2178 bp, Zea mays
cttcacacagccattttttctctctctctctcatgcatcgtctatctatattattttatctccccccgtctccacctccccctatattctctctctcccctcctctcctctccccagctacgccagtcctcctccctgtctgcttcggtgcttcgctcccgcactgcgcttggccgctttccctctccccgcaccttctccacctcccccattccgccaccgcacgagcagagctccctcaccaagaggaccaaaaaaaaaaaaaacgagggaggcaagccaggcgggacagcaacgcgacgcgcttgtcattcactcgaggagctcatgcaaggcgtaaatcttattgcaagaagggcagctgtgcatgttaagtctcaaatatagactcacttgataacactgcatgagaggttgaaaacttgaggtacagttgatattctggttcagagtatgggttcaaggtttgcatcacatcagctgagcaatggcctgtatgtttctggtcgacctgagcaacctaaggagaaggccccaaccatttgttccactgcgatgccatatactgggggtgacatcaagaagtctggagagcttgggaagatgtttgatctccatgttgagaaatcaagaaaatctggtcctctaggaaacgctccttcaaggaatacttcatttggaggcactgcttccaattctgggcctgtctccaatgctggtggtcggtccaactactctggttccctttcatcttcagttcctggtgctggtggatcagccagagcgaaatcaaactccggaccactcaataagcatggagagccaacaaagaggtcatctggtccccagtctggaggagtaaccccaatggcacgccagaattctggcccccttcctcctgtgcttccgacaactgggcttatcacatctgggcctatctcttcagggccacttaattcgtctggtgctccaaggaaagtatctgggccacttgattctgctgcatcgatgaaaatgcgggctacttcctttgctcacaatcaagctgttactaatctgaacactgaagatggttactcaattcagggaagctttccgaagccaatactctgggctgtgattttgctctttgtgatgggttttatagcaggtggcttcattttgggggctgttcacaatgcaattttgctgatagttgttgtggtcatatttggttttgttgctgcacttcttatctggaatgcttgctggggtagcagaggtggaattgggtttgttagtcgctaccctgatgctgatctcagaacggccaaagatggacaatatgtaaaggttacaggggttgttacttgtggaaatttccccctcgaatcctcgttccaaagggttccaagatgcgtatacacttctactggcttgtatgagtacaggggttgggattccaaagctgccaataccgaacatcggcgttttacatggggtttacgttcaatggagcgacatgcggttgatttctacatttcagattttcagtccgggcttcgagcattggtgaaaacaggatatggtgcacgtgtgaccccatacgttgatgaatctgttataattgacatcgatccagacaacaaggatatgtcccctgaatttttgagatggctaagagagagaaacctttcaagcgatgatcggacaatgcgcctaaaagaaggatacatcaaggaaggtagcactgtaagtgtgatgggggttgtccaaaggaacgacaacgttctgatgattgttcctccatcagagcccatctcaactggttgtcagtgggccaagtgcgttctcccgaccaaccttgacgggcttgttttaagatgcgaagatacttcgaacattgatgtggtgccagtttaattagcggtgaagagtcgttgccaaagaaagtgtctgttaaatatgagtctgaattgtttcatgcaatgttagttgacaaaaatgtgcaaatgttgggtgtgattatggcaggtggagggtggttcgttaagctggcttttggatgtatagtttctttttcttttagttgtgttttgtcatttctttttaattttcagctccgagatctgaaacttgtgtaaccagatgcctcttaatctaaatcagcgtggcatttagatcgatttgaaagcttac

SEQ ID NO: 2208 - DNA, 1754 bp, Panicum virgatum
atgggttcaaggtttccatcacatcagctgagcaatggcctgtatgtttctggtcgacctgagcaacctaaggagaaggccccaaccatttgttctaatgtgatgccatatactggtggtgacatcaagaaatctggagagctagggaagatgtttgatctccatgttgaaaagtcaagaaaatctggccctctaggtaatgctccttccaggaatacttcttttggaggcgctgcttccaactctggacctgtatccaattctggtggtcgatccaactactctggttcgctttcgtcttcagttcctggtgctggcggttcagccagagcaaaatcaaactctggacctcttaataagcatggagaaccaacaaagaggtcatctggtccccagtctgggggagtgacaccaatggctcgccagaattcggggcctctccctcctgtgcttccgacaactgggctcatcacatctggacctatctcttcaggaccattgaattcgtctggtgctccaagaaaagtatctgggccacttgattctgctgcatccatgaaaatgcgggcgacttcctttgctcacaatcaagctgttactaatctcaacactgaagatggttactctattcagggaagctttccgaagccaatactttgggctgtgattctgctcttcgtgatgggtttcattgcaggtggcttcattctgggtgctgttcacaatgcaattttgctgatagttgttgtggttatatttggttttgttgctgcactgttaatctggaatgcttgctggggaaggagaggcgctattgggtttattaatcgctatcctgatgctgatctcagaactgccaaagatggacagtatgttaaggtgacgggggttgttacttgtggaaatttcccccttgagtcctcgttccaaagggtcccaagatgtgtgtacacttctactaccttgttcgagtacaggggttgggattccaaagctgctaacactgagcatcgccgttttacctggggtttacgctcaatggagcgacatgcggtcgatttctacatttcagattttcaatctgggcttcgagcattggtgaaaacaggatatggtgcacgtgtgaccccttatgttgatgaatctgttattattgacatcaatcctgataacaaggatatgtccccagaatttttgagatggctgagggaaaggaacctttcaagcgacgatcggataatgcgccttaaagaagggtacattaaggaagggagtactgtgagtgtgatgggggttgtacaaagaaatgacaacgtattgatgatagttcctccatcggagcccatttcgactggttgccagtgggccaagtgcgtcctcccaacgaacattgacgggctagttttaagatgcgaagatacgtcaaatattgatatcataccagtttagcaagatggaagctggaagaatcatcattgccaaagaaaaaaaatgcttgtgaaatatttggactttggattaatcttgtcgaatgctagaattgagataaatgtgcaaatgtgggtgtgattatggcaggttgagggtggttgattaagccgagatttggttgtatagttttcttaatgtgttttatgttttttttgggctgtgcgctttaaggtacttatgtaacatgatatgatggtttgactacagccatggagatgtagctgcttataaagtctagaattcggtttgtatgatctttgagc

SEQ ID NO: 2209 - DNA, 1874 bp, Pennisetum glaucum
cgcgacgtgcttgccattctctcgaggagctcatgcaaggtgtgggtttttcagcgataagggtagctgtgcatgccaagacccagatatagcctcacttaatcaagctgtgggttggtgggacacttgagatacaattgatcttcagcttcagaatatggggtcaagatttccatcacatcagctgagcaatggcctgtatgtttctggtcgacctgagcaacctaaggagaaggccccaaccatttgttccaatgtgatgccatatactggtggtgacatcaagagatctggagagctggggaagatgtttgatctccatgttgaaaagtcaagaaaatctggccctctaggcaacgctccttcaaggaatacttcatttggaggtgctgcttccaactccggacctgtatccaactctggcggtcgatccaactactccggttcgctttcgtcttcagttcctggtgctggtggttcagccagagcaaaatcaaactctggacctcttaataagcatggagaaccaacaaagaggtcctcaggtccccagtctgggggagtgaccccgatggcgcgccagaactcagggcctctccctcctgtgctccccacaactgggctcatcacatctgggcctatctcttcaggaccattgaatccgtctggtgctcagagaaaaatatctgggccacttgattctgcttcatccatgaaaatgcgggccacttcttttgctcacaatcaagccgttactaacctcaacactgaagatggttacactattcagggaagctttccaaagccaatactttgggctgtgattctgctcttcgtgatgggtttcatagctggtggcttcattctgggtgctgttcacaatgcgattttgctaatagttgttgtggtgatatttgggtttgttgctgcactgttaatctggaatgcttgctggggaaggagaggtgctattgggtttgttaatcgctatcctgatgctgatctcagaactgccaaagatggacagtatgtaaaggttacaggggtcgttacttgtggaaatttccccctcgagtcctcattccaaagggtcccaagatgtgtttacacttctactagcttgtatgagtacagaggttgggattccaaagctgccaacactgagcatcgccgttttacctggggtttgcgctcaatggagcgccatgcggtcgatttctacatttcagattttcaatctgggcttagagcattggtgaaaacaggatgtggtgcacgtgtgaccccatatgttgatgaatctgttattattgacatcaatcctgacaacaaggatatgtccccagagtttttgagatggctgagggaaaggaacctttcaagcgacgatcggataatgcgcctcaaagaagggtacattaaggaaggaagtactgtgagtgtgatgggggttgtgcaaagaaatgacaatgtgttgatgatagttgctccatcggagcccatctcgactggctgccagtgggccaagtgtgtcctcccaacgaacatcgacgggctagttttaagatgtgaagatacgtcaaatattgatgtcataccagtgtagtgagatggaagctggaagaatcgtcgccaaagaaaaaaaaatgcttgtgaaatatttggactttggatttatattgtgggcttctagaattgagataaatgtgcaaatgttgggtgtgattatggcaggttgagggtggttggttaagccgagatttggttgtatagtttttaatgtgttttatgttttttttcagttatgagctctaagttcttctgtaacatgatggtttgattactaccatggagatgaagttgcttaaagtaca

SEQ ID NO: 2210 - DNA, 1948 bp, Pennisetum glaucum
caggtggagggaggtgggcggaggagagagcaagcgcgcaggcgcagcaggggagggggaggcagaccaggcggggcagcagcgcgacgtgcttgccattctctcgaggagctcatgcaaggtgtgggtttttcagcgataagggtagctgtgcatgccaagacccagatatagcctcacttaatcaagctgtgggttggtgggacacttgagatacaattgatcttcagcttcagaatatggggtcaagatttccatcacatcagctgagcaatggcctgtatgtttctggtcgacctgagcaacctaaggagaaggccccaaccatttgttccaatgtgatgccatatactggtggtgacatcaagagatctggagagctggggaagatgtttgatctccatgttgaaaagtcaagaaaatctggccctctaggcaacgctccttcaaggaatacttcatttggaggtgctgcttccaactccggacctgtatccaactctggcggtcgatccaactactccggttcgctttcgtcttcagttcctggtgctggtggttcagccagagcaaaatcaaactctggacctcttaataagcatggagaaccaacaaagaggtcctcaggtccccagtctgggggagtgaccccgatggcgcgccagaactcagggcctctccctcctgtgctccccacaactgggctcatcacatctgggcctatctcttcaggaccattgaatccgtctggtgctcagagaaaaaatatctgggccacttgattctgcttcatccatgaaaatgcgggccacttcttttgctcacaatcaagccgttactaacctcaacactgaagatggttacactattcagggaagctttccaaagccaatactttgggctgtgattctgctcttcgtgatgggtttcatagctggtggcttcattctgggtgctgttcacaatgcgattttgctaatagttgttgtggtgatatttgggtttgttgctgcactgttaatctggaatgcttgctggggaaggagaggtgctattgggtttgttaatcgctatcctgatgctgatctcagaactgccaaagatggacagtatgtaaaggttacaggggtcgttacttgtggaaatttccccctcgagtcctcattccaaagggtcccaagatgtgtttacacttctactagcttgtatgagtacagaggttgggattccaaagctgccaacactgagcatcgccgttttacctggggtttgcgctcaatggagcgccatgcggtcgatttctacatttcagattttcaatctgggcttagagcattggtgaaaacaggatgtggtgcacgtgtgaccccatatgttgatgaatctgttattattgacatcaatcctgacaacaaggatatgtccccagagtttttgagatggctgagggaaaggaacctttcaagcgacgatcggataatgcgcctcaaagaagggtacattaaggaaggaagtactgtgagtgtgatgggggttgtgcaaagaaatgacaatgtgttgatgatagttgctccatcggagcccatctcgactggctgccagtgggccaagtgtgtcctcccaacgaacatcgacgggctagttttaagatgtgaagatacgtcaaatattgatgtcataccagtgtagtgagatggaagctggaagaatcgtcgccaaagaaaaaaaaatgcttgtgaaatatttggactttggatttatattgtgggcttctagaattgagataaatgtgcaaatgttgggtgtgattatggcaggttgagggtggttggttaagccgagatttggttgtatagttttttaatgtgttttatgttttttttcagttatgagctctaagttcttctgtaacatgatggtttgattactaccatggagatgaagttgc

SEQ ID NO: 2211 - DNA, 2275 bp, Oryza sativa
tgctgccaacatccattcccccctccccctctgctgctgctgctgctgctgccgcctcgactcctcctcctagatctggaagctcactcccccccccacccccacccacctcctcgccgccgatctccaccgcattcccctcctcctcgtcgccggcgacctccccccgcccccctgatctccgtcgtccagcggcatcgtcgtcggtgagcgaaggtgctgatacaaggtgttgtctgagtctgcaaatattgatgatgtgcctaaaagtttgacagtcttgcttgaatacacagcagcattacttggttacactctgaaggtgtagttgcctttgttggtttagaacatgggttcacggtttccatcccaccaactaagcaatggcctttatgtctcgggccgaccagagcaacctaaggagaaggctccagtcatttgctccacagcaatgccatacactgggggtgacataaagaaatctggagaactagggaaaatgtttgacctccatgttgaaaagtcgcggaagtctggtcctttgggtaatcaaccttcaagaaatacttcatttggtggtgctggttccaactctggaccagtttctaatgctcttggtcggtccaactactctggttctatttcatcatctgttcctggtgctggaggatcagcaagggcaaaatcaaattctggacctctcaataagcatggagaaccaggaaagaagtcatctggtccccagtcaggcggagtgaccccaatggcacgtcagaattctggtcctttacctcctgttcttcctacaactgggctgatcacatcagggcctatctcctctggacctctgaattcatctggtgctccacgaaaagtatcaggccctcttgatcctagtgtatcaatgaagatgcgtgcaacttcttttgctcacaacccagctgttacaaacctgaatgccgatgatggttactctattaagggcagcattcctaagacaatactctggatggttattctgctctttttgatggggttcatagcaggtggtttcattcttggagctgttcataaccctattctgctggtagttgtggtggtcatattttgctttgttgctgctcttgtgatttggaacatttgctggggaacaagaggtgtgactgggttcgtcagtcgctatcctgatgctgatctcagaacagcaaaagatggacagtatgtgaaagttactggggttgttacatgtggaaattttcctctcgagtcctcatttcaaagggtcccaagatgtgtgtacacttcaacttgcttgtatgagtacaggggctgggattcgaaagctgctaacactgagcaccgccaatttacttggggtcttaggtcaatggagagacatgctgttgatttctacatctctgatttccaatctggactacgagcattggtcaaaacaggatatggagcacgggtaaccccttatgttgatgaatctgttgttattgacataaacccagataacaaggacatgtctcccgagttcttgagatggctgcgtgaaaggaatctatcaagtgatgatcggataatgcgcctgaaagaaggatacattaaggagggcagcacggtgagtgttatgggggttgttcaaaggaacgacaacgtgttgatgattgttcctccatcggaacccatctccactggctgccagtgggccaagtgcatcctccctactagccttgatgggctagtcttaagatgcgaagatacatcgaacatcgatgtaataccagtctgagcttagctttgttctggcagctactcctagaaagaaaatgcctgtcaaaatctttggatttatttcgtgggatgttagagttgaaagatgtgcaaatgcagggtgtgattatggctaagtacaatatcggtggtctattatttgggtcttggttgtatagtattttatgtattttttctctcttcttttttctttcttttggtgatctatggatacttgtaacatggatggcttgagttgtaccttggagctgtttggagattcagtggaatcgagttcacaaggttttttggtgaagaattccagcagtatcataagtcgttccagtttcaatttatgcacctttactctaaaacttcctggtctcttggtaggtatattttcatggacataatgtataaatttcgtttgtaattaattccggtctctgtaagatatgaatcaatttatttggaggaattcctaaacttctttttt

SEQ ID NO: 2212 - DNA, 2110 bp, Brachypodium distachyon
gagcgactcagcagtcagccccctcgctccgtggatcgtcttcctcctcgcgcgagcgccgccacccgtcccgctgccgagcgccggagccccctagctcgtcttcctcctcgcgcgagcgcctccaacgcaggttctgatgcatggtgttggttgtgtctgagaatgctgagggttatctccaaagcttggtagtctcattttaatacacaacacaactacttggctgtactctagggtcataggtcttgaatctgcccattcagaacatgggttctcggtttccatcccaccagttaagcaatggactttatgtctcggggcgacctgagcaacctaaggagaagtctccggttgtttgctccgcagctatgccatacactgggggggacatcaagaaatcgggagaacttgggaagatgtttgatctccatgctgagaagtcacggaaatctggtcctttgggtaatcaaccttcaaggaatacttcatttggtggtgctggttcgaactctggaccagtttctagtgctgttggtcgatccaactactccggttctatttcatcagcagttcctggcactggaggttcggcaagggcaaaatctaattctggaccactcaataagcatggagaaccaacaaagagatcgtctggcccccagtcaggaggagtgaccccaatggctcgccagaattctggccatctacctcctattcttcctacaactgggttgattacatcaggacctatctcatctggaccgttgaattcatctggtgcccaacgaaaagtatcaggccctcttgattctaatgtatcaatgaagatgcgtgccacctcttttgctcacaaccaagctgttacaaatctcaatgcggatgctggcttcttgattaaggccagtttgccaaagccaatactctggacggccattctactctttgtgatggggttaatagcaggttgcttcattcttgccgctgttcataatccgatcctgctggtagttgtggtggtgatatttgggttcgttgctgcactcttgatatggaacatttgctggggaaaaagaggtgtgactaagtttgtcagttgctatcctgatgctgatcttagaatcgcaaaagatggagagtatgtgaaggttactggggttgttacttgcggaaatttccccctcgagtcctcatttcaaagggttccaagatgtgtgtacacttcaacctgcctgtatgagtataggggctgggactcgaaagctgccaacactcagcatcgccgatttacctggggattgcggtcagtagagcgacatgctgttgatttctacatctctgatttccaatctgggctgcgagcattggtcaaaacaggatacggtgcacgggtagctccatatgtagatgaatctgttgttattgacataaatccagaaaacaaggacatgtcccctgaatttctgagatggctacgggaaaggaatctctcaagtgatgatcgtataatgcgcctaaaagaaggatacattaaggagggaagcactgtaagtgtcatcggggttgttcaaaggaacgacaatgtgctgatgatcgttccgccatctgaaccgttctccactggctgccaatggaccaagtgcatcctcccaactagccttgatggactagtcttgagatgtgaggatgcatcaaacggcgatgtaataccagtgtagctcgctagcctcgctctggcagctgattgggagaaaaaggaaacaacgcctgtcaacatttgactttggatttgtttcatgggatgtttggattgaaaaatgtgcaaatgcagggtgtgattatggttaagtacaatttcggtggtcagggcttgattgtgtagtattttatgtgttttttctattttcggttgagcttgtaacatggatgacttgagtactaccatggagctgtttggagttctagtggaatcaggttcatatgtttttttggtttgtagaattccggcaatatcataaaccattcctccaattcccctttctgtatctataattctatacataattccatctctcgctgtaggtctattatccagaatgaggatttgttg

SEQ ID NO: 2213 - DNA, 2261 bp, Oryza sativa
gctcctcctctactccccccccccccctcccccctccccttcttcctctctgtctccagcgcacgcacgcacgaccacctcgcctcctctcctctcccctcccctcccccacctcgcctcgcctccacgcgcgcgacgcggccggcgacggcgagccgcacggcgcgtgggcgtgcctctcctcagccggcggctagccctctcctcgcgcgggggcggcggcggcggcggttgttgctggcctcattccaccgccatccctcctccgtgtctcgggctcgactcggtggtgaaggtcaggtgctgatgcaagatataggttgttctatgagaaggatagctgtgcacatcaagacccaaatataatctcacttggttgtactatagtggtggttgaacactaagatatagcttattctgttgtttcaaaaacatgggttcgaggtttccatcgcatcagcttagcaatggcctgtatgtgtctggccgacctgagcaaccgaaggagaaggccccaaccatttgttccactgccatgccatacactggtggtgatataaaaaaatctggagagcttgggaagatgtttgagctccacgctgtcaagtcaagaaaatctggtccactgagcaatgcaccttcgaggaatgcgtcatttggaggtgctgcatcaaactctggacctgtccctaatgccggggatcggtccaactactctggttctctatcatcttcagttcctggtgctagtggatcagcaagagcaaaatctagctccggacctctcaataagcatggagaaccagtaaagagatcatcaggtcctcagtctggaggagtgaccccaatggcgcggcagaattctggccctctccctcctatgcttcctacaactggacttatcacatctgggcctatcacatcggggccactgaattcgtctggtgctcaaaggaaagtatctggacctcttgattctgctgcatccaagaagacgcgggccacatccttttctcataaccaggctgttactaaaatcaccacagaagacagttactcaatcacaggaagcctttcgaagctaatactcggggcagtgggtgtgctctttgtgttggggctcatagcaggcatcttgattcttagtgctgttcacaatgcaattcttctgatagttgttctggtgctgtttggttttgttgctgcacttttcatttggaatgcttgctgggcaaggagaggtgtgattgggtttgtggatcgctattctgatgctgatctaagaactgctaaagatggacagtatatcaaggttacaggggttgttacttgtggaaatttccctctcgagtcctcgtatcaaagggttccaagatgtgtgtacacttcaactaccttacatgaatataggggttgggactcaaaagctgccaacacccagcatcaccggtttacctggggattacggtcaatggagcaacacgcagtggatttctacatctcagattttcaatctgggctccgggcattggtgaaagcaggatatggtgctcgagtgaccccattcgtggatgaatctgtcattattgacattgatcctgacaacaaagacatgtcccctgaatttcgaagatggctgcgggaaaggaatctctcaagtgatgatcggataatgcgcctaaaagaaggatacattaaggaaggcagcaccgtgagtgtgatgggggttgttcaaaagaatgacaacgtgttgatgattgttcctccaccagagcccatctctactggttgccagtgggccaagtgtgtcctcccaagggacctttatggattagtcctgagatgtgaagatacctcaaatatcgatgtcatagcggtttagcaagctgggtgttggaacttagaagagctgctgctgaagaagtgctttttaaatgttttgacttggagtttgtttcgtggaatgttagaattgagaaaaatgtacaaatgttggggatgattaaggttagtaaaaatagatgttaagctggggtttggatgtatagtcttttcttgtattttgtcctttcttttcacctattcctcggttatgagcactgaatgcttgtcttgtgaaatatgatggcttggttattactaccatccagctgtttgaagacttagtgaaattgggtaaacaactatatatgtttttttcaactagatgtatcactgctgttaaagcccttccatgttccatttaggtgtctatgttatgc

SEQ ID NO: 2214 - DNA, 2236 bp, Brachypodium distachyon
aaacagagaaagggacagggaaagggacacagcagaagagctcttccttttcctctcccctcccacggcgccgacggtgtcatccaacccaccatctccggacacagccagcccccactcttcccattccacccagccacgcacgccgcctccaacgagtccttctcgcattcctaccgccgccgccgccgccgtcctcatacttctccgctcggctggactggcatggagcggagatccaccccggccttggaggattggtttcttcggggctgattcacggtgttggttgtatctgagaatgctggggctgtgctccaaagcttggtagattcatttcaatacacaatacaactacttagacatagtctgaggccagttgaatctgctgctttagaacatgggttctcgatttccatcgcaccagttaagcaatgggctttatgtctcggggcgacctgagcaacctaaggagaagtctccggttgtttgttccacagctatgccatacactgggggggacatcaagaaatctggagaacttggcaagatgtttgatctccatgctgagaagtcacgcaaatctggtcctttgggtaatcaaagttccaggaatacttcatttggtggtgctgcttccaactctgggccagttgctagtgcagttggtcgacccagctactctggttctatttcatcagcggctcctggcactggaggttcggcaagggcaaaatctaattctggaccgctgaataggcatggagaaccaacaaagagatcctctggcccccaatcaggaggagtgacccctacgactcgccagcactctggccctctacctcctattcttcctacaactgggttgatcacatcaggacctatctcatctggacctttgaattcatcgggtgctccacggaaagtatcaggccctcttgattctactgtttcaaagaagatgcgtgccacctcttttgctcagaaccaggctgtaacaaatctcaatgaagaagatggctactcgatcaaggacagtttgccaaaaccaatacgatgggcgatcattctgctctttctgttggggttcatagcaggtggcctcattcttggcgctgttcataattcgattttgctactggttgtggtagttatatttggatttgttgctgcactcttgatttggaacatttgctggggaacaagaggtgtgactgggtttgtcagtcgctatcctgatgctgatcttagaacagcaggagatggacagtatgtgaaggttactggggttgttacttgtggaaattttcccctcgagtcgtcatttcaaagggtcccaagatgtgtatacacttcgacatgcttgtatgagtacaagggttgggactcaaaagccgccaacactcagcagcgccgatttacctggggattacggtctatggagcgacatgcggttgatttctacatctctgatttccaatctgggctgcgagcattggtcaaaacaggatatggtgcacggctaaccccatatgtggatgagtctgttgttattgacataaatccagaaaacaaggacatgtcccctgaatttctgagatggctacgggaaaggaatctctcaagtgatgattgcataatgcgcctaaaagaaggatacgtaaaggagggaagcactgtgagtgtcattggagttgttcaaagaaacgacaatgtattgatgattgttccgccatctgaacccttctcgactggctgccattgggccaagtgcatcctcccaactagccttaatggactagtcttgagatgtgaagatacatcaaacggagatgtaataccagtttagctagcatctcactggcagtttggtgtgtgaaaaaaatgcccgtcaaaatatttgacttcggattcgtttctgggatgttaggattgaaaaatgtgcaaatgcagggtgtgattacggtaaatacaatatcggtggtcagttactcacggattgactgtgtagtatttaatatacactattttttggttgagctttgtagcaggtagctgtttggagtgttagtggaatcaggctcattatttctttgtctgtagaattccagaaatcgtaaaccatacgcccaacccccccttcctgtatctatatttctatacatacttacatctctcatggtaggtatattttattcaagaatgaagatttggcaatgtattttctccagccttt

SEQ ID NO: 2215 - DNA, 1963 bp, Pennisetum glaucum
ggcaggaaaggggatagcaccgtcggccgccgctctcctcaggtgctgatgcaaggctttcaaaacctcaacaatctcacttgacacaacacaatcacactgaaggtttagttggattggccatttcagaacatgggttcacgatttccatcccaccagctaagcaatggcctgtatgtctctggccgacctgagcaacctaaggagaaggccccagtcatttgctcctcagctatgccatacactggcggggacataaagaaatctggagagcttgggaagatgtttgatctccatagaaaatctggtcctttgggtaaccaaccttcaaggaatacttcgttcagtggtgctgcctccaactctggaccagtttctaatgctgttggtcgctccaactactctggttctatttcatctgcagttcctgggactggaggatcttcaaggacaaaatctaattctggacctctcaataagcatggagagccgacaaagaggtcgtctggcccccaatcaggtggagtaacccccatggcccgccagaactctggccctctacctcctgttcttcctacaactgggctaattacatcaggtccaatcacctcgggtcagatgaattcatctggtgctcaaaggaaagtatcaggccctcttgattccagtgtatcaatgaagatgcgtactgcctcttttgcacacaacccagctgtcacaaatctcaatgcagaggatggttactcgattaagggcagcattccagcagcaataatgtggttggttgcattgctttttgtggttggatttgtggcaggaggcttcattcttgctgctattcataatccgaccttgctcatagttgttgtggtgatatttgcttttgttgctgcacttgtcacctggaacatctgctggggaacaaaaggtgtgactgcgtttgtcagacgctatcctgatgcagatcttagaactgcaaaagacggagagtatgtgaaggttactggggttgttacttgtggaaatttgcccctcgagtcctcattccaacgggttccgagatgtgtttacacttccacttgcttgtatgagtataggggttgggattcaaaagctgctaacactacacatcgccggttcacttggggactcaggtcaatggagcgacatgcagtggatttctacatctctgatttccagtcaggattgcgggcacaggtgaaaacaggatttggtgcacgtgtaaccccatatgttgatgaatctgtcgttattgacataaacccagacaacaaggacatgtcgcctgaattcctaaggtggctgcggggaaggaacctctcgagcgatgatcggattatgcgcctgaaagaagggtacatcaaggagggcagcactgttagcgtgatgggtgttgttcaaaggaacgataacgtgctgatgatcgttcctcctgctgaacccatctccactggctgccagtgggccaagtgcatgctcccaaccagcctcgatggcctggtcctgaggtgcgaagatacatccgacatggatgtgataccggtctaggtagggagcttggctctggcgatcctctggtccggagaaagagagaaaaaaagatgccttgacttttgatttggttttcagtggggatgttaggattgaaagaatgtgcaaatgcagggtgtgattatatgggctaagtaagtacaacaatatcagtggatggtcggttacatggagcttggttgtatagtatattatatgtaattttctcttctctttttggttgagccatggatgatacctgtaacatggatggcttgatgtcagtactacctacctacctaccatggagcctgtttggagattcagtggtttccagtttatattatgtttccttttttttgttggaggtagggttccagcaacaccatgaagcctgcaatttcctttttgt

SEQ ID NO: 2216 - DNA, 1921 bp, Pennisetum glaucum
ccacagccgacaacccaccgtctcgcggtggggaggggaggaggaaggaaggaaggaaaggggatagcaccgtcggccgccgctctcctcaggtgctgatgcaaggctttcaaaacctcaacaatctcacttgacacaacacaatcacactgaaggtttagttggattggccatttcagaacatgggttcacgatttccatcccaccagctaagcaatggcctgtatgtctctggccgacctgagcaacctaaggagaaggccccagtcatttgctcctcagctatgccatacactggcggggacataaagaaatctggagagcttgggaagatgtttgatctccatagaaaatctggtcctttgggtaaccaaccttcaaggaatacttcgttcagtggtgctgcctccaactctggaccagtttctaatgctgttggtcgctccaactactctggttctatttcatctgcagttcctgggactggaggatcttcaaggacaaaatctaattctggacctctcaataagcatggagagccgacaaagaggtcgtctggcccccaatcaggtggagtaacccccatggcccgccagaactctggccctctacctcctgttcttcctacaactgggctaattacatcaggtccaatcacctcgggtcagatgaattcatctggtgctcaaaggaaagtatcaggccctcttgattccagtgtatcaatgaagatgcgtactgcctcttttgcacacaacccagctgtcacaaatctcaatgcagaggatggttactcgattaagggcagcattccagcagcaataatgtggttggttgcattgctttttgtggttggatttgtggcaggaggcttcattcttgctgctattcataatccgaccttgctcatagttgttgtggtgatatttgcttttgttgctgcacttgtcacctggaacatctgctggggaacaaaaggtgtgactgcgtttgtcagacgctatcctgatgcagatcttagaactgcaaaagacggagagtatgtgaaggttactggggttgttacttgtggaaatttgcccctcgagtcctcattccaacgggttccgagatgtgtttacacttccacttgcttgtatgagtataggggttgggattcaaaagctgctaacactacacatcgccggttcacttggggactcaggtcaatggagcgacatgcagtggatttctacatctctgatttccagtcaggattgcgggcacaggtgaaaacaggatttggtgcacgtgtaaccccatatgttgatgaatctgtcgttattgacataaacccagacaacaaggacatgtcgcctgaattcctaaggtggctgcggggaaggaacctctcgagcgatgatcggattatgcgcctgaaagaagggtacatcaaggagggcagcactgttagcgtgatgggtgttgttcaaaggaacgataacgtgctgatgatcgttcctcctgctgaacccatctccactggctgccagtgggccaagtgcatgctcccaaccagcctcgatggcctggtcctgaggtgcgaagatacatccgacatggatgtgataccggtctaggtagggagcttggctctggcgatcctctggtccggagaaagagagaaaaaaagatgccttgacttttgatttggttttcagtggggatgttaggattgaaagaatgtgcaaatgcagggtgtgattatatgggctaagtaagtacaacaatatcagtggatggtcggttacatggagcttggttgtatagtatattatatgtaattttctcttctctttttggttgagccatggatgatacctgtaacatggatggcttgatgtcagtactacctacctacctaccatggagcctgtttgga

SEQ ID NO: 2217 - DNA, 2170 bp, Saccharum officinarum
ctctcgtctccctagcctacgccgtcgctcactttttttctctctctcgcctcccgttccccccgcgtgcgctctctccctccctctcttgtgaggagtgaggacgactggggcgaccgacgccgccgccgccgccctacgacaggtgcccaggtcgttgtcaggcccttcgccagctcttctccgggcccttcgccggcgacgagcacccaccagttgctgatgcaaggctttcacaagtttaacagtctcacttgacgcaaaagcaacacaatcaatctaaaggtttagacagtcatttcagagcatgggttcacggtttccatcccaccagctaagcaatggcttgtatgtctcgggccgacctgagcaacctaaagagaaggccccagtcatttgctcctcggctatgccatacactggtggggatataaagaaatctggagagcttggaaagatgtttgatctccacagaaaatctggtccattgggtaatcaaccttcaaggaatacttccttcggtggtgctgccaacaactctggaccagtttctaatgctgtcggtcgctccaactactctggttctatttcgtctgcagttcctggtactggaggatcttctagaacaaaatctaattctggacctctcaataagcatggagaaccaacaaagaggtcatctggcccccaatctggtggagtaaccccaatggcccgtcagaactctggccctctgcctcctgtgctaccaacaactgggctaatcacatcaggtcctatcacctctggtcagttgaattcatctggtgctcaacggaaagtatcaggccctcttgattctagtgtatcaatgaagatgcgtaccacctcttttgcacacaacccagctgtcacaaatctcaatgtgggagatggttactcgattaagggcagcattccgaccacaataatctggctggtcgcgttgctctttttggttgggttcgtagctggtggcttcattctcgctgctattcataatccgatcttgcttatagtcgtggtggtgatatttggttttgttgctgcactggtgacctggaacatctgctggggaacaaaaggtgtgatcgggtttatcagtcgctatcctgatgcagaccttagaaccgcaaaagatggagagtatgtgaaggttactggggttgttacatgtggaaatctgccccttgagtcctcgttccaacgggtgccgcgatgtgtttacacttcaacttgcttgtatgagtataggggttgggattcgaaagctgctaacactacgcatcgccgatttacttggggtctcaggtcaatggagcgacatgcagtggacttctacatctctgatttccagtctggactgcgagcattagtcaggacaggatctggtgcacgtgtaaccccatatgtggacgaatctgttgttattgacataaacccagacaacaaggacatgtcgcctgaattcctgaggtggctccgtggaaggaatctctcgagtgatgatcggattatgcgccttaaagaaggatatatcaaggagggcagcactgtgagtgtgatgggtgttgttcaaaggaatgagaacgtgctgatgatcgttcctccagctgaacccatctccactggctgccaatgggccaagtgcatcctcccggccagcctcgagggcctggtcctgagatgcgaagacacatctgacctggatgtgataccagtctagctagagggattggttctggcgatcctctggtgcggagaaagagaaaaaagatgccttgacttttgatttggtttctgtgggttgttagggttgaaagaatgtgcaaatgcagggtgtgattatgggctaagtaagtacaatatcagtggtcggtcagttacctggagcttggtcgcatagtatattatatgtaattttctcttctcttttttggttgagccatggatggtgcttgtaacaaggatggcttgatgtcagtactacctaccctgccatggagcctgtttggagattcagtggtttccagttcatattatgttcctgtttttgttgtagggttccagcaatgccttgaaacctgcaatttccctttttgtacccagatcttcataaaaatcgctagcctgcacatggcaggtatatttc

SEQ ID NO: 2218 - DNA, 2155 bp, Saccharum officinarum
cccacgcgtccgctttttctctctctctctctcgcctcccgttccccccgcgtgcgctctctccctccctctcttgtgaggagtgaggacgactggggcgaccgacgccgccgccgccgccctacgacaggtgcccaggtcgttgtcaggcccttcgccagctcttctccgggcccttcgccggcgacgagcacccaccagttgctgatgcaaggctttcacaagtttaacagtctcacttgacgcaaaagcaacacaatcaatctaaaggtttagacagtcatttcagagcatgggttcacggtttccatcccaccagctaagcaatggcttgtatgtctcgggccgacctgagcaacctaaagagaaggccccagtcatttgctcctcggctatgccatacactggtggggatataaagaaatctggagagcttggaaagatgtttgatctccacagaaaatctggtccattgggtaatcaaccttcaaggaatacttccttcggtggtgctgccaacaactctggaccagtttctaatgctgtcggtcgctccaactactctggttctatttcgtctgcagttcctggtactggaggatcttctagaacaaaatctaattctggacctctcaataagcatggagaaccaacaaagaggtcatctggcccccaatctggtggagtaaccccaatggcccgtcagaactctggccctctgcctcctgtgctaccaacaactgggctaatcacatcaggtcctatcacctctggtcagttgaattcatctggtgctcaacggaaagtatcaggccctcttgattctagtgtatcaatgaagatgcgtaccacctcttttgcacacaacccagctgtcacaaatctcaatgtgggagatggttactcgattaagggcagcattccgaccacaataatctggctggtcgcgttgctctttttggttgggttcgtagctggtggcttcattctcgctgctattcataatccgatcttgcttatagtcgtggtggtgatatttggttttgttgctgcactggtgacctggaacatctgctggggaacaaaaggtgtgatcgggtttatcagtcgctatcctgatgcagaccttagaaccgcaaaagatggagagtatgtgaaggttactggggttgttacatgtggaaatctgccccttgagtcctcgttccaacgggtgccgcgatgtgtttacacttcaacttgcttgtatgagtataggggttgggattcgaaagctgctaacactacgcatcgccgatttacttggggtctcaggtcaatggagcgacatgcagtggacttctacatctctgatttccagtctggactgcgagcattagtcaggacaggatctggtgcacgtgtaaccccatatgtggacgaatctgttgttattgacataaacccagacaacaaggacatgttgcctgaattcctgaggtggctccgtggaaggaatctctcgagtgatgatcggattatgcgccttaaagaaggatatatcaaggagggcagcactgtgagtgtgatgggtgttgttcaaaggaatgagaacgtgctgatgatcgttcctccagctgaacccatctccactggctgccaatgggccaagtgcatcctcccggccagcctcgagggcctggtcctgagatgcgaagacacatctgacctggatgtgataccagtctagctagagggattggttctggcgatcctctggtgcggagaaagagaaaaaagatgccttgacttttgatttggtttctgtgggttgttagggttgaaagaatgtgcaaatgcagggtgtgattatgggctaagtaagtacaatatcagtggtcggtcagttacctggagcttggtcgcatagtatattatatgtaattttctcttctcttttttggttgagccatggatggtgcttgtaacaaggatggcttgatgtcagtactacctaccctgccatggagcctgtttggagattcagtggtttccagttcatattatgttcctgtttttgttgtagggttccagcaatgccttgaaacctgcaatttccctttttgtacccagatcttcataaaaatcgctagcctgcacatggcaggtatatttc

SEQ ID NO: 2219 - DNA, 2170 bp, Triticum aestivum
tgctgagttgctcctgcctgcgtaggtccaccaacagcgacagagacagacggtcggacacacccagagagcttccttttcccacagcgccgacggtgtcatccaacccaccatctcggccgaacaaccctcctccctccactccttccattccatttccacccatccacgcgcgctcgcacgccgccacagaggaatcgttctggcattcccgttccgcctccgtcgtcgccgtcgcactcctctgctgggccaccatataacggagatccacccgggcttggaggattggtttcttcggtgctgatgcaaggtgtttgttgtatctgagaattcagaatatgggttctcggtttccatcccaccaattaagcaatgggctttatgtctctgggcgacctgagcaaccaaaggagaaggctccggttgtttgctctgcagctatgccatacactgggggtgacatcaagaaatcaggagaactagggaaaatgtttgatctccatgctgagaagtcacggaaatctggccctttgggtaatcaaccttcaaggaatacttcatttggtggtgctgcttccaattctggaccagtatctagtgctgcttctcgatccaactactctggctctatttcagcagcggttcctggcactggaggttcggcaagggcaaaatctaattctggaccgctcaataagcatggagaaccaacaaagagatcctctggcccccagtcaggaggagtgaccccaatggctcgccagaattctggccatctaccgcctattcttccgacaactgggctcatcacatcaggacctatctcctctggacagttgaactcatctggtgctctacgaaaagtatcaggcactcttgattctactgtttcgatgaagatgcgtgccacctcttctgcttacaacccggctgttacaaatattaatgagcaaaatagctactcaattaaggccagtttgccaaagccaatactatgggcggctattctgctctttgcgatggggttcatagcaggtggcttcattctagctgctgttcataattcaattttgctggtagttgttgtggtgatatttggatttgttgctgcgctcttggtttggaacatttgctggggaacaagaggcatgactaggtttgtcagtcgctatcctgatgctgatcttagaattgcgaaagatggagagtatgtgaaggtcacaggggttgttacttgtggaaatttcccccttgagtcctcatttcaaagggttccaagatgtgtatacacttcgtcctgcttgtatgagtataggggttgggactcaaaagctgccaacactcagcatcgccgatttacttggggattacgttcaattgaacggcatgcggtcgatttctacatctctgatttccaatctgggctgcgagcattggtcaaaataggatatggtgcacggctaatcccatatgtcgatgaagctgttgttattgacataaatccagaaaacaaggacatgtcccctgaatttttgagatggctacgggaaaggaacctctcaagtgatgatcgtataatgcgcctaaaagaaggatacattaaggagggaaacactgttagtgtcatcggtgttgttcaaaggaacgataatgtgctgatgattgttccaccacctgaacccttcaacactggttgccagtggggcaagtgcctcctcccaactagccttgatggactagtcttaagatgtgaagacacgtcgaacggtgatgtaattccagtatagctatctagcctcgttctggcagttcacctggggaaaagggaaaacaatatttgactttgggtttattttatggattgaaaaatgtgcaaatgcaaggtgtgattatggtttagtacaatattgatagtcagttgctcacggcttgattgtgtagtattttttgcattttgctcttttttggttgggcaatgaatacctgtaagattgatggcttcagtactaccatggagctctttggagatagagtggaaccatgttcatatgttttttttcttttggtttgtagcattacagcatcataaaccattctccagttcccctatctgtatctatactttatacacaactccagctctcatggtagatatgttctcataacc

SEQ ID NO: 2220 - DNA, 1971 bp, Triticum aestivum
ccacgcgtccacccatccacgcgcgctcgcacgccgccacagaggaatcgttctggcattcccgttccgcctccgtcgtcgccgtcgcactcctctgctaggccaccatataacggagatccacccgggcttggaggattggtttcttcggtgctgatgcaaggtgtttgttgtatctgagaattcagaatatgggttctcggtttccatcccaccaattaagcaatgggctttatgtctctgggcgacctgagcaaccaaaggagaaggctccggttgtttgctctgcagctatgccatacactgggggtgacatcaagaaatcaggagaactagggaaaatgtttgatctccatgctgagaagtcacggaaatctggccctttgggtaatcaaccttcaaggaatacttcatttggtggtgctgcttccaattctggaccagtatctagtgctgcttctcgatccaactactctggctctatttcagcagcagttcctggcactggaggttcggcaagggcaaaatctaattctggaccgctcaataagcatggagaaccaacaaagagatcctctggcccccagtcaggaggagtgaccccaatggctcgccagaattctggccatctaccgcctattcttccgacaactgggctcatcacatcaggacctatctcctctggacagttgaactcatctggtgctctacgaaaagtatcaggcactcttgattctactgtttcgatgaagatgcgtgccacctcttctgcttacaacccggctgttacaaatattaatgagcaaaatagctactcaattaaggccagtttgccaaagccaatactatgggcggctattctgctctttgcgatggggttcatagcaggtggcttcattctagctgctgttcataattcaattttgctggtagttgttgtggtgatatttggatttgttgctgcgctcttggtttggaacatttgctggggaacaagaggcatgactaggtttgtcagtcgctatcctgatgctgatcttagaattgcgaaagatggagagtatgtgaaggtcacaggggttgttacttgtggaaatttcccccttgagtcctcatttcaaagggttccaagatgtgtatacacttcgtcctgcttgtatgagtataggggttgggactcaaaagctgccaacactcagcatcgccgatttacttggggattacgttcaattgaacggcatgcggtcgatttctacatctctgatttccaatctgggctgcgagcattggtcaaaataggatatggtgcacggctaatcccatatgtcgatgaagctgttgttattgacataaatccagaaaacaaggacatgtcccctgaatttttgagatggctacgggaaaggaacctctcaagtgatgatcgtataatgcgcctaaaagaaggatacattaaggagggaaacactgttagtgtcatcggtgttgttcaaaggaacgataatgtgctgatgattgttccaccacctgaacccttcaacactggttgccagtggggcaagtgcctcctcccaactagccttgatggactagtcttaagatgtgaagacacgtcgaacggtgatgtaattccagtatagctatctagcctcgttctggcagttcacctggggaaaagggaaaacaatatttgactttgggtttattttatggattgaaaaatgtgcaaatgcaaggtgtgattatggtttagtacaatattgatagtcagttgctcacggcttgattgtgtagtattttttgcattttgctcttttttggttgggcaatgaatacctgtaagattgatggcttcagtactagtactaccatggagctctttggagttagagtggaaccatgttcatatgtttttttttattttggtttgtagcattacagcatcataaaccattctccagttcccctaat

SEQ ID NO: 2221 - DNA, 2083 bp, Panicum virgatum
ccccattctgccattccacagcccaaacccaccgtcttggagtggggggaggaggaaggggatagcgccgccggctgccgcttgccgcaggtgctgatgcaaggctttcaaaagttcaacaatctcacttgacgcaacacaatcactctgaaggtatagttggatcggtcatttcagaacatgggttcacggtttccatctcaccagctaagcaatggcctctatgtctcgggccgacctgagcaacccaaggagaaggccccagtcatgagctcctcagctatgccatacactggtggggacttgaagaaatctggagagcttggaaagatgtttgatctccatagaaaatctggtcctttgggtaatcaaccttcaaggaatacttcatttggtggtgctgcctccaactctggaccagtttctaatgccgttggtcgctccaactactctggttccatttcatcggcagttcctggcactggaggatcttcaaggacaaaatctaattctggatctctcaataagcatggagaaccgacaaagaggttgtctggcccccaatcaggtggagtaacccccatggcccgccagaactctggccctctacctcctgttcttcctacaactgggctaattacatcaggtccaatcacctcgggtcagatgaattcatccggtgctcaaaggaaagtatcaggccctcttgatcctagtgtatcaatgaagatgcgtactgcctctttcgcacacaacccagctgtcacaaatctcaatgcagaagatggttactcgattaagggcagcattccaactgcaataatgtggttggttgcgttgctttttgtggttgggttcgtggcaggtggcttcattcttgctgctattcataatccaatcttgctcatagttgttgtggtgatatttggttttgttgctgcacttatcacctggaacatctgctggggaacaaaaggtgtgactaggtttgtcagtcgctatcctgatgcagatcttagaactgcaaaagatggggagtatgtgaaggttactggggttgttacttgtggaaatttgccccttgaatcctcattccaacgggttccgagatgtgtttacacttccacttgcttgtatgagtataggggttgggattcaaaagctgccaacactacacatcgccgatttacttggggactcaggtcaatggagcgacatgcagtggatttctacatctctgattttcaatcggggctgcgtgcactggtcagaacaggatttggtgcacgtgtaaccccatatgttgatgagtctgtcgttattgacataaacccagacaacaaggacatgtcgccagagttcctaaggtggctgcggggaaggaacctctcgagcgatgatcggatcatgcgcctgaaagaagggtacatcaaggagggcagcactgttagcgtgatgggtgttgtccaaaggaacgataacgtgctgatgatcgttgctcccgctgaacccatctccactggctgccagtgggccaagtgcatgcttccaaccagcctcgacggcctggttctgaggtgcgaagatacatccgacatggatgtgataccagtctaggtagggtgcttggctatgctgattctctggttcggagaaagagagaaaaaaaaagatgccttgacttttgatttggttttcagtgggatgttaggattgaaagaatgtgcaaatgcagggtgtgattatatgggctaagtaagtacgacaatatcagtggatggtcagtttacctggggcttggttgtatagtatattatatgtaattttctcttctcttttttggttgagccatgggtgatacttgtaacatggatggcttgatgtcagtactacctacctacctacctaccatggagcctgtttggagattcagtggcttctagtttatattatgtttttttccctttctgttgtagggttccagcaacatcatgaagcctgcaatttccagtttgtacctatgatctccacaaaacaaggttctcttcacatggtaggtatatttgcaatgttaagaagtcat

SEQ ID NO: 2222 - DNA, 2423 bp, Sorghum bicolor
ccggccctgcattttgttctctcgtctccctaagcctacgcggtcgctcactttttctctctctctcgcctcgcgttccccccgtgtgcgctctcccttcctctcttgtgaggagtgaggacggctggggcgaccgacgccgccgccgccgccctacgccaggtgccgaggtcgttgttgtgcccttcgccagctcttctccgggcccttcgccggcgacgagcacccaccagttgctgatgcaaggctttcaaaagtttgaaagtctcacttgacgcaaaagcaacacaatcactctaaaggtttagacagtcatttcagagaatgggttcacggtttccatctcaccagctaagcaatggcttgtatgtctcgggccgccctgagcaacctaaagagaaggccccagtcatttgctcctcggctatgccttacattggtggggacataaagaaatcaggagagcttggaaagatgtttgatctccacagaaagtctggtcaattgggtaatcaaccttcaaggaatacttcctttggtggtgctggcaacaactctggaccagtttctaatgctgttggtcgctccaactactctggttctatttcgtctgcagttcctggtactggaggatcttctagaacaaaatctaattctggacctctcaataagcatggagaaccaacaaagaggtcgtctggcccccaatctggtggtgtaaccccaatggcccgccagaactctggccctctgcctcctattcttcctacaactgggctaatcacatcaggtcctatcacctctggtcagttgaattcatctggtgctcaacggaaagtatcaggccctcttgattctagtgtatcaatgaagatgcgtgccacctcttttgcacacaacccagctgtcacaaatctcaatgttggaggtggttactcgattaagggcagcattccaaccacaataatctggctggtcgggttgctctttttggttgggttcgtagctggtggcttcattctcgctgctattcataatccaatcctgcttatagtcgtggtggtgatatttggttttgttgctgcactggtgacctggaacatctgctggggaacaaaaggtgtgattgggtttatcagtcgctatcctgatgcagaccttagaaccgcaaaagatggggagtatgtgaaggttactggggttgtcacttgtggaaatttgccccttgagtcctcattccaacgggtgccgcgatgtgtttacacttctacttgcttgtatgagtataggggttgggattcgaaagctgctaacactacgcatcgccgatttacttggggtctcaggtcaatggagcgacatgcagtggacttctacatctctgatttccagtctggactgcgggcactggtaaggacaggatctggtgcacgcgtaaccccatatgtggatgaatctgttgttattgacataaacccagacaacaaggatatgtcgcctgaattcctgaggtggctccgtggaaggaatctctcgagtgatgatcggattatgcgccttaaagaaggatatatcaaggagggcagcactgtgagtgtgatgggtgttgttcaaaggaatgagaacgtgctgatgatcgttcctccagctgaacccatctccactggctgccaatgggccaagtgcatcctcccggccagcctcgagggcctggtcctgagatgcgaagacacatctgacctggatgtgataccggtctagctagagggggattggttctggcgatcctctggtgtgcggaggagaggaaaaagatgccttgacttttgatttggtttctgtgggttgttagggttgaaagaatgtgcaaatgcagggtgtgattatgggctaagtacaatatcagtggtcgttcagtcagttacccggagcttggtcgtatagtatattatatgtaattttctctttctcttttttggttgagccaagccatggatggtgcttgtaacaaggatggcttgatgtcagtactacctaccctaccatggagcctgtttggagattcagtggtttccagttcgtgttattatgttcctgtttttgttgtagggttccagcaatgtcttgaaacctgcaatttccttttgtacccaaatctccatagaaatcgcttacctgcacatggcaggtatgtttccgatggtgagaaatcaatctaaagtgtaattgattcctatccgtgttgatgtgttcacgcagcttacccggggacagaatctattgccgtgggtcgttgagatgctcagagtcacatgatattccaagttttacagcgtacatgcatgcacgaccatcaatcacatccataccgaccggccggtgtgccacactgtcaaggttaggttagtggttagcaacacaag

SEQ ID NO: 2223 - DNA, 2957 bp, Zea mays
agcaagcccttccggtcctgcattttgttgtcccctctccgtagcggagacgttcgttcactttctctctctcgcctcccgtttgccccgcgtgcgctctgtgtcgctccctctcttgtgaggagtgaggacgactggggcgaccgccgccgccgccgccgccctacgccagatgcccaggtaggggccattcgctagctcttcttcgtgcccttcgccggcgacgagcattcaccagttgctgatgcaaggctttcaaaagtttaacagtctcacttgatgcaaaagcaacacaatcactctaaaggtttggatcagtcatttcagagcatgggttcgcggtttccatcccatcagctaagcaatggcttgtatgtctctggccgacctgagcaacctaaagagaaggccccagtcatttgctcctcggctatgccgtacactggcggggacataaagaaatctggagaacttggaaagatgtttgatctccatagaaaatctggtccattgggtaatccgccttcaaggaatacttcctttggtggtgctgccgccaactctggaccagtttccaatgctgtcggtcgctccaactactctggttctatttcgtctgcagttcctggcactggaggatcttctaggacaaaatctaactctggacctctcaacaagcatggagaaccaacaaagaggctatctggcccccaatcttctggagtaaacccgatggcccgtcagaactctggccctctacctcctgtacttcctacaactgggctaattacatcaggtcctatcacatctggtcagttgaattcgtctggtgctcaaaggaaagtatcaggccctcttgattctagtgtatcaatgaagatgcgtgttacctcttttgcacacaacccagccgtcacaaatatcaatgtgggagatggttactcgattaggggcagcattccgaccacaataatctggttggtcgcgttgctctttttggttgggtttgtagctggtggcttcattctcgctgccattcataatccgatcttgcttatagttgtggtggtgatatttggctttgttgctacactggtgatctggaacatctgctggggaagaagaggtgtgattggttttatcagtcgctatcctgatgcagaccttagaaccacaaaagatggggagtatgtgaaggttactggggttgttacttgtggaaatttgccccttgagtcctcgttccaacgggtgccgcgatgtgtgtacacttcaacttgcttgtatgagtacaggggttgggattcgaaagctgctaactccacacatcaccgatttacctggggtctcaggtcaatggagcgtcatgcagtggacttctacatctccgatttccagtctgggctgagagcgttggtcaggacagggtccggtgcacgagtatccccatatgtggacgagtctgttgttatcgacataaacccagacaacaaggacatgtcgcctgagttcctgaggtggctccgcggaaggaatctctcgagcgatgaccggattatgcgcctcaaagaagggtatatcaaggagggcagcaccgtgagcgtgatgggtgttgttcaaaggaatgagaacgtgctgatgatcgttcctccggctgaacccatctccactggctgccaatgggccaaatgcatcctcccgaccagcctcgacggtctggtcctgagatgcgaggacacgtctgacctggatgtggtaccagtctagttggttccggcgcggaggaggagaaaaagatgccttgactcgatttgagttggtttctgtgggttgttagtgttggagggaaaaaaatgtgcaaatgcagggtgtgattatgggctaagtaaagttacaatgtcagtggtcggtcagctacctggagattggtcgtacagtatgtcatgtgtaatttttgtcgtctcgttttggttgagccatgggtggtgcttgtaacaaaaggatggcttggtgtcagtactacctaccctaccatggagcctgtttggagattcagtggtctggtttcccattcatattttgttcttttttcttttggcgtagggttccgacaatgccctggaagcctgcagtttccttctgtacccagatctacatggaaatcgcttacctaaacttgagaggcatatttccggtggtgagaaaccaatgtaaaaaaaagttgattccaattcgtgttgacgcgtttccgaagcttaccggaggacaaaatctattgccgtgggtcgttgagatgctcagagtcacatgatattccaagttttacagcgtacatgcatgcacgaccatcaatcacatccataccgaccggccggtgtgccgcactgtcaacgttaggtcagtggttagcaacacacaagcaggctgcattgcatttgcattaccgttggacttggacaggaattagggaacaaccgggggttgccgcccaggaaccttattagctggtagcatggtcctgtctgtcacaatcttgtgccttcgtagcatcactcatctaccaaccacaacttagaagacaagtctggatggatctagcaaacgacacggatatgacacaactgctgctagcggagcgtgccaagttgctgaaatgaaaatcttgcaccaacatcaacaagctacgcgatcttcaaaactttgtcgcatgtatcatgaaagcaacaacgagagttgaggaatcatttaggtcaggtccgcgcttcttgtttttctatggtttcttggataaacccctaccaaatgcaagcacgtaaagaagccgtttttcttagggcatgttgggtatatctctgttgtacactatagcagctctaaaactttagattggagcaactatgttgttgagttttagtgacatttaggtaaaataaatggttcgtagcttttagaacaaa

SEQ ID NO: 2224 - DNA, 2954 bp, Zea mays
agcaagcccttccggtcctgcattttgttgtcccctctccgtagcggagacgttcgttcactttctctctctcgcctcccgtttgccccgcgtgcgctctgtgtcgctccctctcttgtgaggagtgaggacgactggggcgaccgccgccgccgccgccgccctacgccagatgcccaggtaggggccattcgctagctcttcttcgtgcccttcgccggcgacgagcattcaccagttgctgatgcaaggctttcaaaagtttaacagtctcacttgatgcaaaagcaacacaatcactctaaaggtttggatcagtcatttcagagcatgggttcgcggtttccatcccatcagctaagcaatggcttgtatgtctctggccgacctgagcaacctaaagagaaggccccagtcatttgctcctcggctatgccgtacactggcggggacataaagaaatctggagaacttggaaagatgtttgatctccatagaaaatctggtccattgggtaatccgccttcaaggaatacttcctttggtggtgctgccgccaactctggaccagtttccaatgctgtcggtcgctccaactactctggttctatttcgtctgcagttcctggcactggaggatcttctaggacaaaatctaactctggacctctcaacaagcatggagaaccaacaaagaggctatctggcccccaatcttctggagtaaacccgatggcccgtcagaactctggccctctacctcctgtacttcctacaactgggctaattacatcaggtcctatcacatctggtcagttgaattcgtctggtgctcaaaggaaagtatcaggccctcttgattctagtgtatcaatgaagatgcgtgttacctcttttgcacacaacccagccgtcacaaatatcaatgtgggagatggttactcgattaggggcagcattccgaccacaataatctggttggtcgcgttgctctttttggttgggtttgtagctggtggcttcattctcgctgccattcataatccgatcttgcttatagttgtggtggtgatatttggctttgttgctacactggtgatctggaacatctgctggggaagaagaggtgtgattggttttatcagtcgctatcctgatgcagaccttagaaccacaaaagatggggagtatgtgaaggttactggggttgttacttgtggaaatttgccccttgagtcctcgttccaacgggtgccgcgatgtgtgtacacttcaacttgcttgtatgagtacaggggttgggattcgaaagctgctaactccacacatcaccgatttacctggggtctcaggtcaatggagcgtcatgcagtggacttctacatctccgatttccagtctgggctgagagcgttggtcaggacagggtccggtgcacgagtatccccatatgtggacgagtctgttgttatcgacataaacccagacaacaaggacatgtcgcctgagttcctgaggtggctccgcggaaggaatctctcgagcgatgaccggattatgcgcctcaaagaagggtatatcaaggagggcagcaccgtgagcgtgatgggtgttgttcaaaggaatgagaacgtgctgatgatcgttcctccggctgaacccatctccactggctgccaatgggccaaatgcatcctcccgaccagcctcgacggtctggtcctgagatgcgaggacacgtctgacctggatgtggtaccagtctagttggttccggcgcggaggaggagaaaaagatgccttgactcgatttgagttggtttctgtgggttgttagtgttggagggaaaaaaatgtgcaaatgcagggtgtgattatgggctaagtaaagttacaatgtcagtggtcggtcagctacctggagattggtcgtacagtatgtcatgtgtaatttttgtcgtctcgttttggttgagccatgggtggtgcttgtaacaaaaggatggcttggtgtcagtactacctaccctaccatggagcctgtttggagattcagtggtctggtttcccattcatattttgttcttttttcttttggcgtagggttccgacaatgccctggaagcctgcagtttccttctgtacccagatctacatggaaatcgcttacctaaacttgagaggcatatttccggtggtgagaaaccaatgtaaaaaaaagttgattccaattcgtgttgacgcgtttccgaagcttaccggaggacaaaatctattgccgtgggtcgttgagatgctcagagtcacatgatattccaagttttacagcgtacatgcatgcacgaccatcaatcacatccataccgaccggccggtgtgccgcactgtcaacgttaggtcagtggttagcaacacacaagcaggctgcattgcatttgcattaccgttggacttggacaggaattagggaacaaccgggggttgccgcccaggaaccttattagctggtagcatggtcctgtctgtcacaatcttgtgccttcgtagcatcactcatctaccaaccacaacttagaagacaagtctggatggatctagcaaacgacacggatatgacacaactgctgctagcggagcgtgccaagttgctgaaatgaaaatcttgcaccaacatcaacaagctacgcgatcttcaaaactttgtcgcatgtatcatgaaagcaacaacgagagttgaggaatcatttaggtcaggtccgcgcttcttgtttttctatggtttcttggataaacccctaccaaatgcaagcacgtaaagaagccgtttttcttagggcatgttgggtatatctctgttgtacactatagcagctctaaaactttagattggagcaactatgttgttgagttttagtgacatttaggtaaaataaatggttcgtagcttttagaac

SEQ ID NO: 2225 - DNA, 2256 bp, Zea mays
cgtttggttctctcgtctgttgtctccatagcctacacacacggtcgctcactttctctcgcctcctgtcccccccgcgtgcgcgcagcgctctctctctctccctcactctcttttgaggagtgaggacgactggggcgaacgtcgccgccgccgccctacatcaggtgcccaggtcgttgttcggcccttcgccagctctttttcgggcacttcgccggcgacgaacacccaccagttgctgatgcaaggctttcaaaagattaacagtctcaattgatgcaaaagcaacacaatcacactaaaggtttggattagacatttcagagcatgggttcgcggtttccatcccaccagctaagcaatggcttgtatgtctcgggccgacctgagcaacctaaagagaagtctccagtcatttgctcctcggctatgccgtacactggtggggacataaagaaatctggggagcttggaaagatgtttgatctccatagaaaatctggtccattgggtaatcaaacttcaaggaatacttcctttggtggtgctgcctccaactctggaccagtttctaatgctgtcggtcgctccaactactctggttctatttcgtctgcaattcctaacactggaggatcttctaggacaaaaactaattctggacctctcaataagcatggagaaccaacaaagaggtcatctggcccccaatctggtggagtaaccccgatggcccgtcagaactctggccctctgcctcctgtacttcctacaactgggctaatcacatcaggtcctatcacctctggtcagttaaattcatctggtgctcaacgcaaagtatcagggcctcttgattctagtgtatcaatgaagatgcgtaccacatcttttgcacacaacccagctgtcacaaatctcaatgtgggagatggttactcgattaagggcagcattccgaccacaataatctggttggtcgcgttgctctttttggttgggtttgtagctggtggcttcattctcgctgctattcataatcctatcttgcttatagtcgtggtggtgatatttggctttgttgctgcacttgtgacctggaacatctgctggggaacaagaggtgtgattgattttatcggtcgctattctgatgtagaccttagaactgcaaaagatggagagtatgttaaggttactggggttgttacttgtggaaatttgccccttgagtcctcattccaacgggtgccacgatgtgtgtacacttcaacttgcttgtacgagtacaggggttgggactcgaaagccgcaaacgccacacaccgacggtttacttggggtctcaggtcaatggaacggcacgcggtggacttctacatctccgatttccagtccgggctgcgagcactggtcagggcaggatccggcgcgcgcgtgaccccatacgtggacgagtccgtcgctatcgacgtaaacccagacaacaaggacatgtcgcctgagttcctccggtggctccgcggaaggaatctgtcgagcgacgaccggactatgcgcctcaaagaaggatacatcaaggagggcagcaccgtgagcgtgatgggcgtcgttcagaggaacgagaacgtgctgatgatcgttcctccagccgagcccatctccactggctgccagtggggcaagtgtgtcctcccgaccagcctcgagggccttgtcctgagatgcgaggacacgtctggcctggacgtgataccggtctagctagagaggttggttctggcgaatcctctggcgcggaaagggagtagaaaaaaaaagatgccttgacgtttggtttggtctccgtgggttgttagggttggaaggatgtgcaaatgcagggtgtgattattgggctaagtaagtaagtacaatatgagtggtcggtcggttacctggagcttgatcgtgatagtatatggtatgtaatttcctcttctcttcttttggctgagccatggatggtgtgcttgtaacaaggatggcttgatgtcagtatactaccctaccataccatggagcatgtttggagattcagtgggttccagtccgtattatgctcctgtttttttttgttgtagggttccaacaatgccttgaagcctgcaatttccttgtgtacccagatctccatagaaatctatttgcctaaacatggactatagcaggtgtattttcgatggtgagaaatcgatgtgattgattcctcct

SEQ ID NO: 2226 - DNA, 2199 bp, Brachypodium distachyon
aacagcagaaatctcacccaccgccacctctctctctctctcgtagtacggcgaattgcttctccaccaaatcctccaccaccagatccctcttctacttcccgggcggagctcgcagatcacagatcgagccccgccgtcgtggcttggtggtagctctggagccgtgaaaggcaccaccagatcgacctcgaatacccccagatcgaagcacagcgcctcccggaggccgttgtcggcggtcgttggcagcgcgcagggggaagtcgcggcaacacgaaagtcgtcacaccgtcaggcgcgagcaagtccgggccattgcgcgagagattcagaggttgggaggagctgatgcaagctgcaggttgtacgctgaggagggtatctgtgcacatcgtcgatactcaaatatagccttgcttgattattccacagctggttaaacagtaatatacacttgattctgctggttcaaacatgggttcaaggtttccatcacatcagctgggcaatggcctgtatgtatctggccggcctgagcaacctaaggagaagggcccaaccatgggctccactgtgatgccgtacactggtggtgacatcaagaaatctggagagcttgggaagatgtttgacctccatgctgaaaagtctagaaaatccggtcctctgggtaatgcgccttcaagaaatacttcgtttgggggtgctgcttcaaactctggacccgtctctaatgctggtggtcggtccaactactctggttccctttcatcttcagttcctggtgcgggcggatcagcaagagccaaatcaaactctgggccactcaataagcatggagaaccagcaaagcgttcatctggtccccagtctggaggtgtgaccccaatggctcgccagaactctggccctctccccccaatgcttcctacaactggacttatcacatctgggcctatttcttccggaccaatgaattcgtctggtgctccaagaaaaaaagtatctggatctctcgatgctgctgcatccatgaagacgagggcaacatcattcgctcacaaccaggctgttactaatctcacaagagataatgatttctcaattaaggacagcatttcgaagtgcctgttgtattgtctggctggactcatcgggacggcactgatagttggtgtcttcattcttgttgctgttcacaatgcaattgtgctgatagttgttgtcgtgatgtgtggttctattgctgcacttgttacttggaatgtgtggcagggaaggagaggcgtgattggttttgtcaatcggtaccctgataccgatctcagaactgcgaaagatggacagtatgtaaaggttacaggggttgttacatgtggaaattttcccctggagtcctcatttcaaagggttccaagatgtgtgtacacctcgaccggcttgtatgagtacaggggctggggctcgaaaactgcaaacaccaagcatcgccagttcacctggggattacggacaatggagcggcatgcagttgatttctacatctcagattttcaatccgggcttcgagcattggtgaaaacaggatatggtgcaccggtgacaccatatgtcgatgaatctgtagtaattgacatcaaccctgagaataaggacatgtctcctgaatttctaagatggctacgtgaaaggaacctctcgagtgatgatcggataatgcgtctaaaagaaggatacatcaaggaaggcagcacagtgagtgtgatgggggttgttcaaaagaatgacagcgtgttgatgatagttcctccacgggagcccatctcatctggttgccagtggacgaagtgcttcctctcatcgaaccttgatggactagtcttgcgatgcgaagatacatcaaatatggatgtcataccagtatagcaagccttgttgaatcaagtcttttgacttcgggttgggtttgtttcgtggaatgttagaatcgagaaatgtacaaatgttgggtgtgattatggctagtaaagatcgaggatggctggttaagctgggttggatgtatagtccttttttaatgtgttttgtcctcctttcctcttctttctcggttacaagctctggatacttatgtaacgtgatggcttttgggctgtttgaagatttagtggaattgggttcatatgttatttagga

SEQ ID NO: 2227 - DNA, 2292 bp, Hordeum vulgare
gcgggcagctgcatcacggggtcggggaggggaggggaggagagagagggactccttcgtcgcggtggtaacagacagacagcgcggagagagagagggagggagggaggggagctgaaaggcgtcgtacgcgctccctcccaccatcccccgccccgctgcattattttctctctccctccctccgcctccccgtttattctctctcccccttcctactctctgtcccccatctgctccatttcctccctcccaccccattccgtcggcgcggcagcccaaccaaaaccaagctcactcccccgacgagatgctcgcccttccgctcaggagctgattcaaggtgtaggttgtactatgagaaggacagctgtgcacgtcaagactcaaattagctttgcttgattacactacagctgattgaataataatatatacttgattttggtggttcaaaaacatgggttctagatttccatcacatcagctgagcagtggtctttatgtatctggccgacctgagcaacctaaggagaaggccccgacctttggatccaatgtgatgccatacactggtggtgacaccaagaaatctggagagcttgggaagatgtttgagctccatgctgaaagatctagaaaatctggtcctctaggcaatgctccttcgagaaatccttcatttggcggtgctgcttccaactctggacctgtctctaatgctggcggtcggtcaaactactcgggttctctttcatcttcagttcctggtgctggaggatcagcaagagcaaaatctaactccggaccactcaataagcatggagaaccagtaaagcggtcatctggtccccagtctggaggtgtgaccccaatggctcgccagaattccggtcctcttcctccaatgcttcctacgaccgggcttatcacatctggccctgttacttctggaccactgaattcgtctggtgccccaagaagaaaagtatctggatctcttgatcctgctgcatcgatgaaggtgcgggccacatcgcttgctcacaaccaggctgttactacactcaccagtgaaggtggtttctcagttatgggaagcatttcaaagtgggtattctggctagtgatcacactcttgctgttcgggtttgcagtaggtctcttcattcttattgctgttcacaatgcgattgtgctgatagttgttgttgcaatgattggttctgctgctgcacttgtgtcttggaatgtttggcggggcaggagaggcgtgctcaggtttgtcaatagctgtcctgatactgatctcagaactgcaaaagatggagagtatgtgaaggttacaggggttgttacgtgtggaaatttccccctggagtcctcatttcaaaggattccgagatgtgtgtacacttcaactaggctgtatgagtataggggctgggattcaaaaactgcaaaccccaagcatcgccggtttacctggggattacgcacagcagagcggcatgcggtcgatttctacatttcagactttcagtctgggcttcgagcattggtgagaaccggaagcggtgcacgggtgacaccatatgtcgatgaatccgtagtaattgatgtcaatcctgagaacaaggacatgtctcctgaatttttaagatggctacgagaaaggaacctctcaagtgatggtcggaaaatgcgcctaaaagaaggatacatcaaggaaggcagcactgtgagtgtgatgggtgttgttcaaaagaatgagagcgtgttgatgatagtacctccatcagagcccatctcatctggttgccagtggggtacttgtttcttcccagcgaacctcgatggactggttgtgagatgtgaagatacttcagacatggatgtgataccagtatagcaagctgatgattgctgtggtgtggaatagctgctgttgaagagggaacgatggcctgtcgaatcttttgacctcgggttgggtttgattggtagagtattagaactgagaaaaatgtacaaatgttaggtgtgattaaggctagtaaagatggagtatggctgctggttaatctgtgtttggctgtatagtcctttttcaatgtgttttgtcctccttcgctcctgttttttcggttatgagctctcaatacttgtgtaatatgattgcttttgggctgtttgaagacttgttgaatcgggtttatgtgttatttaggatgaacttcttgcaccgctgttaaagccttaaatgtattgttgctgttacttttatgtatc

SEQ ID NO: 2228 - DNA, 2293 bp, Hordeum vulgare
gcgggcagctgcatcacggggtcggggaggggaggggaggagagagagggactccttcgtcgcggtggtaacagacagacagcgcggagagagagagggagggagggaggggagctgaaaggcgtcgtacgcgctccctcccaccatcccccgccccgctgcattattttctctctccctccctccgcctccccgtttattctctctcccccttcctactctctgtcccccatctgctccatttcctccctcccaccccattccgtcggcgcggcagcccaaccaaaaccaagctcactcccccgacgagatgctcgcccttccgctcaggagctgattcaaggtgtaggttgtactatgagaaggacagctgtgcacgtcaagactcaaattagctttgcttgattacactacagctgattgaataataatatatacttgattttggtggttcaaaaacatgggttctagatttccatcacatcagctgagcagtggtctttatgtatctggccgacctgagcaacctaaggagaaggccccgacctttggatccaatgtgatgccatacactggtggtgacaccaagaaatctggagagcttgggaagatgtttgagctccatgctgaaagatctagaaaatctggtcctctaggcaatgctccttcgagaaatccttcatttggcggtgctgcttccaactctggacctgtctctaatgctggcggtcggtcaaactactcgggttctctttcatcttcagttcctggtgctggaggatcagcaagagcaaaatctaactccggaccactcaataagcatggagaaccagtaaagcggtcatctggtccccagtctggaggtgtgaccccaatggctcgccagaattccggtcctcttcctccaatgcttcctacgaccgggcttatcacatctggccctgttacttctggaccactgaattcgtctggtgccccaagaagaaaagtatctggatctcttgatcctgctgcatcgatgaaggtgcgggccacatcgcttgctcacaaccaggctgttactacactcaccagtgaaggtggtttctcagttatgggaagcatttcaaagtgggtattctggctagtgatcacactcttgctgttcgggtttgcagtaggtctcttcattcttattgctgttcacaatgcgattgtgctgatagttgttgttgcaatgattggttctgctgctgcacttgtgtcttggaatgtttggcggggcaggagaggcgtgctcaggtttgtcaatagctgtcctgatactgatctcagaactgcaaaagatggagagtatgtgaaggttacaggggttgttacgtgtggaaatttccccctggagtcctcatttcaaaggattccgagatgtgtgtacacttcaactaggctgtatgagtataggggctgggattcaaaaactgcaaaccccaagcatcgccggtttacctggggattacgcacagcagagcggcatgcggtcgatttctacatttcagactttcagtctgggcttcgagcattggtgagaaccggaagcggtgcacgggtgacaccatatgtcgatgaatccgtagtaattgatgtcaatcctgagaacaaggacatgtctcctgaatttctaagatggctacgagaaaggaacctctcaagtgatggtcggaaaatgcgcctaaaagaaggatacatcaaggaaggcagcactgtgagtgtgatgggtgttgttcaaaagaatgagagcgtgttgatgatagtacctccatcagagcccatctcatctggttgccagtggggtacttgtttcttcccagcgaacctcgatggactggttgtgagatgtgaagatacttcagacatggatgtgataccagtatagcaagctgatgattgctgtggtgtggaatagctgctgttgaagagggaacgatggcctgtcgaatcttttgacctcgggttgggtttgattggtagagtattagaactgagaaaaatgtacaaatgttaggtgtgattaaggctagtaaagatggagtatggctgctggttaatctgtgtttggctgtatagtcctttttcaatgtgttttgtcctccttcgctcctgttttttcggttatgagctctcaatacttgtgtaatatgattgcttttgggctgtttgaagacttgttgaatcgggtttatgtgttatttaggatgaacttcttgcaccgctgttaaagccttaaatgtattgttgctgttacttttatgtatcc

SEQ ID NO: 2229 - DNA, 2004 bp, Triticum aestivum
attccgtcggcgcagcaggcaggcgaacggagctcactcccccctccctcgctgatttcctccctcccaagagaagatgtccgccgtcccctcgaggagctgattcaaggtgtaggttgtactatgtgagaaggacagctgtgcacatcaagactcaaattagcttcgcttgattacacttcagctggttgaataatatacttgattttggtggttcaaaaacatgggttctagatttccatcacatcagctgagcagtggcctttatgtttctggccgacctgagcaacctaaggagaaggccccgacctttggatccaatgtgatgccatacactggtggtgacaccaagaaatctggagagcttgggaagatgtttgagctccatgctgaaagatctagaaaatctggtcctctaggcaatgcgccttcgagaaatccttcatttggcggtgctgcctccaactctggacctgtgtctaatgctggcggtcggtcaaactactccggttctctttcatcttcagttcctggcgctggaggatcagcaagagcaaaatctaattccggaccactcaataagcatggagaaccagtaaagcggtcatctggtccccagtctggaggtgtgaccccaatggctcgccagaattccggccctctccctccaatgcttcctacgactgggcttatcacatctggccctgttacttctggaccactgaattcgtccggtgccccaagaaggaaagtatctgggtctctggatcctgctgcatcgatgaaggcgcgggccacatcgcttgctcacaaccaggctgttactacactcaccagtgaagatggtttctcagttatgggaagcatttcaaagtgggtattctggctagtgatcacactcttgctgttcgggtttgcagtaggtctcttcattcttattgctgtaaacaatgcgattgtgctgatagttgttgttgcaatgattggttctgttgctgcacttgtgtcttggaatgtttggcggggcaggagaggcgtgctcaggtttgtcaatagctgtcctgatactgatctcagaactgcaaaggatggagagtatgtgaaggttacaggggttgttacgtgtggaaatttccccctggagtcctcatttcaaaggattccaagatgtgtgtacacttcaactaggctgtatgagtataggggctgggattcaaaaactgcaaaccccaagcatcgccggtttacctggggattacggacagcagagcgacatgcggtcgatttctacatttcagattttcagtctgggcttagagcattggtgagaacaggaagtggtgcacgggtgacaccatatgtcgatgaatcggtagtaattgacgtcaatcctgagaacaaggacttgtctcctgaatttctaagatggctacgagaaaggaatctctcaagtgatggtcggaaaatgcgcctaaaagaaggatacatcaaagaaggcagcactgtgagcgtgatgggtgtcgttcaaaagaatgagagcgtgttgatgatagtacctccatcagagcccatctcatctggttgccagtgggggagttgtttctttccagcgaaccttgatggactggtcgtgagatgtgaagatacttcagacatggatgtgataccagtatagcaagctgatgattgctgtggtgtggaatagctgctgttgaagagggaacgttggcctgtcgaatcttttgacctcgggttgggtttgattggtagagtattagaactgagaaaaatgtacaaatgttaggtgtgattaaggctagtaaagatggagtatggctgctggttaatctgtgtttggctgtatagtcctttttccatgtgttttgtcctccttcgctcctgttttttcggttatgagctctcaatacttgtgtaatatgattgcttttgggctgtttgaagacatgttgaatcgggtttatgtgttatttaggatgaacttct

SEQ ID NO: 2230 - DNA, 2084 bp, Triticum aestivum
  misc_feature (18)..(18): n is a, c, g, or t
  misc_feature (993)..(994): n is a, c, g, or t
ggtcgacccacgcgtccncgtctgctccatttctgctctgcgcgctcccctccccaccccacccactccccccattccgtcggcgcagcaggcgagcggagctcactcccaagagaagatgtccgccatcccctcgaggagctgattcaaggtgtaggttgtactatgtgagaaggacagctgtgtacatcaagactcaaattagcttcgcttgattacactacagctggttgaataatagtatatacttgattttggtggttcagaaacatgggttctagatttccatcacatcagctgagcagtggcctttatgtatctggccgacctgagcaacctaaggagaaggccccgacctttggatccaatgtgatgccatacactggtggtgacaccaagaaatctggggagcttgggaagatgtttgagctccatgctgaaagatctagaaaatctggtcctctaggcagtgcgccttcgagaaatccttcatttggcggtgctgcttccaactctggacctgtgtctaatgctggtggtcggtcaaactactctggttctctttcatcttcagttcctggcgccggaggatcagcaagagcaaaatctaactccggaccactcaataagcatggagaaccagtaaagaggtcatctggtccccagtctggaggtgtgaccccaatggctcgccagaattccggccctctccctccaatgcttcctacgactgggcttatcacatctggccctgttacttctggaccactgaattcgtctggtgccccaagaaggaaagtatctggatctcttgatcctgctgcatcgatgaaggcacgggccacatcacttgctcacaaccaggctgttactacactcaccagtgaaggtggtttctcagttatgggaagcatttcaaagtgggtattctggctagtgatcacactcttgctgttcgggtttgcagtaggtctcttcattcttattgctgtnnacaatgcgattgtgctgatagttgttgttgcaatgattggttctgttgctgcacttgtgtcttggaatgtttggcggggcaggagaggcgtgctcaggtttgtcaatagctgtcctgatactgatctcagaactgcaaaggatggagagtatgtgaaggttacaggggttgttacgtgtggaaatttccccctggagtcctcatttcaaaggattccgagatgtgtgtacacttcaactaggctgtatgagtataggggctgggattcaaaaactgcaaaccccaagcatcgccggtttacctggggattacggacagcagagcgacatgcggtcgatttctacatttcagattttcagtctgggcttcgagcattggtgagaacaggaagcggtgcacgggtgacaccatatgtcgatgaatcggtagtaattgacgtcaatcctgagaacaaggacatgtctcctgaatttctaagatggctacgagaaaggaatctctcaagtgatggtcggaaaatgcgcctaaaagaaggatacatcaaggaaggcagcactgtgagtgtgatgggggtcgttcaaaagaatgagagcgtcttgatgatagtacctccatcagagcccatctcatctggttgccagtgggggagttgtttcttcccagcaaaccttgaaggactagtcgtgagatgtgaagatacttcagacatggatgtcataccagtatagcaagctgatgattgccgtggtgtggaatagctgctgttgaagagggaacgttggcctgtcgaatcgggttgggtttgattggtagagtattagaactgagaaaaaaatgtacaaatgttaggtgtgattaaggctagtaaagatgggagtatggctgctggttaatctgtgtttggctgtatagtcctttttcaatgtgttttgtcctccttcgctcctgttttttcggttatgagctctcaatacttgtgtaatatgattgcttttgggctgtttgaagacatgttgaatcgggtttatgtgttatttaggatgaacttcttgcactgctgttaaagcctaaatatattgttgctgttaca

SEQ ID NO: 2231 - DNA, 1978 bp, Zostera marina
aggttttcggttctaattaacttcattcgaaccacaatgattataattggcacctgttgagaacaattttggagtaggaaaaaaactcaaaaaggagctagtggagtgaacaagtgcaatgggttcgcgattcccttcccatcaacttagcaatggcctctacgtatcaggccgcccagagcagcccaaagaaaaacctgtcaccatgagctccacagcgatgccttacacaggtggtgatataaaaaaatctggagaactagggaaaatgtttgacattcatggtgaatactccaaatcaaggaaatctggacctatcaccaatgccccttctcgaaccggttcatttgggggagcaacttctaacaacactggacgtgctagctattcgtctggaccggtcggttccggtgtaccaggatctggtactggtggaggttcgatccgtcagaagtccaattcaggaccgttaaacagacatggcgaatcaatcaaaaaattgtctggtcctcaatctggttgtgtgactccaatggcacgccaaaattctggcccacttgcaccaatgctccccaccaccggacttatcacatctggtcctatttcatccggaccacttaactcatcgggtgctcctcggaaagtatctggtcctcttgactctactgggtcactcaaactacacagcgcctctatcgttcataaccaggcggttaccaatctcagtcaggaggatgaatattcattcaggagaagcttcccaaaaccgatattctgggccgtgatacttctgtttgtgatggggttcattgcaggtggttttattctaggtgccgttcacaatgcaattcttctcattgtcgtggttgttctctttggtgctgtcgcggcacttttcacatggaatacttgctggggtaggagatctataaccagatttattgcacagtaccccgatgccgagcttagaactgctaaagatggacaatatgtcaaagtatccggtgtggtaacctgcggaaatgtaccgctcgaatcgtcgttccaaaaaataccaagatgtgtgtatatatcgacgagtttgtatgagcatagaggatgggaatccaaggcagccaatcccaaacaccgtcgcttcacttggggtcttagatccatggagagacatgttgtggacttctacatctcggattttcagtcaggtcttcgagcattggttaagacaggatacggcgcaagagttacaccatatgtggacgaatccgtggttgttgacatcaacccagacaataaagatatgtctccacaattccttcggtggcttcgcgagaggaatctttctagcgatgatcgtgtgatgcgcttgaacgaaggatacatcaaagagggaagcacggtgagtgtgatgggagtcgtccagagaaatgacaatgtgctgatgattgtccctccatcagagccattttccacaggatgtcagtgggagaattgcactctcccagccaaccttgatggcgtagtattacgatgcgaagatatttcaaagattgacgtcattcctgtgtagaacgttatgaacgatagctgaaccgctgccatcaacatctgctttagttacttaatggtgttgttgaagatgtattcttattaaatcatcaactatcttgaatgtgtcgtcttcggtagatagcggtttggatggttgtgattagaactatgtttgttggatcaggtgtatagctttggttgtggctttcttgggtgttattaatcttctgtgtaattctcccccatcctttcacccttcactcttgttttttagagactagggttttcactttcaaagctttgtttatgaatctgctagaaaattcttggttattttgttttttttatagttgaacttttgttatgcacttgtgttgggcatcttttatcatctgaaacttacaaacaagaaaaaatttaagagatgaac

SEQ ID NO: 2232 - DNA, 561 bp, Saccharum officinarum
  misc_feature (473)..(473): n is a, c, g, or t
  misc_feature (497)..(497): n is a, c, g, or t
agccaccgtaccaaggcgagctccgcgacctgcgcgcgccggctgccggtgctggattcggttttctacgaagtgacgatggggtttcacctgctggcgttcgtggcggcgagggggctcatgcaggtgttcaacctctcggcgccgctcaacctccggctgccgctcgcgcgccacctccccgaggccttcgccgtcctgtacggcgtgctcgcgtcgcacgccgcgtggctcaacgacgccctggcgcgcggcgccgcctggagccacagcgggagccggggcggcgtcgacgagtacgtccgctacgccatgctcagcatctccgactgacgtgcgcaccggcggacggacgacgggcgacggtcaggcgcgagggcgctacctgctgcctgctgttcttccctgactccctgtccgtcgtgctcgtgatggcaagtgcatgccgcccggcctttgctagcttagcttangatctagctcttccttctcccttntgtgggttgtgaccttgtccattgctcgctcgtttggtttcttcttgttcgtagcatgattttt

SEQ ID NO: 2233 - DNA, 291 bp, Sorghum bicolor
cttaattcttggacctcgacgatggggttccacctgcttgcgttcgtggcggcgagggggctcatgcaggtgttcaacctctcggcgccgctcaaccggcggctgccgctcgcgcgccaccttcctgaggccttcgccgtcctgtacggcgtgctcgcctcgcacgccgcgtggctcaacgacgccctggcgcgcggcgccgcctggaggcacagcgggagccggggtggcgtcgacgagtacgtccgatacgccatgctcagcatctccgactgatctgacgcgcgcgcg

SEQ ID NO: 2234 - DNA, 902 bp, Zea mays
tgttgcggccgtccctggcgtgccctttcgccttacttaacccgcgaggacacgccgcatttcgcaggcgcgatcgagctcaccaagcgcggatattggcccgtcagcagaacaagtgcgctgcacgcgacgcgatcgaccggccggccgggcagacagacattatttcaattcccactagctagctagctgctgcaggaggcaagagacgacgacagacagccagccgccaccgtgcggtgccaaggcgagctccggtccgcgacctgttgtgcgccgccgctgctggcttctcttccgcctcgacgcgcgacgatcgatggggttccccctgctcgcgttcgtggcggcgaggggcctcatgcaggtgttcaacctctcggcgccgctcaacctccgcctgccgctcgcgcgccacctgccggaggccttcgccgtcctcttcggcgtgctcgcgtcccacgccgcgtggctcagcgacgccctggcgcgcggcgccgcctggcgccacaccgggaaccggggcggcgtcgacgagtatgtccgctacgccatgctcagcatctccgactgagacgcgcgcatccacggcggacgacaaccaccatctccgactccgtccctgcgcgatcgagaaggcgctagctatcaagctgcggtccgtcgtgcatgctcgtggtggcaactgcatgccgcccctcgctagattagcttaggatctctctccccctccccctttgtaacacattgcttgctcgctcctttggtttcttcttgttcgtagcatgcgtgatttttggtagcatcggaaagatctgggagattgttgtaacatgcaaccgtggaccgtggttaatttgtaaatacaggtgaattttgttcgagctagtgaaagtttctcg

SEQ ID NO: 2235 - DNA, 895 bp, Zea mays
tgttgctgccgtcctggcgtgtccttcgcctacttaacccgcgaggacacgccgcatttcgcaggcgcgatcgagctcaccaagcgcggatattggcccgtcagcagaacaagtgcactgcacgcgacgcgatcgaccggccggccgggcagacagacattatttcaattcccactagctagctagctgctgcaggaggcaagagacgacgacgacagccagccgccaccgtgcggtgccaaggcgagctccggtccgcgacctgttgtgcgccgccggtgctggcttctcttccgcctcgacgcgcgacgatcgatggggttccccctgctcgcgttcgtggcggcgaggggcctcatgcaggtgttcaacctctcggcgccgctcaacctccgcctgccgctcgcgcgccacctgccggaggccttcgccgtcctcttcggcgtgctcgcgtcccacgccgcgtggctcagcgacgccctggcgcgcggcgccgcctggcgccacaccgggaaccggggcggcgtcgacgagtatgtccgctacgccatgctcagcatctccgactgagacgcgcgcatccacggcggacgacaatcaccatctccgactccgtccctgcgcgatcgagagggcgctagctgtcaagctgcggtccgtcgtgcatgctcgtggtggcaactgcatgccgcccctcgctagattagcttaggatctctctccccctccacctttgtaacacattgctccgctcctttggtttcttcttgttcgtagcatgcgtgatttttggtagcatcggaaagatctgggagattgttgtaacatgcaaccgtggaccgtggttaatttgtaaatacaggtgaattttgttcgagctagtgaaagtttctcg

SEQ ID NO: 2236 - DNA, 1115 bp, Zea mays
gaggctagcagtaccacttgctctggatatatactttaattgtttagatactagataacggatgggtgaaaatacactcttgcagtacacgtcagaggcaaccgtggggtcctttctttcttatccaaaaccaaaaccagcgaaaccaccggccccgcccttgaccaaaactagtccgtcagccggtggctcccgctcccctcgctgccgctcgtaactggggaaggccgcaaccccctcgggcaggcagcggctacccccaccaccaccagtgcaccaccactccaccagcgtggcagcgacgttgctgctgtcggcccgtacgtcctggcgtgtccttggcctacttaacccgcaaggacacgccgccattccgcagggcgagctcaagcctcaagctgggattggcccgtcggcagaacaagtgcacgcgggaccgggcaacatttcccgctgcagccaacaagcagagggggcgacgatatatagccacgggcggccgttgctggatccggcatcttcctcgatcggcaagacgataggatggggttccacctgctggcgttcgtggcggcgaggggcctcatgcaggcgttcaacctgtcggcgccgctcagcctccggctgccgctcgcgcgccacctgccggaggccctcgccgtcctgtacggcgtgctcgccgcgcaagccgcgtggctcaacggcgccctggcgcgcggcgccgcctggagccacagcgggagccggggcggcgtcgacgagtacgtccgccacgccatgctcagcgtctacgactgagaccaccggcggaaggtcgacggacagcaggcgccacgcgagggcgcttctagctgctgtccctgcccccgtcgtgctcgtggtggcaagtgcacgccgcgccggcgccggcgccgccctctgctagctagcggcgactagcagcgtagatctttgtaattcattgctcgctcgctcgtttggcgttccttcttgttcgtagcatgatttttgatagcatcgaaaaggtttgggaggttgctctctgtaacatgcaattgcaagccgtcggtggtagctagtggctggtaaattaaatacaagtgatgaattctgtt

SEQ ID NO: 2237 - DNA, 1115 bp, Zea mays
gaggctagcagtaccacttgctctggatatatactttaattgtttaaatactagataacggatgggtgaaaatacactcttgcagtacacgtcagaggcaaccgtggggtcctttctttcttatccaaaaccaaaaccagcgaaaccaccggccccgcccttgaccaaaactagtccgtcagccggtggctcccgctcccctcgctgccgctcgtaactggggaaggccgcaaccccctcgggcaggcagcggctacccccaccaccaccagtgcaccaccactccaccagcgtggcagcgacgttgctgctgtcggcccgtacgtcctggcgtgtccttggcctacttaacccgcaaggacacgccgccattccgcagggcgagctcaagcctcaagctgggattggcccgtcggcagaacaagtgcacgcgggaccgggcaacatttcccgctgcagccaacaagcagagggggcgacgatatatagccacgggcggccgttgctggatccggcatcttcctcgatcggcaagacgataggatggggttccacctgctggcgttcgtggcggcgaggggcctcatgcaggcgttcaacctgtcggcgccgctcagcctccggctgccgctcgcgcgccacctgccggaggccctcgccgtcctgtacggcgtgctcgccgcgcaagccgcgtggctcaacggcgccctggcgcgcggcgccgcctggagccacagcgggagccggggcggcgtcgacgagtacgtccgccacgccatgctcagcgtctacgactgagaccaccggcggaaggtcgacggacagcaggcgccacgcgagggcgcttctagctgctgtccctgcccccgtcgtgctcgtggtggcaagtgcacgccgcgccggcgccggcgccgccctctgctagctagcggcgactagcagcgtagatctttgtaattcattgctcgctcgctcgtttggcgttccttcttgttcgtagcatgatttttgatagcatcgaaaaggtttgggaggttgctctctgtaacatgcaattgcaagccgtcggtggtagctagtggctggtaaattaaatacaagtgatgaattctgtt

SEQ ID NO: 2238 - DNA, 1226 bp, Zea mays
gatccatttgaaccggaggctaccgctgcctcaagggcctcctcgctcgctcgccagtcgccacccgctcacggagacagagaggccgatggcgagctcgctggcccgcctgggagcggcgctgccacgcgcgcgcccacgcgctgcgacccgcaccctgccaccgccgcggtgggacgccgcggcgctcggcgcctcccgccgcgccgcaccgaacgtttgcaggtgcctagttcattccgacgttaaagtagcccctacatcggacttcaaggacagtagcaaatctgaaacttggaggatcaagatgctctacgacggtgattgccctctctgtatgcgtgaggtaaacatgctaagagaaagaaacaaatcctatggagcaataaagtttgttgacataagctcgaaagattactctccagatgacaatcagggccttgattatgaaacttccatggggaggatacatgcggttctttcagatggaactgttgtcacagacgttgaggcatttagaaaactgtacgaggaagtaggacttggatgggtttatgctgttactaagtatgagcctgtagctagcatggcaaatgcagtatatggtttgtgggcaaaataccgtatgcaaattacaggtcgacctccgctagaagagatcatggcatcccgaagagctgcaggcgaatgtaaagatgacaaagtatgcaagatgtgagcataaagatgttatactgtgctacatacctcgcctctagccatgctttatataggctaaggctcgtatatatggctttaacagtacaaataatcgcagttgtattagaaaaaaaaaggtgaatagcttatgtaatggtttatcaaagtacatatgattgtacatttgtatgtacactgtactggttcacgcatgtaaaaacgatccaccacagatcgagctgactcacattgtctgttctaccaagtcgtatggactactacgcggccccaagctcacagtcacatcctagtccattgttgtggatatataagctcatgcactgcccgctgccggctgagaagcacagctaacgtccgcagaggccgcgttgcttgacgtcgagggggcctcggtgcttggatgggcgtcggcgcgcttgttcttggaggctaacctgctgttcctgagcctgttgaagggccgccagtgccatctgtcgtgcgacttcatgtgacccatccccacc

SEQ ID NO: 2239 - DNA, 975 bp, Zea mays
gatccatttgaaccggaggctaccgctgcctcaagggcctcctcgctcgctcgccagtcgccacccgctcacggagacagagaggccgatggcgagctcgctggcccgcctgggagcggcgctgccacgcgcgcgcccacgcgctgcgacccgcaccctgccaccgccgcggtgggacgccgcggcgctcggcgcctcccgccgcgccgcaccgaacgtttgcaggtgcctagttcattccgacgttaaagtagcccctacatcggacttcaaggacagtagcaaatctgaaacttggaggatcaagatgctctacgacggtgattgccctctctgtatgcgtgaggtaaacatgctaagagaaagaaacaaatcctatggagcaataaagtttgttgacataagctcgaaagattactctccagatgacaatcagggccttgattatgaaacttccatggggaggatacatgcggttctttcagatggaactgttgtcacagacgttgaggcatttagaaaactgtacgaggaagtaggacttggatgggtttatgctgttactaagtatgagcctgtagctagcatggcaaatgcagtatatggtttgtgggcaaaataccgtatgcaaattacaggtcgacctccgctagaagagatcatggcatcccgaagagctgcaggcgaatgtaaagatgacaaagtatgcaagatgtgagcataaagatgttatactgtgctacatacctcgcctctagccatgctttatataggctaaggctcgtatatatggctttaacagtacaaataatcgcagttgtattagaaaaaaaaggtgaatagcttatgtaatggtttatcaaagtacatatgattgtacatttgtatgtacactgtactggttcacgcatgtaaaaacgatccaccacagatcgagctgactcacattgtctgttctaccaagtcgtatggact

SEQ ID NO: 2240 - DNA, 893 bp, Setaria italica
gtcgatggcgagttcgctggcccgcctgggagcggcgctgccccgcgcgcgcccacgtcccggcgcgcgggtcctgccaccggggcggtgggacgccgcggcgctcggcgcctcccgccgcgccgcgccgaatgttggcagatgccaagttcattccgatgtcaaagtagcccctacatcggacctgaaggatggagacaactcatctaaaaattggaggatcaagatgctctatgatggtgattgcccgctctgtatgcgtgaggtaaacatgctgagagaaagaaacaaatcctatggagcaataaagttcgttgacataagctcgaaagattactctccagatgacaatcagggacttgattatgaaactgtcatgggaaggatacatgccattctttcagatggaactattgtcacagatgttgaggcatttagaagattatatgaggaagtaggacttggatgggtctatgctgttactaagtatgaacctgtagctaccatggcaaatgcagtatatggtgtgtgggcgaaataccgtatgcaaattacaggtcgacctccgctagaagagattatggcatcccgaaaagctgcaggcgaatgtaaagatgacaaagtatgcaagatgtgagcctgaaaatgttggtctgctctgctgcattcctcacctctagctatgcttagataggcacatacagagacttaacactaaaaataatcgtagtggtatgaaaagaatggagaatagattttataacagtttgttgaagtaaataatgatgcaattgtacactgtaccggtttgttgaaaagagtgaagatattttatgtgaaaacttccacaaactgttctcgtatttatcttaagctccgcgactggatcgcac

SEQ ID NO: 2241 - DNA, 1493 bp, Oryza sativa
gcgtggagacgtcgcgagagatcgatccgaccgatggcgagctcgctggcacgcatgggtgcggcgctgccccgggtgcggccgcgcgccgcggcgcggttcccgccgccaccggggcggtgggactccgcggcggcgctccgccgcgctccggtgtacggtttcagatgtcaagttcactctgacgtcaaagtaggccctagttcagggttaaaggatggggaaaattcatctggaagttggaggatcaagatgctctatgatggcgattgcccactctgtatgcgtgaggtaaacatgctgagggaaagaaacaaatcctatggagctataaaatttgttgacataagctcgaaagattactctccacaagacaatcagaaccttgattatgaaactgccatggggaggatacatgctatactttcagatggaacaatagtcacagatgttgaggcatttagaaagctgtatgaggaagtgggacttggttggatttatgcagttactaagtatgagcctgtagctaaagtagcaaatgcaatatatggtgtgtgggccaaataccggatgcaaattacaggtcgacctccactagaggaaattatggaatccagaaaactagcagccgaatgcaaagatgataaagtgtgcaagatgtgagcaacggagcatcggtctgctgtggctaccattcccacatacgcttaggtagacacacaatcacacatacaaagctaatctcaccatacagatcattataatgcatagtgctatagataagattatgagaacgacgatacagtaatttgcctgagatgtaatagtatcatctgtacactgaataaatgacaaataaatcttcagaaaaaacaaagcagcagtatgattgatttttcatttcgcattgacttcttcgatactgcagtgagcttccttctcatcttcacgaaattctacggtttgagtcagttccaccttgagctgaccatattcaccgtatgctgcctgatcatgagccatctccatttcccttacagagcagcttgtgaacttaagaagcagcaagcaaccgaactttccatagaaccacagcacatcaagattgcaaattttgtagggcttcacaacttgcagtaacatctatctcatgaatatattatttttattgtgatacagctagcctattctgaaggattatcaagaatgttaagattatagtggtccctatcttttgaaagaaaaaaggaaaccgactgttatcaaaactctattctatgagactatgacgcactccattccaattaggatcagtcactctttactcacaagagattttttgacacaatccacgataccttcacagtcatcttcaggtattacacactcggtgtcagtttctaagcatttctgcatagagtgaggagaacgaaggtttccatgtgtttgacaggccttcatcgtcttgcaatgttctgcctcatcatctcgta

SEQ ID NO: 2242 - DNA, 875 bp, Avena sativa
acacgcacggtcgcactgacgtcgctagggagaagggtatcgatcgatcgatggcgagctcgctggcccgcctgggagcggcgctgccccgcgcgctcccgctcgccgccgcggcggcgcgggtcccgccacggggaggacggtgggactccgccgcgtcccgccccgcttcgctgtacgcttggagacgccaagttcactcggacgtgaaagtgtcccctgcagcggaaccgaaggatgtggggaattcgtcccagaattggaggatcaagatgctctacgatggtgaatgcccgctctgtatgcgtgaggtaaacatgttgagggaaagaaataaatcctatggagctataaattttgttgacatcagctcaaaagattactccgcgaaggacaatcacggtcttgattatgaaactgccatggggaggatacatgccattctctcagatggaaccattgttacagatgttgaggcatttagaaggctttacgaggaagtgggacttggatgggtttatgcagttactaagtatgaacctgtggctaccatagcaaatgcagtttatggtgtatgggccaaataccggatggaagttacaggtcgaccaccactggaggaaatttttgcagctcggagacaagcgggtgaatgtaaagatgataaagcatgcaagatgtgagcagcaaagctcccgtcttctcttcatgcatattttaactttgatatgtttagatagacacacatacatacatagctagccttacgtccaaataattccgaaattgatgataccaagttgttctgtgattgagggtagtaaataattccatggtctgtacactgattctatgggaaagacatgcaactttat

SEQ ID NO: 2243 - DNA, 1254 bp, Brachypodium distachyon
atcgacgatggcgagctcgctggcccgcctgggagcggcgctgcaaccccgcgctcgcccgctcgccgcggcgtcgcggcggattctgctgccacagggagggcggtgggaccccgcggctgccgcctcccgcccggcttcgctgtacgcttgcaaatgccaagttcactcgaacgtgaaggtgtccccacctacgtcggaggtgaaggatgggggaaattcgtcccaaagttggaggattaagatgctctatgatggtgattgcccgctctgtatgcgtgaggtaaacatgctgagggaaagaaacaaatcctatggagctataaattttgttgacatcagctcaaaagattatactcccaaggacaatcaaggtcttgattatgaaactgccatggggaggatacatgccattcttgcagatggaactatcgtcacagatgttgaggcatttagaaggctttacgaggaagtgggacttggatgggtgtatgctgttaccaagtatgaacctgtgtctaccatagcaaatgcagtatatggtgtatgggccaaataccgtatggaagttacaggtcgacctccactggaggaaatttttgcagcacgaagacaagcgggcgaatgtaaagatgataaagcatgcaagatgtgagcagcaaaggcgctggttttcccggctctttcactgctactctgctacatacctttaaatagtcacatatacataggtagcaagtctcgcattcaaatgataacaagatccactatcacaacgtttcccgtgttggagagcaaataattccaaaatctgtacactggttctgtgggaaagaaaagctgatgagctgtggcaggtggtcatctagggacgctgtcttcagttctgcagggaggtcgccggttgctttgtttcctagccttcccggcgacctcctccgtgtatgaccagctgcgttcacttgtgctgtgcagtttgatattattatttttctataattccggagggagtacagtatttatgttggtagatactattcatacaacgttacaactgtttatggcccgcaacccataccggtggagatcaagatggattatgagaccttaatcccaggctccaacccaaactttcccaaattatgcaaaatctttcgggatgggcagtggaagcaacaggcgaacgaagaattttgtcgtgctttcacaaagggcccaaagcccaagagcggtgaggccgtccccactccgccg

SEQ ID NO: 2244 - DNA, 2146 bp, Zea mays
cctctcctccccctcccccacccccttatcgccaccatgctctccctctcccacccccacccccaccccgccgcgtccaccaccgcgccgcgccaccagcgcactgctcccgtgtggcaccgccgtcgcgccagccacatcgccgcgagcgccatcctgcttccgggaggcggcagcaccggcggcaggggcgggcccggcgaccgcaggctccccttcaccccgccccctatggcgccgccgggccagctctaccagccgttccacccgccgccgtcccctctcccgcccagcctccgcaacctcgacctcagcgagcgcctccagatcctccgcgaccggatgggcctgtggcacgagtacgcgcccctcatctcctcgctctcccgggacggcttcaacccgtcttccatccaggaggccacgggcatctccggcgtggagcagaactgcctggtcgtcgcgtcccaggtccgcgactcgctcctcgacgaccgggccgccgcgttcccgcccgacctgcttccctacttcgactccttgggtgggcccgaggtcctgtacgagctccgcttcctgaacgcgcggcagcgcgccgacgccgccaggcacgccatcggctacaggctcgagcccaagggcgtgcgggagcttgcgcgcgccatgaagggcttcccgcgctggcgcggggaggaaggctgggaggccttctcgaaggactcccccgccgactgcctcgccttcgcgcggttccggcagtcgcgggaggccatcgacgtgcaggaccgcgtcgcggagctggagcgcgcgctgcaggtggtggagaccgagtccggcagggcgcgcgtggagctcgagttggagcgcgccaggaggaaggcggccggggaggaggaggtggacgaggagggcgaggaggacgacgctgccgcctcgctgcggcccggcgtcacggtggtgcggctccgctacggcgaggtcgccgaggcgaccaccgtcatcctgctgccggtggtgagggagacggacggcgtcgcggccatggagtcggcgcccaggcgggctaagacggacgtgggccttggcgtcgtggaggtggacagggcgtgggcgcgctgggccgtggtgcccggatggggccccgtggccgaggcagcggacgacgccgtcgtcgtagagctggccgacgggcggaggctgccgtggcggatgagcgacgaggagccggtgctggtcatcgccaaccggagcaagaaggaggtagtggaggagggggtatacgtcctcgagagggaaggccggcttgtggtggagagggggaagaagctggctgagcagggcatagctgctgcggcggccgaggtggtcatcgtggtccggccgcccaaggacgaggacgacatggttagcgacgaggagtgggactgatgactgatctggagagcgttttggttgtggagatgccaatttgtcttttctccatagggtaccggtggaaatgcaggtggatacggagccctttccaatgaacatgatcgacttcgagggcaagaaagtcctggttcggccaaacacagccgataaaggcaaaggcgaggagatagtcatcggtaatgcaagagaggccgatgagaatcataaaatttcttgcagaaaagtggtggcagagaagactcccgatggaggggaaacccttaagttgaccatcacgacctccggcgctggagggcaggcacggaccaaggagcaggaacacgtgctgcgcatcccggacggtccaacacacaggcacggacggtccgaagaattcaagcggacggtccggccccactcaggactcgcaacaaccacgtatcttctgtcggtgttttgagtccgaccgcgcacctggggttgcccctcgaggtgctttttggagtaggacggtgttaccgactgtagctcgatggtttgcgctagaagtacgagagacagtggacagttttgtacaggttcgggccgctttgagatgcgtaacaccctacgtcctggcgtgaatactttgtgtggtgggttacaaggaggttctctagtaccgaggatgttagagaactgggtggatggctaagtagtgagagttgttttgaggggatgccccctaggcctt

SEQ ID NO: 2245 - DNA, 1562 bp, Zea mays
cccctcccccacccccttatcgccaccatgctctccctctcccacccccacccccaccccgccgcgtccaccaccgcgccgcgccaccagcgcactgctcccgtgtggcaccgccgtcgcgccagccacatcgccgcgagcgccatcctgcttccgggaggcggcagcaccggcggcaggggcgggcccggcgaccgcaggctccccttcaccccgccccctatggcgccgccgggccagctctaccagccgttccacccgccgccgtcccctctcccgcccagcctccgcaacctcgacctcagcgagcgcctccagatcctccgcgaccggatgggcctgtggcacgagtacgcgcccctcatctcctcgctctcccgggacggcttcaacccgtcttccatccaggaggccacgggcatctccggcgtggagcagaactgcctggtcgtcgcgtcccaggtccgcgactcgctcctcgacgaccgggccgccgcgttcccgcccgacctgcttccctacttcgactccttgggtgggcccgaggtcctgtacgagctccgcttcctgaacgcgcggcagcgcgccgacgccgccaggcacgccatcggctacaggctcgagcccaagggcgtgcgggagcttgcgcgcgccatgaagggcttcccgcgctggcgcggggaggaaggctgggaggccttctcgaaggactcccccgccgactgcctcgccttcgcgcggttccggcagtcgcgggaggccatcgacgtgcaggaccgcgtcgcggagctggagcgcgcgctgcaggtggtggagaccgagtccggcagggcgcgcgtggagctcgagttggagcgcgccaggaggaaggcggccggggaggaggaggtggacgaggagggcgaggaggacgacgctgccgcctcgctgcggcccggcgtcacggtggtgcggctccgctacggcgaggtcgccgaggcgaccaccgtcatcctgctgccggtggtgagggagacggacggcgtcgcggccatggagtcggcgcccaggcgggctaagacggacgtgggccttggcgtcgtggaggtggacagggcgtgggcgcgctgggccgtggtgcccggatggggccccgtggccgaggcagcggacgacgccgtcgtcgtagagctggccgacgggcggaggctgccgtggcggatgagcgacgaggagccggtgctggtcatcgccaaccggagcaagaaggaggtagtggaggagggggtatacgtcctcgagagggaaggccggcttgtggtggagagggggaagaagctggctgagcagggcatagctgctgcggcggccgaggtggtcatcgtggtccggccgcccaaggacgaggacgacatggttagcgacgaggagtgggactgatgactgatctggagagcgttttggttgtggagatgccaatttgtcttttctccatagggtaccggtggtaaagcttttccccctctctttaccaatttgtcgcgtcgctgaataagaatttgccaccctacttttgttgttgc

SEQ ID NO: 2246 - DNA, 1801 bp, Setaria italica
tctccccccttatcgccaccatgctctccctctcccacccgcacacgcaccccgccgcggcgccgcggcaccagcgcgcgccccgccccgccgtcgcggccacccccgcgtcgtgccgccgccgcgccagccacatcgccgcgagcgcaatcctgctccccggcggcggcagcacgggcggccgcggcgaccggaagctccccttcacccctcccccgatggctccgccgggccagctctaccagcccttccacccgccgccgtccccgcttccgtccaagttccgcaccctcgacctcacccagcgcctcgaggtccttcgcgagcgcctgggccagtggcacgagtacgcgcccctcatctccgcgctctcccgcgacggcttcaccccgtcctccatcgaggaggccacgagcatcaccggcgtcgagcagaactgcctcgtcgtcgcgtcccaggtccgcgactcgctcctcagcgagacggccgcgttccctcccgacctgcttccctacttcgactcctacggcgggcccgacctgctctacgagctccgcttcctcaacgcgccgacgccgcgaagcacgccatcgactaccgcctcgagcccaagggcgtgcgggagctggcgcgctccatgaaggacttcccgcgccgccgcgcggtggacgaaggatgggaggccttcgacggcgcgtccccgggggactgcctcgccttcgcgcgcttccgccagtcgcgggaggccatcgacgtggatgaccgcatcgccgagctcaaccgcgcgctgcaggtcgtggccaccgagacggccagggcgcgtcttgagctcgagatggagcgcgccaggaagaaggccgccggggaggaggtggaggagggcgaggacgacaccgcctcgcgacccgccgtcaacgtggtgcggctccagtacggcgaggtcgccgaggcgtccaccgtgctgctgctgccggtggtgagggagacggacggcgtcgcggccatggagtccgcgcccaggcggaccaagacggacgtcgacctcgggatcgtggaggtggacaaggcgtgggcgcgctgggccgtcgtgcccggatggggccccgtcgccgcggccgcggaggaggcggtcgcgatcgagctggccgacgggcgcaggctgccgtggcggacggccgaggaggagccggtgctggtcattgccaaccggggccagaaggaggtggcggagcaggggagctacgtcctcgagaaggaaggccggcttgtggtggagagggggagaaagctggctgagcagggcatcaccgtcgcagccgccgaggtgttgatcgttgtccggccgcccagggatgaggacgaaatgatcagcgacgaggagtgggactaattggaggggtttaggaagttttttcttggagatggcaatttttttcatgggtagagttttcccctcttctcgtcacagttgatgaacaagaggaacgaactgccgctttgattcggtatatccgtacatgtcatataggaacattgtgtagtcccttagcctttgcattgctggctattgtttcgcctcattatatttaaataatatgatcacataaacacatgccattgctgaaaatatgcttttccctgtcttacaggactttccaaaaccttaactcaatagcaaaatgaaactacatactggtacaaggtagtcatctaaatctgcagtcagaagtctcaggacttcaggacattggcacattgccagagctgcaatcttgatcttaactttgggtcagctatagca

SEQ ID NO: 2247 - DNA, 2369 bp, Zea mays
gggctggcgcgaggttcgttggaccaggaaaccgcggtcggcggagctctcgctctcgctctcgcttcgttgaaggctcccctcttcctccaagtataaaggagcctcctttccctttgccgtgctgtgccgcgcctgccattctcctcccgagccttctcttccttcacgcctctttgccgcagcgcgggtgggtcgtcgtttgctgtttgttccgagatcaccggagccagccagccagccagaggcagagatgaggtggtcggcgttcctgtgggaggccgcgtccggccgccgcccgggggtttccaacctcctcctcgtcgtcgcagccgccagtagcggaggtctcgtcgcgtacgccgactccggatcagatgctgctgtcgagcagccgcagcttcctccgaggaagaaggtcgtggtgcttgggactggttggggcggcacgacgttcctgaggaacctcgatagcagactgtatgatgtgcaggttatatctcctcggaactacttcgcgttcacgccgctgctcccgagtgtcacttctggaacagttgagcctaggagcattgtggagccgatccgtagggttttggagaagaaaggtggagaaatcaaattttgggaagcagagtgtttcaagattgatccacaaagcaagaaaatccattgtcgctcgaatgttgggacaagccttgaggggaatggcgagttcttggttgactatgactatctcgtggtagcagttggggctaggacaaatacattcaatactcctggtgtggtagagaattgccacttcttgaaggaagtagaggatgctcaaaagatcagacggagtgtgatggactgctttgagagagcaagcctcccctttcttaatgaagaagagaggaagaagaatcttcattttgttgttgtgggtggtggacctactggagtggaatttgcagcatctttgcatgattttgttaccgaagatttatccaagctttacccctcgattcagcaccttgtcaagatatcgttgattgaagctgcagatcatatactgaccatgtttgacaagaggataactaattttgctgaggataagtttggaagggatggtattgatgtgaaaactggatataaagttgtgaaggtttctaaggatgatattaccatgcaaaatcctgccaccggggatatttcagtcccttatgggatggctgtctggtcgactggtattggaactcgtccattcgttgtggaatttatgaaacaaattggccaggctaatcgccgtgtcttggctactgatgaatggctaagggtccgtgaatgtgatggtgtctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggtacccgcaagtacagctctaccttaagagcaagcagatgaacggcatcgctgatctagtgaggagcgccaaaggagacgctgagaaggaatccgtggaactgaacatcgaggaattcaagaaggctctttcgctcgtggattcacaagtcaaattcttacctgcgaccgctcaggtcgcatcgcagcagggccaatatcttgctaggtgctttaacaagatgaaggatgctgaagaaaaccctgaaggcccaatccgcatcaggggagaaggccgccatcgcttccgccccttcaggtaccggcatctgggccaattcgccccactaggaggggagcaaactgctgcacagcttcccggggactggatctccattggccacagctcccagtggctctggtactccgtgtacgcaaccaaacaaatcagctggcgcacgaggatgctggtggtatcagactggacacgccgattcatcttcggaagagactcgagttgcatatgatcaagagggaaaagattttgctgtgacatatattcagatgaacgaggccagtacagcctcttcccactttttttttagtctgatttcacataaatgttccccttttgttgttagggaagaatctgacttcccctgcactttgtatagtgcaccacgaagaaattcctttgtacctaccttttctttttgagagagttgcactgcacttttgcggtctgagtaagctcagaattcttttaatagctattttttctaccactaatatgtgatatggagaagggtcagtttggacctgattttgttgtgtgaaatcctgttttggctactcattgtgtgctgaactagtggttcagttggttacatgaattttctggcacttggt

SEQ ID NO: 2248 - DNA, 2321 bp, Zea mays
ctcgctctcgctctcgcttcgttgaaggctcccctcttcctccaagtataaaggagcctcctttccctttgccgtgctgtgccgcgcctgccattctcctcccgagccttctcttccttcacgcctctttgccgcagcgcgggtgggtcgtcgtttgctgtttgttccgagatcaccggagccagccagccagccagaggcagagatgaggtggtcggcgttcctgtgggaggccgcgtccggccgccgcccgggggtttccaacctcctcctcgtcgtcgcagccgccagtagcggaggtctcgtcgcgtacgccgactccggatcagatgctgctgtcgagcagccgcagcttcctccgaggaagaaggtcgtggtgcttgggactggttggggcggcacgacgttcctgaggaacctcgatagcagactgtatgatgtgcaggttatatctcctcggaactacttcgcgttcacgccgctgctcccgagtgtcacttctggaacagttgagcctaggagcattgtggagccgatccgtagggttttggagaagaaaggtggagaaatcaaattttgggaagcagagtgtttcaagattgatccacaaagcaagaaaatccattgtcgctcgaatgttgggacaagccttgaggggaatggcgagttcttggttgactatgactatctcgtggtagcagttggggctaggacaaatacattcaatactcctggtgtggtagagaattgccacttcttgaaggaagtagaggatgctcaaaagatcagacggagtgtgatggactgctttgagagagcaagcctcccctttcttaatgaagaagagaggaagaagaatcttcattttgttgttgtgggtggtggacctactggagtggaatttgcagcatctttgcatgattttgttaccgaagatttatccaagctttacccctcgattcagcaccttgtcaagatatcgttgattgaagctgcagatcatatactgaccatgtttgacaagaggataacaaattttgctgaggataagtttggaagggatggtattgatgtgaaaactggatataaagttgtgaaggtttctaaggatgatattaccatgcaaaatcctgccaccggggatatttcagtcccttatgggatggctgtctggtcgactggtattggaactcgtccattcgttgtggaatttatgaaacaaattggccaggccaatcgccgtgtcttggctactgatgaatggctaagggtccgtgaatgtgatggtgtctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggtacccgcaagtacagctctaccttaagagcaagcagatgaacggcatcgctgatctagtgaggagcgccaaaggagacgctgagaaggaatccgtggaactgaacatcgaggaattcaagaaggctctttcgctcgtggattcacaagtcaaattcttacctgcgaccgctcaggtcgcatcgcagcagggccaatatcttgctaggtgctttaacaagatgaaggatgctgaagaaaaccctgaaggcccaatccgcatcaggggagaaggccgccatcgcttccgccccttcaggtaccggcatctgggccaattcgccccactaggaggggagcaaactgctgcacagcttcccggggactggatctccattggccacagctcccagtggctctggtactccgtgtacgcaaccaaacaaatcagctggcgcacgaggatgctggtggtatcagactggacacgccgattcatcttcggaagagactcgagttgcatatgatcaagagggaaaagattttgctgtgacatatattcagatgaacgaggccagtacagcctcttcccactttttttttagtctgatttcacataaatgttccccttttgttgttagggaagaatctgacttcccctgcactttgtatagtgcaccacgaagaaattcctttgtacctaccttttctttttgagagagttgcactgcacttttgcggtctgagtaagctcagaattcttttaatagctattttttctaccactaatatgtgatatggagaagggtcagtttggacctgattttgttgtgtgaaatcctgttttggctactcattgtgtgctgaactagtggttcagttggttacatgaattttctggcacttggt

SEQ ID NO: 2249 - DNA, 2054 bp, Panicum virgatum
cggcgcccgccgccgccccggcgtctccaacctccttctcgtcgtcgccgccgcgagtagtggaggcctcgtcgcgtatgcggactctggatcagatgctgctgttgagaagccccagcttcctcagaggaaaaaagttgtggtgcttgggactggttggggcggcaccacattcctgaggaatctcgacagcagaatgtatgatgtgcaggtcatatctcctcggaactactttgcttttacgccgttgctcccaagtgtcacatctggaacagttgagccaaggagcattgttgagccaattcgtaggattttggagaagaaaggtggagaaatcaaattttgggaagcagagtgcttcaagattgatccgcagaacaagaaaatccattgccgctcgaatattgggacaaatcttgatgggaatggcgagttcttggctgactacgactatcttgtggtagctgtcggagctaggacgaatacattcaatactcctggtgtggtcgagaattgtcacttcttgaaggaagttgaggatgctcaaaagatccggcggagtgtgatggactgcttcgagagggcaagcctccccttcctggatgaagaagagaggaagaagaaccttcattttgttgttgtcggtggtggacctactggagtggaatttgcagcatctttgcatgattttgttactgaagatttatccaagctttatccctcaattcagcaccttgtcaagatatcattgatcgaagctgctgatcacatattgaccatgtttgacaagaggataactaactttgctgaggataagtttggaagggatggcattgatgtaaaaactggatacaaagttgtgaaggtctctaaggatgcgattaccatgcaaaatcctgcaactgggaacatctcagttccttatggaatggctgtctggtcgactggtattggaactcgtccattcattgtggaattcatgaaacaaattggccaggggaataggcgtgtcttagccactgatgagtggctaagggtccgtgaatgtgatggtgtctacgcaattggcgattgtgctacaataaaccagaggagagtaatggaagatattgcagaaatattcagagttgcagataaagataagtctggaaccttgactgtcaaagagattcaagatgtgttggatgatatttacgttagatacccacaagtgcagctctaccttaagagcaagcaaatgaatggtattgccgatttagtgaggagtgccaaaggagatgctgagaaggaatctgtggagctgaatatcgaagaattcaagaaggctctttcattggtggactcgcaagtcaaattcctacctgcaactgctcaggtggcttcgcagcaagggcaatatcttgctaggtgttttaacaagatgaaggatgctgaagaacatcctgaaggccctatccgcatcaggggagaaggccgccatcgcttccgtcctttcaggtaccggcatctgggccaattcgctccactaggaggtgagcaaactgccgcacagctccccggagactggatctccattggccacagcactcagtggctctggtactccgtgtatgcgaccaaacaaatcagctggcgcacgaggatgctggtggtatctgactggacacgccgattcatctttggaagagactccagctgcatatagtcaagaaggaaactgaaatttttgctgtgacataatcagatgatcagggccaatagagctcatcccactatgagttttgaatgacataaaagttcttttttttggttgagggaagaatgaaatttccctgcacttgtatagtgcaccacgaaattcctttgttactaccttttggagagagttgtactcactttgcggcctgagcatgctcagattctttaatagccttttttctaccaccaagaaatgatatgcaaaaggagtcagtttctaccagactttgttccgtgacactatccatgttagtggtcctggtccagttggttgcatgaatttcctaaaatctggt

SEQ ID NO: 2250 - DNA, 1945 bp, Setaria italica
ccgcaagtagtggaggcctcgtcgcttatgcggactccggatcagatgctgctgttgagaagccccagcttcctcagaggaagaaagttgtggtgcttgggactggttggggtggcaccacattcctgaggaatctcgataccagattgtatgatgtgcaggtcatatctccccggaactactttgcttttacaccattgctcccaagcgtcacttctggaacagttgagccaaggagcatcgtcgagccaattcgaagggttttggagaagaaaggtgaagaaatcaaattttgggaagcagagtgcttcaagattgatccacaaaacaagaaaatccattgtcgctcgaatcttgggacaaatcttgatggaaatggtgagttcttggttgactacgtagcagttggagctagggtaaatacattcaatactcctggtgtggtcgagaattgccacttcttgaaggaagttgaggatgctcagaagatccgacggagtgtgatggactgctttgagagggcaagtctccccttcctggatgaagaagagaggaggaagaatcttcattttgttgttgtcggtggtggacctactggagtggaatttgcagcatctttgcatgattttgttactgaagatttatccaagctttatccctcgattcagcaccttgtcaagatatcattgattgaagctgcagatcacatactgaccatgttcgacaagaggataacaaactttgctgaggataagtttggaagggatggcattgatgtgaaaactggatacaaagttgtgaaggtttctaaggatgctattaccatgcaaaatcctggcactggggacatctcagttccttatggaatggctgtctggtccactggtattggaactcgtccattcattgtggaattcatgaaacagattggccagggcaataggcgtgtcttagccactgatgaatggctaagggtccgtgaatgtgatggtgtctatgcaattggtgattgtgctacaataaaccagaggagagtaatggaagatatttcagaaatattcagagttgcagataaagataagtctggaaccttgactgtgaaagagattcaagacgtgttggatgatatttccatgagatacccacaattgcagctctaccttaagagcaagcaaatgaatggtattgccgatttagtaaggagtgcgaaaggagatgctgagaaggaatctgtggagctgaatatcgaagaattcaagaaggctctttcactggtggattcacaagtcaaattcctacctgcaactgctcaggtggcttcgcagcaagggcaatatcttgctaggtgtttcaacaagatgaaggatgctgaagaacaccctgaaggccccatccgcatcaggggagaaggccgccatcggttccgccccttcaggtaccggcatctgggccaattcgcccctctaggaggtgagcaaactgctgcacagcttcctggagactggatctccattggccatagctctcagtggctctggtactccgtgtatgcgaccaaacaaatcagctggcgcacgaggatgctggtggtatctgattggacgcgtcgattcatcttcggaagagactcaagctgcatataattaagaaggaaactaaagttttttgctgtgacatattcagatgatcagggccattagagccttctcccactatgagttttgtttcacataaaagttcttttttttgttaagggaagaatgaaagttcccttgcacttgtatagtgcaccacgaaattcctttgtactacacttttggagagagttgtacctcactttcgcggcctgagcaagctcagattcgtttaatagcctttttgtaccactaagatatgacgtgcaaggggtcagtttggccctgattttgttctgtgaaattctgtt

SEQ ID NO: 2251 - DNA, 2289 bp, Brachypodium distachyon
ggactgggagcttcttcttcgcataaaagactcttctgcgggcgaggcggccaaagaaaggtgcctgcctgcctgccatttcgcttcttctttcttcttccttccccagatcaccggaggagaaaggaacagagctgtgctgctgtgcctgtgaaggaagaagagatgaggtggacggcgttcgtgtgggacggcgcgaccagggcaatgaagcaccgccccaccttcaccaacctcgtcctcgtcctcgccgcaagtagcggaggaggcctcgttgcgtatgcggactctcagtcggatggtgttgttgacatgccccaaggacctaagaagaagaaagttgtggttcttgggactgggtggggtggcaccacgttcctgaggaatcttgatagcaaactgtatgatgtccaggtcatttcacctcggaactactttgcattcacacccttgctcccaagtgtcacctgtggaacagttgagccaaggagcgttgttgagccaatccgcaggatcttggagaagaaaggtggagacttcaaattctgggaagcagagtgcttcaagattgatccagcaaacaagaagatccattgccgctcaaatgctgggacaaatcttgatggaaatggcgagttcttagttgactatgactatctagtggtagcagttggagccaggtctaacacattcaatactccgggtgttgaggagaattgccactttctgaaggaagttgaggatgcccaaaagatacgaaggagtgtgatgaactgctttgagaaggcaagcctcccatacctcaatgaggaagagaaaaagaagaatcttcacttcgttattgtgggcggtggccctacaggtgtagaattcgcagcagagttgcatgattttgttactgaagatctatccaagctatatccttccattcagcaccttgtgaaaatatcattgatcgaagctgcagatcacatactgactatgtttgacaagagaataaccaactttgctgaggataagtttggaaggaatggcattgatgtgaaaactggatataaagttgtgaaggtttcgaaggatgcaattactatgcaaaatccagctactggggatattgcagttccttatggaatggctgtctggtccactggtattggaacccgtccattcattgtggacttcatgaaacagattggccaggctaatcgtcgtgtcctggctactgatgaatggctaagggtgcgtgaatgtgatgatatctacgcagtaggtgattgcgctaccataaaccagcggagagtaatggaagacatcgcagaaatattcagagttgcagacaaagataaatctggaaccttgactgtgaaagaaattcaagatatcttggaggatatctatgtgagatatccacaagtaaagctatacatgaagagcaaacaaatgaatggaattgctgatttgataagcactggcgaaggtgataccaaaaaggaaaatgtagagctgaacattgaagagttcaagaaggctctttcacttgtggattcacaagtcaagaatctaccggcaacagctcaggttgctgcacagcaaggacaataccttgctaggtgtttcaacaagatgccagatgctgaagaaaatcctgaaggtccaatccgcataaggggagaaggccgtcatcgcttccgtcccttcaggtacagacatttaggccagtttgccccactaggaggggaacaaacggctgcacagctccctggagattggatctccattggccatagctcacagtggctctggtattctgtttatgcaaccaaacagataagctggcgcacgagggcgctggtgatatctgactggggccgtcgctttatcttcggcagagactcgagttgcatatagtcaaggagataagattttgttcgtgacatattcagaagctaagaccagcagtggtgcctctcacttagtctgtttttgcagatacatatgttcttttcttttgtcaggggaaagaataaaagtaaccctgcacttccctagtgctccacggagaaaattcccctgtacttttcactcttatgagatttacttttgcggcatgcgcaaacttgcagattaattttgtagttcctttacgaaatgataaagcaaaagggccagttcggacctgattttgttctgagaaaccttgtttatgtgaacacctgattctgtcatgtgaaatgatgtttgtgttggaacctgattttgttctgaaaaatcctgtttatgtgcattgta

SEQ ID NO: 2252 - DNA, 2214 bp, Hordeum vulgare
ctttttcttcttctactcctgctgccgccgccgccagtacgttccaggatcaccggagccccggaggaagagcaaagcgtaccggagggaggaagatgaggtggacggcgttcgcgtgggagagcgcgtcccgggccttcaacaaccgccccaccttcaccggcctcgtcgtcgtcctcgccgcaagtagtggaggaggcctcgtcgcatatgcggattctcagccggaccagccccaaggatttaaaaagaagaaagtagtggttcttggaactggctgggctggcaccacattcctgaggaatcttgatagcaaactgtatgatgtccaggtcatttcacctcggaactactttgcattcacacccttgctcccaagtgttacctgtggaacagttgaaccaaggagtgttgttgagccaatccgtaggattctggagaagaaaggtggagacttcaaattctgggaagcagagtgcttcaagattgatccagcaaacaaaaagattcattgccgctcaaatgtggggacaaatcttgatggaaatggagagttcttagttgactatgactatctggtggtagcagttggagctaggtctaacacattcaatactcccggtgtgacagagaattgccactttctgaaggaagtagaggatgcccaaaagatccgaaggagcgtgatggactgctttgagaaggcaagcctcccataccttaatgaagaagagaggaagaagaaccttcactttgttgttgtggggggtggacctacgggcgttgaatttgcagcagagttgcatgattttgttactgaagatctatccaagctctatccttccattcagcatcttgtcaagatatcactgatcgaagctgcagatcacatactgactatgttcgacaagagaattaccaactttgctgaggacaagtttgggagggatggcattgatgttaaaactggatataaagttgtgaaggtttctaaagatgcaattaccatgcaaaatccagctactggcgatattgcagttccttacggaatggctgtctggtccaccggtattggaacccgcccattcgttgtggacttcatgaaacaaattggacaggctaatcgtcgtgtccttgctactgatgaatggctaagggtgcgtgaatgtgatgatgtctatgcagtaggtgactgtgctaccataaaccagcggagagtaatggaggacatctcagaaatattcagagttgcagacaaagataaatctggaaccttgactgtgaaagaaatccaagacatcctggaggatatctacgtgaggtatccgcaagtaaaactatacatgaagagcaagcaaatgaacggaattgcagatttaataagaactggcaaaggtgacactgaaaaggaatctgtagatctaagcattgaagagtttaagaaggctctttcacttgtggattcacaagtcaagaatctacctgcaacagctcaggttgctgcacagcaaggacagtatcttgcgacgtgctttaacaagatgcaggctgctgaagaaaatcctgaaggtccgatccgcattaggggagaaggccgtcatcgtttcaaccccttcaggtacaggcatttaggccagtttgccccactaggaggggagcaaaccgctgcacagctccctggtgactgggtctccatcggccacagctcacagtggctctggtattccgtctacgcaaccaaacaaataagctggcgcacgagggcactggtgatatctgactggggccgtcgcttcatcttcggtagagactcgagcggcatatagtcaaaggagatatgattttgtttgcggcatatacagaagctaagctaaggccagtagtggtaccttccaccaaagtctgttcttgcagatgcatataatccttttttgtcagggaaagaataaaagcaaccctgcacttccctagtgctccacggaaaaaattcctttgtacttaccttttactctcgagagttctacttgtgcggcacgcgtaaactcgcagattaattttgtactagtttttcttacgacaaaggtaagcaaaaggccagtttggacctgtttttgttctggaaaatcctgtttgtgtgaaggcctgattttgtcatgagaaatatactgttgatgtggaggccagattttgtgctgtgaaaaaaaaaaaaaaaaa

SEQ ID NO: 2253 - DNA, 2152 bp, Hordeum vulgare
cggcacgaggctttttcttcttctactcctgctgccgccgccgccagtacgttccaggatcaccggagccccggaggaagagcaaagcgtaccggagggaggaagatgaggtggacggcgttcgcgtgggagagcgcgtcccgggccttcaacaaccgccccaccttcaccggcctcgtcgtcgtcctcgccgcaagtagtggaggaggcctcgtcgcatatgcggattctcagccggaccagccccaaggatttaaaaagaagaaagtagtggttcttggaactggctgggctggcaccacattcctgaggaatcttgatagcaaactgtatgatgtccaggtcatttcacctcggaactactttgcattcacacccttgctcccaagtgttacctgtggaacagttgaaccaaggagtgttgttgagccaatccgtaggattctggagaagaaaggtggagacttcaaattctgggaagcagagtgcttcaagattgatccagcaaacaaaaagattcattgccgctcaaatgtggggacaaatcttgatggaaatggagagttcttagttgactatgactatctggtggtagcagttggagctaggtctaacacattcaatactcccggtgtgacagagaattgccactttctgaaggaagtagaggatgcccaaaagatccgaaggagcgtgatggactgctttgagaaggcaagcctcccataccttaatgaagaagagaggaagaagaaccttcactttgttgttgtggggggtggacctacgggcgttgaatttgcagcagagttgcatgattttgttactgaagatctatccaagctctatccttccattcagcatcttgtcaagatatcactgatcgaagctgcagatcacatactgactatgttcgacaagagaattaccaactttgctgaggacaagtttgggagggatggcattgatgttaaaactggatataaagttgtgaaggtttctaaagatgcaattaccatgcaaaatccagctactggcgatattgcagttccttacggaatggctgtctggtccaccggtattggaacccgcccattcgttgtggacttcatgaaacaaattggacaggccaatcgtcgtgtccttgctactgatgaatggctaagggtgcgtgaatgtgatgatgtctatgcagtaggtgactgtgctaccataaaccagcggagagtaatggaggacatctcagaaatattcagagttgcagacaaagataaatctggaaccttgactgtgaaagaaatccaagacatcctggaggatatctacgtgaggtatccgcaagtaaaactatacatgaagagcaagcaaatgaacggaattgcagatttaataagaactggcaaaggtgacactgaaaaggaatctgtagatctaagcattgaagagtttaagaaggctctttcacttgtggattcacaagtcaagaatctacctgcaacagctcaggttgctgcacagcaaggacagtatcttgcgacgtgctttaacaagatgcaggctgctgaagaaaatcctgaaggtccgatccgcattaggggagaaggccgtcatcgtttcaaccccttcaggtacaggcatttaggccagtttgccccactaggaggggagcaaaccgctgcacagctccctggtgactgggtctccatcggccacagctcacagtggctctggtattccgtctacgcaaccaaacaaataagctggcgcacgagggcactggtgatatctgactggggccgtcgcttcatcttcggtagagactcgagcggcatatagtcaaaggagatatgattttgtttgcggcatatacagaagctaagctaaggccagtagtggtaccttccaccaaagtctgttcttgcagatgcatataatccttttttgtcagggaaagaataaaagcaaccctgcacttccctagtgctccacggaaaaaattcctttgtacttaccttttactctcgagagttctacttgtgcggcacgcgtaaactcgcagattaattttgtactagtttttcttacgacaaaggtaagcaaaaggccagtttggacctgtttttgttctggaaaatcctgttgtgtgaaggcc

SEQ ID NO: 2254 - DNA, 3831 bp, Triticum aestivum
tcagaggttgagctgtacaaatttgctccttgggaccttcctgataaatcctgtctccagagcaaagatcttgagtggttcttcttttgtccccgtgacaaaaaatatcctaaagggtctaggacgaaccgtgccacaccaaatggttattggaaaacaagtggaaaagacagaacaattgagctgaactctcgcattgttgggttgaagaaaacattgatttttcatgaaggcaaggcacccaaaggcaataggactgactgggtgatgtatgaatacaaaatggaagatgaaactttggtgtctgctggtttctctaaggatgcttatgtactctgcaagatatttaaaaagagtgggcttggcccaaggatcggcgagcaatatggggctccttttgatgaaaatgaatgggagaatttagatgttggatcttctatcttctcttttgcaccgtcgtcaggtgtagaggatccacaggttgaaagttctgccttggctactgccatagttatgcaggaaccatccgctcctcagcagtctgttcaattttctgaacatgttaatatctgttctgatgaggtcaatgacgcgcctcctgaaattgatggaatattgttggacgaactggcaaagtttttggatgattctccgaacgatgatgtagttttgccagagaattctggtctccctccaatgtctgagcttgaggctcaagcttttgagataaatactgctgagctctatgaccaattggcaggactttcccagtcaggagatatgtctactgtaaatttccctgctagcaacggggatgttattgaaaacaatttgcagcaagcaaactctggacttgctatggatgatgattatatagggctggatgatctgcttgctcctggggaaaccttctcctatgatttttctggtgaaaccttttcctatgatctgcctggtggaagcttctcctatgatttgtctgtgccaaacaatcagtttttgctgtacccacttgatcaatcaactagtggcagtcactacggtgttggtgctactcaatcaactttcgaagcaagtggaactcttccaccaatgcaaccaatgccaagcacttttaatgacatgccttctgtttccaattgcttgaacccagccatgaaagacccattctcttagacagcaacttttgaggtataagtctgttatctttgtggtcattggtgctggaagatgctgccgtttctggtttggttgcccatcattgtctgatgaggctcttggtggatcttggatgttggtccctgctgtagatggtccaacaatggtgtttgtatcatggcatggctgctgctcaattgaagaagccggaacttggttgtgtctttgatcacgagcacaatactggacaagtgaccgagcttagcttactgctttaccgcggaggaactgtttctgctggtttggaagatgtcttatctgggtggggatgctgcagtccaccgtagttctttctgtaataactgccatgttagatgccgagttgtccataaacctaatgacaacttcgtagcttaagtcgcatcttctatctattttctgccaatttactgtatttgaaccatcgtcattattattattattgtaatcgtgcctcgtgccgaattcggcacgaggtcccctgctactgctagtacgttccaggatcgccggagccccggaggaagagcaaagcgtaggggaggagggagagagaaagagagatgaggtggacggcgttcgcgtgggagagcgcgtcccgggccttcaacaaccgccccaccttcaccggcctcgtcgtcgtcctcgccgcaagtagtggaggaggcctcgttgcatatgcggactctcagccggaccagccccaaggatttaaaaagaagaaagtagtggttcttggaactggctgggctggcaccacattcctgaggaatcttgatagcaaactgtacgatgtccaggtcatttcacctcggaactactttgcattcacacccttgctcccaagtgttacctgtggaacagttgaaccaaggagcgttgttgagccaatccgtaggattctggagaagaaaggtggagacttcaaattctgggaagcagagtgcttcaagattgatccagcaaacaagaagattcattgccgctcaaatatggggacaaatcttgatggaaatggcgagttcttagttgactatgactatctggtggtagctgttggagctaggtctaacacattcaatactcccggtgtgacagagaattgccactttttgaaggaagtggaagatgcccaaaagatccgaaggagtgtgatggactgctttgagaaggcaagcctcccataccttaatgaagaagagaggaagaagaatcttcactttgttgttgtgggaggtggacctacaggcgttgaatttgcggcagagttgcatgattttgttactgaagatctatccaagctctatccttctattcagcatcttgtcaagatatcactgatcgaagctgcagatcacatactgactatgttcgacaaaagaattaccaactttgctgaggacaagtttggaagggatggcattgatgtaaaaactggatataaagttgtgaaggtttctaaggatgcaattaccatgcaaaatccagctactggcgatattacagttccttacggaatggctgtctggtccactggtattgggacccgcccattcgttgtggacttcatgaaacaaattggccaggctaatcgtcgtgtcctcgctactgatgaatggctaagggtgcgtgaatgtgatgatgtttatgcagtaggtgactgtgctaccataaaccagcggagagtaatggaggacatctcagaaatattcagagttgcagacaaagataaatctggaaccttgactgtgaaagaaatccaagacatcctggaggatatctacgtgagatatccgcaagtaaagctatacatgaagagcaagcaactgaacggaattgcagatttaataagaactggcaaaggtgacaccgaaaaggaatctgtagagctgagcattgaagagtttaagaaggctctttcactcgtggattcacaagtcaagaatctacctgcaacagctcaggttgctgcacagcaaggacagtatcttgcgacgtgctttaacaagatgcagactgctgaagaaaatcctgaaggaccaatccgcattaggggagaaggccgtcatcgtttcaaccccttcaggtacaggcatttaggccagtttgccccactaggaggggagcaaaccgctgcacagctcccgggtgactgggtctccattggccacagctcacagtggctctggtattccgtctacgcaaccaaacaaataagctggcgcacgagggcactggtgatatctgactggggccgtcgcttcatcttcggtagagactcgagcggcatatagtcaaaggagatatgattttgtttgcagcatatacagaagctaagctaaggccagtagtggcaccttccacccaagtctgttcttgcagatgcatataatcttttttgtcagggaaagaataaaagtaaccctgcacttccctagtgctccacggagaaaattcctttgtacctttttactctcgagagttctacttctgcggcacgcgcaaacccgcagattaattttgtagtccttttaccacaaagatatgcaaagggccagtttggacctgtttttgttctgaaaaatcctgtttgtgcggaggcctgatattgtcatgcgaaatgctgttgatgtg

SEQ ID NO: 2255 - DNA, 2117 bp, Triticum aestivum
ccctgctagtagtacgttccaggatcgccggagccccggaggaagagcaaagcgtagcggaggagggagagggagagagagatgaggtggacggcgttcgcgtgggagagcgcgtcccgggccttcaacaaccgccccaccttcaccggcctcgtcgtcgtcctcgccgcaagtagtggaggaggcctcgtcgcatatgcggactctcagccggaccagccccaaggatttaaaaagaagaaagtagtggttcttggaactggctgggctggcaccacattcctgaggaatcttgatagcaaactgtacgatgtccaggtcatttcacctcggaactactttgcattcacacccttgctcccaagtgttacctgtggaacagttgaaccaaggagcgttgttgagccaatccgtaggattctggagaagaaaggtggagacttcaaattctgggaagcagagtgcttcaagattgatccagcaaacaagaagattcattgccgctcaaatatggggacaaatcttgatggaaatggcgagttcttagttgactatgactatctggtggtagcggttggagctaggtctaacacattcaatactcccggtgtgacagagaattgccactttttgaaggaagtggaagatgcccaaaagatccgaaggagtgtgatggactgctttgagaaggcaagcctcccataccttaatgaagaagagaggaagaagaatcttcactttgttgttgtgggaggtggacctacaggcgttgaatttgcggcagagttgcatgattttgttactgaagatctatccaagctctatccttctattcagcatcttgtcaagatatcactgatcgaagctgcagatcacatactgactatgttcgacaaaagaattaccaactttgctgaggacaagtttggaagggatggcattgatgtaaaaactggatataaagttgtgaaggtttctaaggatgcaattaccatgcaaaatccagctactggcgatattacagttccttacggaatggctgtctggtccactggtattgggacccgcccattcgttgtggacttcatgaaacaaattggccaggctaatcgtcgtgtccttgctactgatgaatggctaagggtgcgtgaatgtgatgatgtttatgcagtaggtgactgtgctaccataaaccagcggagagtaatggaggacatctcagaaatattcagagttgcagacaaagataaatctggaactttgactgtgaaagaaatccaagacatcctggaggatatctacgtgagatatccgcaagtaaaactatacatgaagagcaagcaactgaacggaattgcagatttaataagaactggcaaaggtgacaccgaaaaggaatctgtagagctgaacattgaagagtttaagaaggctctttcactcgtggattcacaagtcaagaatctacctgcaacagctcaggttgctgcacagcaaggacagtatcttgcgacatgctttaacaagatgcagactgctgaacaaaatcctgaaggaccaatccgcattaggggagaaggccgtcatcgtttcaaccccttcaggtacaggcatttaggccagtttgctccattaggaggggagcaaactgctgcacagctcccgggtgactgggtctccattggccacagctcacagtggctctggtattccgtctacgcaaccaaacaaataagctggcgcacgagggcactggtgatatctgactggggccgtcgcttcatcttcggtagggactcgagcggcatatagtcaaaggagatatgattttgcttgcggtatatacagaggctaaggccagtagtggtaccttccacccaagtctgttcttgcagatgcatataatcttttttgtcggggaaagaataaaagtaaccctgcacttccctagtgctccacggagaaaattcctttgtacctttttactctcgagagttctacttctgcggcatgcgcaaacccgcagattaattttgtagtccatttaccacaaagatgtgcaaagggccagtttggacctgtttttgttctgaaaaatcctgtttgtgcggaggcct

SEQ ID NO: 2256 - DNA, 2637 bp, Oryza sativa
cggcgaccagacgaaaagcacaccaattccgtctcctcctcctccaccaccttctctctactcctcctaccttctcgccgtagcgtagctagctagagcctagagcggaggagcatatcctccgagatcaccggagaagaggcagcagcagcagggcgccgcgccggcgatgaggtggacggcgttcatgtgggagggcgcgtcgagggcgttcaaccaccgccccaccttcaccaacctcgtcctcgtcctcggcgccgccagtagtggaggactagtagcatatgcggattccaattcagatgatgttgttgggaagccccagggacctccaaagaagaaaatcgttgttcttggcaccggttggggtggcaccacgttcctgaggaatcttgacagcagactgtatgatgttcaggtcatttcacctcggaattatttcgcattcacgcccctgctcccaagtgtcacttgtgggacagttgagccaaggagcgttgttgagccgattcgtaggattttggagaagaaaggtggagatatcaaattctgggaagcagaatgctttaagattgattcatcaaacaagaagatccattgccggtccaatatagggacaaatcttgatggaaatggcgaattcttggttgactacgactatcttgtgatagcagttggagctaggtctaatacatttaacactccaggtgttgaggagaattgcttctttttgaaggaagtagaggatgcccaaaagatccgaaggaatgtgatggactgcttcgagagagcaagtcttccttacctggatgaagaagagaggaagaagaaccttcactttgttgttgtaggtggtggacctacaggcgtggaatttgccgcagagttgcacgattttgttaccgaagatctatccaagctgtatccttctattcagcaccttgtcaagatatcactgattgaagctgcagatcacatactgactatgtttgacaagaggattactgaatttgctgaggataagtttggaagggatggcattgatgtgaaaactggatacaaagttgtgaaggttgctaaggatgcaattaccatgcaaaatccagccactggagatatcgcggttccttatggaatggctgtttggtccactggtattggtacccggcccttcatttcagagttcatgaaacaaattgggcaggtacctagcaagaaactcagctcgactctttgtagctagctgagttatccatctaattctccgtctacatttgcagggcaaacggcgtgtactagccactgatgaatggctaagggtccgtgaatgtgatggtgtttatgctgtaggagattgtgctacgataaaccagcggagagtaatggatgatatctcggaaatattcagagtagcagataaagataactctggaaccttgacagtgaaagaaatccaagatgtcttggatgatatctacgtgagatatccccaggtagagctctatctgaagagcaggcaaatgaatggaatcgctgatttagtaaggactgccaaaggtgatgctgaaaaggaatctgtagaactgaacattgaagaatttaagaaagctctttctcttgttgattcgcaagtcaaaaatctgcctgcaactgctcaggttgcttcacagcagggacaatatttggctaggtgcttcaataagatgaaggatgctgaagaaaaccctgaaggccccatccgtataaggggagaaggacgccatcgtttccgccctttcaggtacaggcatttaggccaatttgccccactaggaggtgagcagactgctgcacagctccctggtgattggatctccattggccacagcacacagtggctctggtattctgtctacgcaactaaacaaataagctggcgcacgagggcactggtgatctctgactggagccgtcgctttatcttcggtagggactcaagttgcatatagtcaagaaggaaaatattttgttgtgacatattcatcagaagctaagtgcatcagtagtgcctgcctcccactcgagtttgtttctgcaaatatatattctttttggttaggaaagaataaaagttacccttttttttttcttacatagtgcaccacggaggaaaaattccctttgtacctttcttttgaagagtgttgtacttttgcggcatgagcaaacctgcagattctttagtagtttctttaccttaaaagataagcaaaagaaaaccactttggacctgacctctttttgttactgtcaaatcttgtttaaatgagttctgttatctttccatggcagcagcccagtggattatctgaaatgtctcgtttggtttatgttgaaatgatggtatatgaactgccaatattcatcattaagtggcaacatgccaaacagttatgctggctgtagttgatgctcattctgtttttggagaactgtagttctatgattgaacatgtttcagtagcatgtgcttgtggtctgtacccctgttatgtatggttagttggaaaaattgttgcctaattaagatgtagaccaatagtttgtctttgcagttcatagttcttgaatttaacatgaacaatctctgagttcaaa

SEQ ID NO: 2257 - DNA, 1811 bp, Pennisetum glaucum
gattgtatgatgtgcaggtcatatctccccggaactactttgcgtttacgccactgctcccgagtgtcacttctggaacagttgagccaaggagcatcgtagagccaatccgaagggttttggagaagaaaggtggagaaatcaaattttgggaagcagagtgcttcaagattgatccacaaaacaagaaaatccattgtcgctcgaacctcgggacaaatctggatgggaatggggagttcttggttgactatgactatcttgtggtagcagtcggagctagggtaaatacattcaacacacctggtgtggtcgagaattgccacttcttgaaggaagttgaagatgctcaaaagatccgacggagtgtgatgaactgctttgagagggcaagcctcccctacctggatgaagaagagaggaagaagaatcttcattttgttgttgtgggtggtggacctactggagtggaatttgcagcatctttgcatgattttgttaccgaagatttatccaagctttatccctcaattcagcaccttgtcaagatatcattgatagaagctgcagatcacatactgaccatgtttgacaagaggataacaaactttgctgaggacaagtttggaagggatggcattgatgtgaaaactggatacaaagttgtcaaggtttctaaggatgctattaccatgcaaaatcctggcactggggacatctcagttccttatgggatggctgtctggtccactggtattggaactcgtccattcattgtggacttcatgaaacaaattggccagggcaataggcgagtcttagccactgatgaatggctaagggtccttgaatgtgatggtgtctatgcaattggtgattgtgctacaataaaccagaggagagtaatggaagatatttcagaaatattcagagttgcagataaagataagtctggaaccttgactgtgaaagagattcaagatgtgttggatgatatttacgtgagatacccacaagtgcagctctaccttaagagcaagcaaatgaatggcattgccgatttagtaaggagtgccaaaggtgatgctgagaaggaatctgtggagctgaatatcgaagagttcaagaaggctctttcactggtggattcccaagtcaaattcttacctgcaactgctcaggtggcttcacagcaagggcaatatcttgctaggtgtttcaacaagatgaaggatgctgaagaaaaccctgaaggccccattcgcatcagggcggaaggccgccatcggttccgccccttcaggtaccggcatctgggccaattcgcccctctaggaggtgagcaaactgccgcacagcttcctggagactggatctccattggccatagcagtcagtggctctggtactccgtgtatgcgaccaaacaaatcagctggcgcacgaggatgctggtggtatctgattggacgcgtcggttcatcttcggaagagactcaagctgcatataattaagaaggaaactaaagtttttgctgtgacatattcagatgatcagggccagcagagccttctcccactatgagttttggttcacataaaagttcctttttttgttaagggaagaatgaaagttcccttgcacttgtataatgcaccacgaaatttctttgcgctacacttttcggagagagttgtacttcactttcgcggcctgagcaagctcagattcttctaattagctttttgtaccactaagatagtaagatatgatgtacaaggggtcagttcagccctgattttgttctgtg

SEQ ID NO: 2258 - DNA, 1298 bp, Zea mays
gcatgcaacagataatcagcgctagctatcccctcatcgtcttctcttatcctcactcgcgtagtcgcctccctcctcttctcttccgcggcctggtgcaagaccaagagggaggaggaggccacgatggccggcagcgtcagcaacggcagcgggaagagcctggcgcgctggctgcgggagaacgggttcgacgacgacgccgtggcgcgcatgtccaggcggtgcaggaacctgcacagcctcgacgccggcgaggccccgggcgtgtgggactacctcctgaccggcgtcaagatggagcggcggaagctgcggcacgtggtggccaagtgccccaagctgctcaccctgtccgtggacggcaagctcgcgcccacggtgcagtgcctcgccacgctgcaggccaggcccggggaggtggcgcaggccatcgccaagttcccccagatactgttccacagcgtcgaggagaagctctgcccgctcctcgccttcttccagacgctcggcgtctccgagaggcagctcgccaagctgctcatggtcaacccgcgcctcatcagctacagcatcgaggccaagttctcgcagaccgtcggcttcctcgccggcctcggcgtcgacagggaaggcatgatcggcaagatcctcaccaaggagccgtatatcatggggtacagcgtcgacaagcggttgcgccccactgccgagttcctcaagtcggaagtcgggttacaggggccagatctccagagggtggtcatgaccttccccgatatactgtcgcgagacgtggataagatcctgcggcccaatctggcgttcctacagagccgcggattcagcagggatcaggtcacggcactggtagctggttaccctcctgttctcatcaagagcatcaaacattgcctggagccaaggatcaagttcctggtcgaagagatggggcgggacatgggcgaggtggtagattacccccagttctttcgccatggcctcaagaggagcctggagtaccgccacaaggtgcttaagcagatgaactcgagctgcagcctcagcgagatgctagactgtaaccacaagaagtttgccatgaaattcggtttggtcgcagcagtttaggtactcaacttttctctagtccaatccaaggtagtttgttttattctcaggtgaatctttccgtttgtaccgtcaggttgtgttgttcttttgaacatttgggcaatgataactaataattcaaggtcctttacaagtatcaactggtatctttgacaccctaagta

SEQ ID NO: 2259 - DNA, 1272 bp, Zea mays
gcatgcaacagataatcagcgctagctatcccctcatcgtcttctcttatcctcactcgcgtagtcgcctccctcctcttctcttccgcggcctggtgcaagaccaagagggaggaggaggccacgatggccggcagcgtcagcaacggcagcgggaagagcctggcgcgctggctgcgggagaacgggttcgacgacgacgccgtggcgcgcatgtccaggcggtgcaggaacctgcacagcctcgacgccggcgaggccccgggcgtgtgggactacctcctgaccggcgtcaagatggagcggcggaagctgcggcacgtggtggccaagtgccccaagctgctcaccctgtccgtggacggcaagctcgcgcccacggtgcagtgcctcgccacgctgcaggccaggcccggggaggtggcgcaggccatcgccaagttcccccagatactgttccacagcgtcgaggagaagctctgcccgctcctcgccttcttccagacgctcggcgtctccgagaggcagctcgccaagctgctcatggtcaacccgcgcctcatcagctacagcatcgaggccaagttctcgcagaccgtcggcttcctcgccggcctcggcgtcgacagggaaggcatgatcggcaagatcctcaccaaggagccgtatatcatggggtacagcgtcgacaagcggttgcgccccactgccgagttcctcaagtcggaagtcgggttacaggggccagatctccagagggtggtcatgaccttccccgatatactgtcgcgagacgtggataagatcctgcggcccaatctggcgttcctacagagccgcggattcagcagggatcaggtcacggcactggtagctggttaccctcctgttctcatcaagagcatcaaacattgcctggagccaaggatcaagttcctggtcgaagagatggggcgggacatgggcgaggtggtaggttacccccagttctttcgccatggcctcaagaggagcctggagtaccgccacaaggtgcttaagcagatgaactcgagctgcagcctcagcgagatgctagactgtaaccacaagaagtttgccatgaaattcggtttggtcgcagcagtttaggtactcaacttttctctagtccaatccaaggtagtttgttttattctcaggtgaatctttccgtttgtaccgtcaggttgtgttgttcttttgaacatttgggcaatgataactaataattcaaggtcctttacaagtatc

SEQ ID NO: 2260 - DNA, 3651 bp, Sorghum bicolor
atgccgacgccggtgcccgccgcgcgccagtgcctcgccccgcccgccgtcacggcgctcgacgccgccgtcgcctccgcgcgccgccgggcgcacgcgcagaccacctccctccacctcatcgcctcgctgctcgcgcccaccgccgccccgctgctccgcgacgcgctcgcccgcgcccgtagcgctgcctactcgccgcgcctccagctcaaggcgctcgacctctgcttcgccgtctccctcgaccgcctcccctccaccccaacctcctcctccgcctccagcagcaatgaccagcacgagccccccgtcgccaactccctcatggccgccatcaagcgctcccaggccaaccagcgccggaacccggacacgttccacttctaccaccaccaccaccaggcggcggcgtcaccaacgccgtcaagccgcgtcttcgccgacgccggcttccgcagcaacgagatcaaggtcgccatcctccgccccgcgccgcccgtcccgctgctggcccgcgccggcctccccacgcgcgcccgcccgccgccgctcttcctctgcagcttcgcggccgcggacgacgccgacgtcccctcgcccgccggagccgcgccgggggaagacaactgccgccgcatcgccgacatcctcgcccgcggacgcaaccccatgctcgtcggcgtcggggccgcgtccgccgctgcagacttcgccaacgcgtcaccgtaccgcatcctccccgtcggccctgcctccgtcaatcaaaatcaaacggacctcctcgccgtcgcgacgcccggttctgggatcatcttcagcatcggtgacctcaaggacctggtgcccgacgaggccgacctgcaggacgcggctcgcagggtggtggcggaggtcacgcgcctgctcgagacgcacagagcggccggccgccacacggtctgggtcatgggctggtcggccacctacgagacctacctcgccttcctttccaagttcccgctcgtcgacaaggactgggaactccagctgctgccaatcaccgccgtgcgcgacgcccggccctgcagccggactcgtgcctcctccagctccagcaaaccacggttgctgccttgtccaatgcctgccactacaagcttcatggagtcgtttgttccttttggaggttttctgtgcgatccctatgaagcaaattcctgccctcaggccctgcgatgtcaacagtgcaacgatagatatgagcaagaagttgcaactatcattagaggaagtggcattacagctgaagctcaccaagatggtctaccatccatgctgcagaatggcagcatgatgggtcctaacaatgggtttgatgtgctcaaggttagagatgatcagatggtattgagtacgaaaatacagaatctgaagaagaagtggaatgagtactgcctacgactccatcaaggttgcaataggatcaacagagatccatgccagttatttcgacatcacatcgatgttcgacaaataaatgcagaccttgtattgaaccttcaagtcaggcaatcaaagagtgatgaaccccttcaagatagggctgtgccatcccaacatagcaactcatcacattgcgacaaccctgaagatcatgcggcaccatcatctgctgcacctgtggccactgacttggagttggccacccctcgtggatcttcttccaaggattcaagtattgcactgtgtaaacatgtaaaggatgctgaagggtcgatccagctgatgcccaagaaggttgatgatctgaatcttaagcctcacttctctgtacagccttacacttgcttcaggagttccttaaatcgggatcaaacttcacctagtgctctgcattcagcagcttcagggggtgcttctgcctttggccaatggcagaggccttcacccctcccagcacaaagttatgatttgagcaattacaagctactcatggaacgtctgtttaaggctgttgggaggcaggaggaagccttgagtgctatttgtgcatccattgagcggtgtaggtcaatggagaggcgtcgtggtgcaaacaagaagaacgacatatggtttagtttttatggcccggatagcattgccaagcggagagttggtgaggcacttgctgagctgatgcacggtggctcagagaacctgatatatctggacctaagcctccatgactggggtaaccccaatttcagaggaaagcgtgccacagactgtatagctgaagagttgagaaagaagcgtcattcagttatcttccttgacaatattgacagggctgactgccttgttcaggagagcctgattcatgccatggagactggcaggtacaaagatttgcatgggggacgggtggctgaccttaataactcgattgtggtgttgtctacaagaatgatccaaggatgtcaggacgcctctcttgggatggaagaggacaatgctttttcagaagaaaaggttgtggcagctcgtggacatcaactgaagatcatagttgagccaggcacagccaacatcggtgaagaccctggaggcaaagttgtagtttcctcaaggcattccttgagaaacagtcaagcatctttgttctctagttctttgagtaagcggaagctccacatctctgatgggcaagaaaagacagcagaatcaccgagcacttcaaagcgactgcatagaagatcaagcgttccattcgacttgaacctcccaggtgatgaggctgaagcccatgatggtgatgatgacagcagtagcagccatgagaactcgtccggtgatccagagggatctgtgggcaacctcttacgttcagtggatgagtcaatcaatttcaaaccatttgactttggcaaactttgtgaggacatcctgcaggagtttagcagtacaatgagcaagactctaggctccaggtgcaggctggagatcgacgctgtggctatggagcaagtagtggcagcggcatgggcatccgattcacatgagaagaggcctgtgcggacgtgggtggagcaggtgtttgccaggacccttgagcagctgaaggtcaggtgtaagaatttgagtagctctactctgagattggttgcctgtgaggatgaaatgccggtaaaagaagatgcttttggagctttccttccctcgacaataattctggattggtgatggtgatatgtgtctgtatagggtttgcattattgctagctgtaagtattgttagcatatagtactggttggccaccccacccacccatagtccatagtagcatatagtagtgtactagtatagcatcatatcattatttggtcgctaaaaaataatgtaattaagctgtatgtacgtacgtagtctagcaagctactcgttgaagtcgatgactcggggcttggcaaattaggcagggtctgtcatcagatcatgaggttctgaccccttagctacttcaaagcatcacaagctgtattgtgatcatggttcgtccctctgattgatggttctgaataaattgtattgttgctcggacgtgtgtatatttgttaatgtatttgcaaggccatgatggcctttctttgtggaattccatatcctgatgcaattcaaactggccg

SEQ ID NO: 2261 - DNA, 3799 bp, Zea mays
caccctctggcttgccgttaatttctttcccgtttcactcctcgcgtttttacacttggcccccaatccaatccccgccaggccgccatgccgacgccggtgcccgccgcgcgccagtgcctctccccgcccgccgtcacggccctcgacgccgccgtcgcctccgcgcgccgacgggcccacgcgcagaccacctcccttcacctcatcgcctcgctcctcgcccccaccgccgcgccgctgctccgcgacgcgctcgcccgcgcccgcagcgccgcctactccccgcgcctccagctcaaggcgctcgacctctgcttcgccgtctccctcgaccgcctcccgtccacccccacctccgcctccacccccacctcacacgagccccccgtcgccaactccctcatggccgccatcaagcgctcgcaggccaaccagcgccggaacccggacacgttccacttctatcaccatcaggcggcgcccacctcccccaacgccatcaaggtcgacctctcccaccttgtcctcgccatcctcgacgacccgctcgtcagccgcgtcttcgccgacgcgggattccgcagcaacgagatcaaggtcgccatcctccgccccgcgccgcccgtcccgctgctcggccgcctccccacgcgcgcgcgcccgccgccgctcttcctctgcagctttgccgccgcggacgacgccgacgtcccctcgcccgcgcccgccctcgcgggggccgcaccgggggaggacaactgccgccgcatcaccgacatcctcgcccgcggacgcaaccccatgctcgtcggcgtcggggccgcctccgcagccgcagatttcgccaaggcgtccccgtaccgcatcgtccccatcggccccgcctctgccaataatcaggcggcaccgacgacgcccacctctggccttatcttcagcatcggtgatctcaaggacctggtgcccgacgaggccgacctgcaggacgcggctcgccgggtggtggcggaggtcacgcgcctgctcgagacgcacagacctgctgcccgccaaacccaaacggtctgggtcatgggctggtccgccacctacgagacctacctcgccttcctttccaagttcccactcgtcgacaaggactgggaactccagctgctgccgatcaccgccgtgcgcgacgccggccctgcagcgggactcgtgcctcctcctccagctccagccaccacggtcgctgccttgtccatgcctgccactacaagcttcgcggagtcatttgttccttttggaggtcttttgtgcgatacctatgaagcaaatagtctcacaacaaatttctgccctcaggctctacgatgtcaacattgcaacgatagatatgagcaagaagttgcctctatcattagaggaagtggcgttacagctgatgctcaccaagaaggtctaccttctctgttgcagaatggcggcatgatgggttctaacaatgagtttgatgcagtcaaggttagagatgatcaaatggtattgagtacaaaaatattgaatctagagaagaagtggaatgagtactgtgtacgtctccatcaaggttgcaatagaatcaacagagatccttgccagttatttccacatcacattggtgttcgagttgacagggaaagatgtgcaaatccaaaccaaagcgcacagacaattgcacttcagagggatattattaaaccttgtgcattgtcttctccatacaccaatataactgcaaagagtatttcagcaccagaccaaataaatgcagaccttgtactaaaccttcaagtgaggcagtcgaggagtaatgaaccccttcaaagtggggttgtgccattccaacatatcaactcatcaaattataacaaacccgaagaatcatctgctgcacctgtgacaactgatttagtgttggccacccctcgtggatcttccttcaaggattcaagtagtgccctgtgtaaacgtgtagaggacattgaagagacaatccagctgatgcctaacaaggttgacgatctgaatcttaaacctcctcacttgtctatacaaccttacacttgctccaagagttcctcatcaaattgggagcaaacatcacctagtgctctgcattcaacatctttaggaggcacttctgcctttggccaatggcagaggccttcaccgctcgcaacacaaagttttgatttgagcaattacaagctacttatggaacacctgtttaaggttgttgggaggcaggaggaagcattgagtgctatttgtgcatccattgtgcggtgcaggtcgatggagaggcgtcgtggtgcaaacaaaaagaacgacatatggtttagtttttatggccctgacagcattgccaagcggagagttggtgtggcacttgctgagctaatgcatggtagctcagggaacttgatatatctggacctaagcctcaatgattggggtaaccctagtttcagaggaaagcgtgccaccgactgtatctttgaagagctgagaaagaagcggcgatcggttatcttccttgacaatattgacaaagccgattgccttgttcaggagagcctgattcatgcaatggagactggtaggtacaaggacttgcatgggggacgagtgactgatcttaatgactcgattgtggtgttgtctacaagaatgatccaaggatgccaggatgcttctcttggggtggaagagggcaatgctttttcagaagaaaaggctgtggcagctcgtgggcatcaactgaagatcatagttgagccgggcacaaccaacatcggtggaggcaacgttgtagtttcgtcaaggcattccttgggaagcagtgaagcctcaagttattccagtaagcggaagctccacatctctgatgggcaagaaaagacagaagaatcggcaagcacttcaaagcgactgcatagaacatcaagcatcccattcgacttgaacctcccaggcgacgatgaggaagcccatgatgatggtgatgatgacaagagcagtggcagccacgaaaactatctagagggatctgtcggaaacctcttgcgttgggtggatggttcaatcaatttcaagccatttgactttggcaagctttgtgaggacatcctgcaggagttcagcaatactaccagcaaaattctgggcaccagggggtgcaggctggagatcgacgctggggctatggagcaggtagtggcagcggcatgggcatccgattcgcatgagaatgagaagaggcctgtgcggacgtgggtggagcaggtgtttggcaggagccttgagcaggtcaagatgaggtgtgagaatctgagcagctgtaccctgagactggtttcctgtgaggtgaaagaagatggttttggagctttgcttccctcgagaataattctggattggtgatggtgatatgtgtcgtttgcattattgctgctagctatctagctgtaagtattggttagttagctgacaccacccaccgtactgtagcatatataggttcatatcattatttggtggcttcaaaataatgtaattaagctggagtatgtacgtacggtagtctagcaattaaactactcgttcaagtccatgacctggggatggatggctgtatttattgttgctcctgcgtgtatatatatatttgtaagaccgacgtgatggccttttcatgtggaattccatatactgatgtcatttaactgtctgtgcaagacaattgcataattcacaagtatggaaagcaaaa

SEQ ID NO: 2262 - DNA, 3753 bp, Zea mays
atgccgacgccggtgcccgccgcgcgccagtgcctctccccgcccgccgtcacggccctcgacgccgccgtcgcctccgcgcgccgacgggcccacgcgcagaccacctcccttcacctcatcgcctcgctcctcgcccccaccgccgcgccgctgctccgcgacgcgctcgcccgcgcccgcagcgccgcctactccccgcgcctccagctcaaggcgctcgacctctgcttcgccgtctccctcgaccgcctcccgtccacccccacctccgcctccacccccacctcagtctccgcctccgcctccgccagcaccagcaatgacccccagcagcacgagccccccgtcgccaactccctcatggccgccatcaagcgctcgcaggccaaccagcgccggaacccggacacgttccacttctatcaccatcaggcggcgcccacctcccccaacgccatcaaggtcgacctctcccaccttgtcctcgccatcctcgacgacccgctcgtcagccgcgtcttcgccgacgcgggattccgcagcaacgagatcaaggtcgccatcctccgccccgcgccgcccgtcccgctgctcggccgcctccccacgcgcgcgcgcccgccgccgctcttcctctgcagctttgccgccgcggacgacgccgacgtcccctcgcccgcgcccgccctcgcgggggccgcaccgggggaggacaactgccgccgcatcaccgacatcctcgcccgcggacgcaaccccatgctcgtcggcgtcggggccgcctccgcagccgcagatttcgccaaggcgtccccgtaccgcatcgtccccatcggccccgcctctgccaataatcaggcggcaccgacgacgcccacctctggccttatcttcagcatcggtgatctcaaggacctggtgcccgacgaggccgacctgcaggacgcggctcgccgggtggtggcggaggtcacgcgcctgctcgagacgcacagacctgctgcccgccaaacccaaacggtctgggtcatgggctggtccgccacctacgagacctacctcgccttcctttccaagttcccactcgtcgacaaggactgggaactccagctgctgccgatcaccgccgtgcgcgacgccggccctgcagcgggactcgtgcctcctcctccagctccagccaccacggtcgctgccttgtccatgcctgccactacaagcttcgcggagtcatttgttccttttggaggtcttttgtgcgatacctatgaagcaaatagtctcacaacaaatttctgccctcaggctctacgatgtcaacattgcaacgatagatatgagcaagaagttgcctctatcattagaggaagtggcgttacagctgatgctcaccaagaaggtctaccttctctgttgcagaatggcggcatgatgggttctaacaatgagtttgatgcagtcaaggttagagatgatcaaatggtattgagtacaaaaatattgaatctagagaagaagtggaatgagtactgtgtacgtctccatcaaggttgcaatagaatcaacagagatccttgccagttatttccacatcacattggtgttcgagttgacagggaaagatgtgcaaatccaaaccaaagcgcacagacaattgcacttcagagggatattattaaaccttgtgcattgtcttctccatacaccaatataactgcaaagagtatttcagcaccagaccaaataaatgcagaccttgtactaaaccttcaagtgaggcagtcgaggagtaatgaaccccttcaaagtggggttgtgccattccaacatatcaactcatcaaattataacaaacccgaagaatcatctgctgcacctgtgacaactgatttagtgttggccacccctcgtggatcttccttcaaggattcaagtagtgccctgtgtaaacgtgtagaggacattgaagagacaatccagctgatgcctaacaaggttgacgatctgaatcttaaacctcctcacttgtctatacaaccttacacttgctccaagagttcctcatcaaattgggagcaaacatcacctagtgctctgcattcaacatctttaggaggcacttctgcctttggccaatggcagaggccttcaccgctcgcaacacaaagttttgatttgagcaattacaagctacttatggaacacctgtttaaggttgttgggaggcaggaggaagcattgagtgctatttgtgcatccattgtgcggtgcaggtcgatggagaggcgtcgtggtgcaaacaaaaagaacgacatatggtttagtttttatggccctgacagcattgccaagcggagagttggtgtggcacttgctgagctaatgcatggtagctcagggaacttgatatatctggacctaagcctcaatgattggggtaaccctagtttcagaggaaagcgtgccaccgactgtatctttgaagagctgagaaagaagcggcgatcggttatcttccttgacaatattgacaaagccgattgccttgttcaggagagcctgattcatgcaatggagactggtaggtacaaggacttgcatgggggacgagtgactgatcttaatgactcgattgtggtgttgtctacaagaatgatccaaggatgccaggatgcttctcttggggtggaagagggcaatgctttttcagaagaaaaggctgtggcagctcgtgggcatcaactgaagatcatagttgagccgggcacaaccaacatcggtggaggcaacgttgtagtttcgtcaaggcattccttgggaagcagtgaagcctcaagttattccagtaagcggaagctccacatctctgatgggcaagaaaagacagaagaatcggcaagcacttcaaagcgactgcatagaacatcaagcatcccattcgacttgaacctcccaggcgacgatgaggaagcccatgatgatggtgatgatgacaagagcagtggcagccacgaaaactatctagagggatctgtcggaaacctcttgcgttgggtggatggttcaatcaatttcaagccatttgactttggcaagctttgtgaggacatcctgcaggagttcagcaatactaccagcaaaattctgggcaccagggggtgcaggctggagatcgacgctggggctatggagcaggtagtggcagcggcatgggcatccgattcgcatgagaatgagaagaggcctgtgcggacgtgggtggagcaggtgtttggcaggagccttgagcaggtcaagatgaggtgtgagaatctgagcagctgtaccctgagactggtttcctgtgaggtgaaagaagatggttttggagctttgcttccttcgagaataattctggattggtgatggtgatatgtgtcgtttgcattattgctgctagctatctagctgtaagtattggttagttagctgacaccacccaccgtactgtagcatatataggttcatatcattatttggtggcttcaaaataatgtaattaagctggagtatgtacgtacggtagtctagcaattaaactactcgttcaagtccatgacctggggagggatggctgtatttattgttgctcctgcgtgtatatatatatttgtaagaccgacgtgatggccttttcatgtggaattccatatactgatgtcatttaactgtctgtgcaagacaattgcataattcataagtatggaaagc

SEQ ID NO: 2263 - DNA, 2201 bp, Zea mays
agcagaatttagttatggcccatggctcattaaccactgggccaccggccaaccgcccaccagcataccggctccagtgatcgacgccgggtcgccggcgaaggaagaacagtcaggacgaggaaagaaaaaacaacagaaacgaggaagaaaaacggaaaaaatagagcggcggggcgagatctacgacgcggccgcgggaaggagaggactgcctctacgcaatcccgctatcctggcgacatccacgactccgatatccggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgaggagggccaagagttattaacactgccacctgcatcggcttcaggcagactttctgttcagacttcttcagtagagccttccggtaccaattcatcccttggtcagtcagattgtggtggaaacccctctcaagaaaacgctggacagatggtgccttcgcatgtttttcagaatggagcttcactgttccaaggccttgttgaacgtgctcggaaaacggtccgtggttcagcagatgatattggctggctccagcgagatcaaagcttacctacaactgaggatgggacagccagattcttagagattttggattctgtgagaaaaaatgaacacaagctatctgattcattggtttacttgttggttccaggtctgtttagtaaccacggacctctttactttgtcaaaacaaaggcatatttctccaagatgggtctggcttgccatattgccaaaattcatagtgagtcttcagtgagtaaaaatgcacgagagataaaggaatacatagaagaaatatactggggatcaaggaaacgtgtgctcctccttggtcacagcaagggtggtgttgatgcggctgcagccctctccctctactggccacaactcaaagacaaagtcgcaggtttagcattagcccaaagtccatatggaggaagccccgttgcttcagatatcctgcgagaggggcagcttggtgactatgtcaggctgcgtaagatcatggagatcttggtatccaaggtccttaagggtgatctgcaggctctagaagatctgacttatgaaaggcggaaagaattcctgcgacggcacccgctacctcaggatgttcctatcgtttcgttccacacggaggcaagcatcactcccagcgtgctcacagcgctctctcacgttgcacacctggagctcccgattgctggcgatggcaattccactaggatcccagttgtgatgccactttcagccgcgatggcagcatgctcgcagttgctggtggcgaggtatggcgagaagagtgacggtctcgtgacgaggaaagatgctgaggttcctggttcagtggcggtccggccggagcggaagctagaccacgcgtggatggtgtattcgtcgctgaaagaagagtctggggatcaggcggacacgtcgcaggtatgcgaagccctgctgactctacttgtcgaggttgcacagaagaggaggcatgagatggcaatgaaagacgagtgaaagtagcttttggtgttggctggcgatagtgggatgtatcctcctgtaatcgtagactggcctgttgctggctgtacagagttgtgctgctcaaagtgctttgggacctgtttttgtttggttgacagaaacttgtgttgtatagcatgtgaagttcagaggtggatggagaaggttctactgtgttgtgtttggttggatgtacaaaaattgatataaaggggtggccacattttctataatgtttggatgagggtcacacgggatgaggtgaacactggagcaattttttatggcggtgtggtctaaaaaaaccgagtggatggtgccggcctcgcctctctcgtgctctcgaaaactgggatggccgcccccgcctctctcgagtagtgacagctaaccatcatacaaacaaaaactagaatggtttcatccaagtttatcccttctactaaataaaaaaaa

SEQ ID NO: 2264 - DNA, 1976 bp, Zea mays
agcagaatttagttatggcccatggctcattaaccactgggccaccggccaaccgcccaccagcataccggctccagtgatcgacgccgggtcgccggcgaaggaagaacagtcaggacgaggaaagaaaaaacaacagaaacgaggaagaaaaacggaaaaaatagagcggcggggcgagatctacgacgcggccgcgggaaggagaggactgcctctacgcaatcccgctatcctggcgacatccacgactccgatatccggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgaggagggccaagagttattaacactgccacctgcatcggcttcaggcagactttctgttcagacttcttcagtagagccttccggtaccaattcatcccttggtcagtcagattgtggtggaaacccctctcaagaaaacgctggacagatggtgccttcgcatgtttttcagaatggagcttcactgttccaaggccttgttgaacgtgctcggaaaacggtccgtggttcagcagatgatattggctggctccagcgagatcaaagcttacctacaactgaggatgggacagccagattcttagagattttggattctgtgagaaaaaatgaacacaagctatctgattcattggtttacttgttggttccaggtctgtttagtaaccacggacctctttactttgtcaaaacaaaggcatatttctccaagatgggtctggcttgccatattgccaaaattcatagtgagtcttcagtgagtaaaaatgcacgagagataaaggaatacatagaagaaatatactggggatcaaggaaacgtgtgctcctccttggtcacagcaagggtggtgttgatgcggctgcagccctctccctctactggccacaactcaaagacaaagtcgcaggtttagcattagcccaaagtccatatggaggaagccccgttgcttcagatatcctgcgagaggggcagcttggtgactatgtcaggctgcgtaagatcatggagatcttggtatccaaggtccttaagggtgatctgcaggctctagaagatctgacttatgaaaggcggaaagaattcctgcgacggcacccgctacctcaggatgttcctatcgtttcgttccacacggaggcaagcatcactcccagcgtgctcacagcgctctctcacgttgcacacctggagctcccgattgctggcgatggcaattccactaggatcccagttgtgatgccactttcagccgcgatggcagcatgctcgcagttgctggtggcgaggtatggcgagaagagtgacggtctcgtgacgaggaaagatgctgaggttcctggttcagtggcggtccggccggagcggaagctagaccacgcgtggatggtgtattcgtcgctgaaagaagagtctggggatcaggcggacacgtcgcaggtatgcgaagccctgctgactctacttgtcgaggttgcacagaagaggaggcatgagatggcaatgaaagacgagtgaaagtagcttttggtgttggctggcgatagtgggatgtatcctcctgtaatcgtagactggcctgttgctggctgtacagagttgtgctgctcaaagtgctttgggacctgtttttgtttggttgacagaaacttgtgttgtatagcatgtgaagttcagaggtggatggagaaggttctactgtgttgtgtttggttggatgtacaaaaattgatataaaggggtggccacattttctat

SEQ ID NO: 2265 - DNA, 2201 bp, Zea mays
agcagaatttagttatggcccatggctcattaaccactgggccaccggccaaccgcccaccagcataccggctccagtgatcgacgccgggtcgccggcgaaggaagaacagtcaggacgaggaaagaaaaaacaacagaaacgaggaagaaaaacggaaaaaatagagcggcggggcgagatctacgacgcggccgcgggaaggagaggactgcctctacgcaatcccgctatcctggcgacatccacgactccgatatccggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgaggagggccaagagttattaacactgccacctgcatcggcttcaggcagactttctgttcagacttcttcagtagagccttccggtaccaattcatcccttggtcagtcagattgtggtggaaacccctctcaagaaaacgctggacagatggtgccttcgcatgtttttcagaatggagcttcactgttccaaggccttgttgaacgtgctcggaaaacggtccgtggttcagcagatgatattggctggctccagcgagatcaaagcttacctacaactgaggatgggacagccagattcttagagattttggattctgtgagaaaaaatgaacacaagctatctgattcattggtttacttgttggttccaggtctgtttagtaaccacggacctctttactttgtcaaaacaaaggcatatttctccaagatgggtctggcttgccatattgccaaaattcatagtgagtcttcagtgagtaaaaatgcacgagagataaaggaatacatagaagaaatatactggggatcaaggaaacgtgtgctcctccttggtcacagcaagggtggtgttgatgcggctgcagccctctccctctactggccacaactcaaagacaaagtcgcaggtttagcattagcccaaagtccatatggaggaagccccgttgcttcagatatcctgcgagaggggcagcttggtgactatgtcaggctgcgtaagatcatggagatcttggtatccaaggtccttaagggtgatctgcaggctctagaagatctgacttatgaaaggcggaaagaattcctgcgacggcacccgctacctcaggatgttcctatcgtttcgttccacacggaggcaagcatcactcccagcgtgctcacagcgctctctcacgttgcacacctggagctcccgattgctggcgatggcaattccactaggatcccagttgtgatgccactttcagccgcgatggcagcatgctcgcagttgctggtggcgaggtatggcgagaagagtgacggtctcgtgacgaggaaagatgctgaggttcctggttcagtggcggtccggccggagcggaagctagactacgcgtggatggtgtattcgtcgctgaaagaagagtctggggatcaggcggacacgtcgcaggtatgcgaagccctgctgactctacttgtcgaggttgcacagaagaggaggcatgagatggcaatgaaagacgagtgaaagtagcttttggtgttggctggcgatagtgggatgtatcctcctgtaatcgtagactggcctgttgctggctgtacagagttgtgctgctcaaagtgctttgggacctgtttttgtttggttgacagaaacttgtgttgtatagcatgtgaagttcagaggtggatggagaaggttctactgtgttgtgtttggttggatgtacaaaaattgatataaaggggtggccacattttctataatgtttggatgagggtcacacgggatgaggtgaacactggagcaattttttatggcggtgtggtctaaaaaaaccgagtggatggtgccggcctcgcctctctcgtgctctcgaaaactgggatggccgcccccgcctctctcgagtagtgacagctaaccatcatacaaacaaaaactagaatggtttcatccaagtttatcccttctactaaataaaaaaaa

SEQ ID NO: 2266 - DNA, 1722 bp, Pennisetum glaucum
gctccactcattatgcaacttcactgcttggttgcgcactgaaatatcctgaccgatgggagcatcatggctaacaggtttctcttctcttgatataaccacaaccgaaaaatgaaggatcccctgccttcaacacagggggagccatctacatctgctacggttgatgatagttgctcagatgacagggttggagattcacaattgttcctctctgtacccgctttaaatcaagctgcatcttatcttgcccagacagcttcatttctcacacagtgcctccctgtacctagttacgtgggtctacctgaggagggccaagagttagtaacactgccatctgcatcagcagtagacaggctttctgttcagacttcttccgtagagtcagctggcaccaattcatcccttggtcaggcagattgcagtggaagcccctctcaagaaagcacaggtcaaatggtgccttcacaagtttttcagaatggagcctcactgtttcaaggccttgtagaacgtgctcggaaaactgtccgtggttcagcagatgatatcggctggctccaaagggatcaaagcttacctacaactgaggatgggacaggcagattcttggagattttggactctgtgagaaaaaatgagcacaagctacctgattcagttgtctacttgttggttccaggtctgtttagtaatcatggaccgctttactttgtcaagacaaaggcacacttctccaagatgggtctagcttgccatattgccaaaattcatagtgagtcttcagtaagtaaaaatgcgcgagagataaaggaatacatagaagaaatatactggggatcaaggaaacgagtgctacttcttggtcatagtaagggtggtgtagattcggctgcagccctctccctctactgggcacagctgaaagacaaagttgctggtttggtattagctcaaagtccatatggaggaagcccagttgcttcagatatcctgcgagaggggcagcttggtgactatgtcaggttgcgtaaaatcatggaggtcttggtatccaaagtcctcaagggtgatgtgcaggctctagaagatttgacctatgaaaggaggaaagaatttctgcgacagcatccattgccacaggagattccagtcgtatcattccacacagaggcaagcatcactcctagtgtgctcaccacactttctcacgttgcgcacttggagctcccgattgctgcggctggcaattccaccaggataccggttgtaatgccactttcagctgcaatggcagcatgctctcagcttctcgtggtacggtatggtgagaaaagtgatggtcttgtgacgaggaaggatgctgaggttcctggatcggtggtggtcaggccagagcggaagctagaccatgcttggatggtgtattcctcactgagagaagagcctggggatcaggcggacacgtcgcaggtatgcgaagccctgctgactctgcttgtagaggttgcacagaaaaggaggcatgagatggccatgaaagatgagtgaaactacttgttagtgttgccctgagatgatatatgtatcttgctaccgtagactttagttatagtgttgcctgtacagagttgtgttcaaatcataacatatgcccaaagtgcttctgggcctgtttttcattggttcacagaagcttaattgtgttccgaacctcgc

SEQ ID NO: 2267 - DNA, 1730 bp, Pennisetum glaucum
ggctccactcattatgcaacttcactgcttggttgcgcactgaaatatcctgaccgatgggagcatcatggctaacaggtttctcttctcttgatataaccacaaccgaaaaatgaaggatcccctgccttcaacacagggggagccatctacatctgctacggttgatgatagttgctcagatgacagggttggagattcacaattgttcctctctgtacccgctttaaatcaagctgcatcttatcttgcccagacagcttcatttctcacacagtgcctccctgtacctagttacgtgggtctacctgaggagggccaagagttagtaacactgccatctgcatcagcagtagacaggctttctgttcagacttcttccgtagagtcagctggcaccaattcatcccttggtcaggcagattgcagtggaagcccctctcaagaaagcacaggtcaaatggtgccttcacaagtttttcagaatggagcctcactgtttcaaggccttgtagaacgtgctcggaaaactgtccgtggttcagcagatgatatcggctggctccaaagggatcaaagcttacctacaactgaggatgggacaggcagattcttggagattttggactctgtgagaaaaaatgagcacaagctacctgattcagttgtctacttgttggttccaggtctgtttagtaatcatggaccgctttactttgtcaagacaaaggcacacttctccaagattggtctagcttgccatattgccaaaattcatagtgagtcttcagtaagtaaaaatgcgcgagagataaaggaatacatagaagaaatatactggggatcaaggaaacgagtgctacttcttggtcatagtaagggtggtgtagattcggctgcagccctctccctctactgggcacagctgaaagacaaagttgctggtttggtattagctcaaagtccatatggaggaagcccagttgcttcagatatcctgcgagaggggcagcttggtgactatgtcaggttgcgtaaaatcatggaggtcttggtatccaaagtcctcaagggtgatgtgcaggctctagaagatttgacctatgaaaggaggaaagaatttctgcgacagcatccattgccacaggagattccagtcgtatcattccacacagaggcaagcatcactcctagtgtgctcaccacactttctcacgttgcgcacttggagctcccgattgctgcggctggcaattccaccaggataccggttgtaatgccactttcagctgcaatggcagcatgctctcagcttctcgtggtacggtatggtgagaaaagtgatggtcttgtgacgaggaaggatgctgaggttcctggatcggtggtggtcaggccagagcggaagctagaccatgcttggatggtgtattcctcactgagagaagagcctggggatcaggcggacacgtcgcaggtatgcgaagccctgctgactctgcttgtagaggttgcacagaaaaggaggcatgagatggccatgaaagatgagtgaaactacttgttagtgttgccctgagatgatatatgtatcttgctaccgtagactttagttatagtgttgcctgtacagagttgtgttcaaatcataacatatgcccaaagtgcttctgggcctgtttttcattggttcacagaagcttaattgtgttccgaaccttgcaatcaaa

SEQ ID NO: 2268 - DNA, 1770 bp, Setaria italica
actgaacaagaagggaagcgcggcgttgggggacgagagccgagacgcggctgccggaagactgaagactccctccgatccatccatcctagcgtcctggcggcatccaccactctggattccgatttctcttctctggacaaccatatcaaacatgagggaatcgccttcaacacaaggggaaccatctacatctgctatggttgattgctcagctgacagggttgaagattcacaattgttcctctctgtaccctctttaaatcaagctgcatcttatcttgcccagacagcttcatttctcacacagtgcctccctgtacctggttatgtgggtctacctgaggagggccaggagttagtagcactgccactgcatcggtagtagacaggctttctgctcagacttcttccgcagagtctgctggcaccaactcatcccttggtcagacaggttgcagtggaagcccctctccagaaagcacaggtcaaatggtgccctcacatgtttttcagaatggagcttcactgttccaaggccttgtagagcgtgctcggaaaactgttcgtggttcggcagatgatatcggctggctccaaagggatcaaagcttacctacaactgaggatgggacagccagattcttggagattttggactctgtgagaaaaaatgagcacaagctacctgattcagttgtttacttgttggttccaggtttgtttagtaaccacggaccgctttactttgtcaagacaaaggcatacttctccaagatgggtctagcttgtcatattgccaaaattcatagtgagtcttcagtaagtaaaaatgcacgagagataatatactggggatcaaggaaacgagtgctacttcttggtcatagtaagggcggtgtagattcggctgcagccctctccctctactggccacagctgaaagacaaagtcgctggtttggtattagctcaaagcccatatggaggaagcccagttgcttcagatatcctgcgagaggggcagcttggtgactatgtcaggttgcgtaaaatcatggaggtcttggtatccaaagtcctcaagggtgatgtgcaggctctagaagatttgacctatgaaaggaggaaagaattcctgcgacagcatccattgcctcaggaggttccaattgtatcattccacacagcggcaagcatcactcctagcgtgctcaccgcactttctcacgttgcgcacttggagctcccgattgctgccgatggcaattccaccaggataccggttgtaatgccactttcagctgcaatggcagcatgctctcaacttctggtggcaaggtatggcgagaaaagtgatggtcttgtgacaaggaaggatgctgaagttcctggatcagtggtggtcaggccagagcggaagctagaccatgcttggatggtgtattcctcgctgaaagaagagcctggggatcaggcggacacgtcgcaggtatgcgaagccctgctgactcttcttgtagaggttgcacagaaaaggaggcatgaagtggccatgaaagatgagtgaaactacttgttagtgttaccgtagactttatttggtgctgtctgtacagagttgtgtccaaattaacatatgcccaaagtgcttctgggcctgtttttcattggttcacagaagcttattgtgttccgaggcacagcacctcacaatcaaaccacagtgacctttttggctattaattggttgcacattttgagtcggtgg

SEQ ID NO: 2269 - DNA, 4314 bp, Oryza sativa
aaagcacccaactttgttctcgattgttctgacggcgagagaaccaaccaaccctaccttggctttgccggcgggcggcggcgatggcgtccgcgacggaggcggaggctgaggagagggacaaacccatcgtcgtccgtgtcaagcgcaagccctcccagacccgccccgacgctttctggctagagatcaatgagaggccggtgaagaaggctatgctcgatttctccagcctttcagtctccgagccatcctctgctcctaataaagcttcagaggaaccacgaattaagaaacttctggtacagcacattgagacagtacaccattctgaggcagttcaagatgttttgcactctcttctgcattctgacttggatgccaaagagataaagagcaagacaaaggaatggaacaacagaactaatcaagataaaaaacaagaccagctacgatcagcagccagacagaggcatgaggaccttggaagaaatgctcgctttgcacaaatttggaggagtcggaaaggagacaggaatgaagttgatgaatcactacgagaaatatgccatctttatgatgctgtccaagattacctcttttgaagagggtgcaattttatgcaattttcttccacttatacgggaacatttgccatcagctgctgaagaaattgaatcagatattatttcgctggcacaatcggaagattcagatgtttatgacatatatactgtcaaagaggtggatgatgatacaacaatggagggcacatcttcagctccatacccactgttacaagtggacaatggcgatgatgtgtgttatgatgatgacgatccttatgatacagatgattcaaatgcggaggataatccattatatgattatcctgcggagttgtcagaagatgaggatgatgattccaatagcgagaatccattttcagacctagacggttctgatcccgagtatgagaaggaagaggataaagagccaaccatggaggatttaccttcaaatctgggtcagccttctacttctgcatcatctgttgatgctagttattcagccaacaggattgaagattcacagctcttcctctccgtcccagctttaaaccaagctgcgtcttatctggcccagacagcttcatatcttacccagtgcctcccagtatctggttacacagctatttctgacgaagggcaagagctagcgacgctgccacctgcatcaactgctggtggatcctcttttcaggcttcttccgaacagtcagcagactcatctcctggtgaaattgataatactggaagctcatctcaagaaatcacagaacagatggcacctttgcgcgtcttccagaatggggcttcactgtttcaaggtcttgtagaacgtgctcggaaaactgttcgtggctcagccgatgatattggatggcttcagcaggatcaaagcttacctccaactgaggacggaactgccagattcttggaaattcttgatgctgtgagaaaaaatgaacacaagctgcctgattcgatggtctatctgttggttccaggcttgtttagtaaccatgggcctctttactttgtcaagacaaaatcatatttctccaagatgggtctggcttgtcacattgccaagattcacagtgagtcttcagtaagtaaaaatgcaagggaaataaaggaatatatagaagaaatatactggggatcgaagaagcgggtgctacttctcggccatagcaagggtggtgtagatgcagcagcagccctctccctttactggccacaactgaaagacaaggtcgcaggtttggctttagctcaaagcccatatggaggaagcccggttgcttcagatatcttgcgagaaggccagcttggtgattatgtcaggttacgtaaactcatggagattttggtatccaaagtccttaagggtgatcttcaggctctggaagacctgacatatgagaggaggaaagaattcctgcggcagaacccattgcctcctgaggttcccattgtctcattccatacagaggctagcatcaccccaagtgtgcttactgccctctctcatgttgcacacttggagctcccagctgcagctgatgggaatcctactaggatcccagttgtaatgccactttcagctgcaatggcagcatgctcacaacttctggtggcaaggtatggtgagaagagtgatggtcttgtgacaaggaaggatgctgaagttcctggatcagtagtagtccggccagagcggaagttagaccatgcatggatggtttattcttcactcaaagaggaacctagggatcaggcagacacatcacaggtatgtgaagccctgctgactctgcttgttgaggttgcacagaaacggaggcatgagatggctatgaaagatgaataaaaatgttagtgttgctctgacagatatttgtaatcgtagatttctgttgttgaatgttcagagttgtgtggctgtgtccaaacttatgctgaaactgcttctgggccacttttttgtttggtttacagaagctttatatatcaagtgaatctgaaaggtgaaaaaggctacattggaagtgtttctctttttttattattattagttagcataacggaattgcatgatttggtcatatctcacgtctcacggtattcccctcgcaatcaggtgattcgtctactaggtctgaatttgattatggttgttaagtatattaggcatgattcatgagtcatgggtacggaacagcctgggattgcaatctatagaactttatatcctagtttgttgtagattcttcacaataaatcgtcgaactcgtgaaagggcatctactgttgtcatggtgtttcgaatttcataatgctatacacaatggataggttctgcttcatcattctaaccgattgctgctggttgaatgcttcctcctcatctgatcaacctttgacatgtccactgggaatggtccaacaatagtgttcagaacagctcctgctaggccccatgaggaagtctccattctggagcatgtccatggtgtctgttgacaatgggtggtagcaaaggaggttgagaaataagggcagaactatggcccatctggttgcagcagaggagcaaaaaagcttaattgggtaattcactcaaattcaactattcatggtaataaaaatataactgtacatactgttcatgctaccttaggttatatcatgccaagcatgcaactacaaggtgcataatgcaaatgcacattacaagataggcataaattggtcatgttcatgtgcaattgcttcctttatgctatgaagtggcatgtgaaattaaagtgtatggaggaaatgctatattagatctcatctataatgttgtttctgacttctggggcattttcagttccatcacatggctacttcaatttgtctatttaccagtttattatacagccacaggaaaaagaaaaaaaaactttttaattagtcatgtgtgcacttttcttttgctttgaagaaatgctaccttttttttttcttgtggatgacaagtctcatcactgtactctcacaaaacaaaggccagattgttgcagagtttctagtatgctgacagtgtgacacacagatgaacacggttgaggagcaagaaaggagagaagagcagggagtggcacatgcgccaaaaggcatgcggttgttggcctgccaatgctaaggaggagacgtggcctagccagggagctctcatcttcttgatataactagcaataagaaacgttaatggattgtgttgctagatcatgcaaccctacctaaatatttttatcggccaaagaacagatgagtcgttcagaggtcaacatatgcacatccaatttgcactattatatgcatggggaagcaactaaatggttgcactagtgccatgttgattagcccggtgcattcagttcagcgacaaccatactcaaatcagcttttctttttgtcgtgtttttgtttctccatttatttctcgtattcttttctaatttattataggtagaaagatggatgggatccaccgttgcacgtttattggaaaatctctcttggcaagtggtactacatgtaaaatgtggtttgcaagcttaattgctgatatggttaattaaatcaaattgtggatacgagaatgacatttatcctagagctcatcatgcgatccaacgaatgaaaaaggaattaacagaatcaaagtgtatctctcatttaccaattgtattaaagc

SEQ ID NO: 2270 - DNA, 3070 bp, Oryza sativa
aaatagatggaagaccagaaaagtctggactctggaagaaagaaagcggcgcggcggccggcggggcacggcacggtggacatcacagggaaggagaaacgcttcttcccgttgttcccaaatcccaatccgtgggagcgcagtcgcaggccaacgatcgagtggagtcgagcacaaggaaaaggaacgcatcgccatcgccatcgccatcgcctccctccctgtcctgtccagctcacctccaaaccctccatcttcttgatttactatacttgattccgtacaaccgctcatggataaagagccaaccatggaggatttgccttcaacgctggggcagccttctacttctgcatcatcggttgatgctagatattcagccgacaggactgaagattcacagctcttcctctccgtcccagctttaaaccaagctgcgtcttatctggcccagacggcctcatatcttacccagtgcctccctgtatctggttacacagctatttctgaggaagggcaagaactagcaactctgccacctgcgtcaactgttggtggatcctcttttcaggcttcttccgaacagtcagcagactcatctcctggtgaaattgataatactggaagctcatctcaagaaatcacagaacagatggcacctttgcgcgtcttccagaatggggcttcactgtttcaaggtcttgtagaacgtgctcggaaaactgttcgtggctcagccaatgatattggatggcttcagcaggatcaaagcttacctccaactgaggacggaactgccagattcttggaaattcttgatgctgtgagaaaaaacgaacacaagctgcctgattcgatggtctatctgttggttccaggtttgtttagtaaccatgggcctctttactttgtcaagacaaaatcatatttctccaagatgggtctggcttgtcacattgccaagattcacagtgagtcttcagtaagtaaaaatgcaagggagataaaggaatatatagaagaaatatactggggatcgaagaagcgggtgctacttctcggccatagcaagggtggtgtagatgcagcagcagccctctccctttactggccacaactgaaagacaaggtcgcaggtttggctttagctcaaagcccatatggaggaagcccggttgcttcagatatcttgcgagaaggccagcttggtgactatgtcaggttacgtaaactcatggagattttggtatcaaaagtccttaagggtgatcttcaggctctggaagacctgacatatgagaggaggaaagaattcctgcggcagaacccattgcctcctgaggttcccattgtctcgttccacacagaggctagcatcactcccagtgtgcttacagccctctctcatgttgcacacttggagctcccagctgcagctgatgggaatcctactaggatcccagttgtaatgccactttcagctgcaatggcagcatgctcacaacttctggtggcaaggtatggtgagaagagtgatggtcttgtgacaaggaaggatgctgaagttcctggatcagtagtggtccggccagagcggaagttggaccatgcatggatggtttattcctcactcaatgaggaacctagggatcaggcagacacatcgcaggtatgtgaagccctgctgactctgcttgttgaggttgcgcagaaacggaggcatgagatggctatgaaagatgaataaaaataagcttcatatatcaactgaatctgaaaggtgaaaagggcaacaatggaagcgtttctctttttttttttaatttaccataaggaaattgtatgatttggtcgtttctcatgtctcatggtattccccttcccaatcaggtgattcgtctactaggtctgaatttgattatggttgtaagtgtatttaggcatgattccatgagtcatgggtatgcaacagcttgagatcgcaatgtatagaactctttatatcctagtctgttgcagattcttcacaacaattagcctaacttgtgaaagcgcattattttctgtttgttatggtgtttagagcttcagtgtgcactatgattaggttatgcttcatcgtcctaactgattactaccagttgagcaattcctcctcatctgatcaacctttgacatgtccacggggaatggtccaataatagtgttcagaacagctcctgctaggccccatggggaagtctccattctggagcgtgtccatggtgtctgttgacaatgggtggtagcaaaggaggttgagaaataagggcagaaccatggtccatctggttgcagcagaggagcaaaaaagctttattgggtaattcactcaaattcaactattcatgatgaacacggttgaggagcaagaaaggagagaagagcagggagtggcacatgcgccaaaagtgcaccccaccccctcgtcctgactactcctgacatcgtgcttgctccaaacaaaagttcacatccaccaaccatgtattacattgatgaacaagcactgcagggaggactgaaatccgaaatgcacagtacaggcatgcggttgttggcctgccaatgctgaggagaagacgtggtctaaccagggagctctcatcttgatataactaacaataagaaatataaatggattgtgttcatgcagccctacatgactatttttatcgatcaaaagaactgattgagtcgttcacaggtcaacgtatacacatacaagttgcgctattctatgcatggggaagcaactaaatggttgcactagtgccaagttgctaatcggagaagcattagctcggggcatgcagttcagtgacaaccatactcaaatcagcttttctttctgtcgtgtttttgtttctccatttctttctcttttttctaatttattataggtagaaagatggatgggatccaccgctgcacgtttattggaaaatctctctttgcaagtggtactacatgtaaaatgtggtttgcaagcttaattgctgatatggttaactaaatcaaattgtggata

SEQ ID NO: 2271 - DNA, 1776 bp, Triticum aestivum
cttcttgccgcagaaaccgactaccgtcccgtcccctcctacctccccacgaaacggaatttctcctctcccgccgccacacccccacctcacccccgctggagaagacagccgagccgccgcctcctggatccaccgcgcgttaggactaataactgggactagcggatccatcggtccagcatggagccctcagcacagggagagccttctacttccgcgtcggttgacgatagccaatcagtcgatagggctgaagattcagaactcttcccctctgtcccagcattaaaccaagctgcgtctaatcttgcccaaatagcttcgtattttacccagtgcctcccggtgcctggttacacaggaataccagaggaaggccaagaactagcaatacttccaccggtctcaacttctggcaggcctgctcttcagacttcttctgcagagttggatggcagtagcttgtctcccagtgtaataagttcctctcaagaaacctcggaaatctcagggcagatggcaccttttcgtgtttttcagaatggagcttcactatttcaaggtctcgtagatcgtgctcggaaaactgtacgtggttcagcagatgatatcggatggcttcagcgcactcaaggcttacctgcagctgaggatgggacgaccagatttttggagatccttgactccgtgagaaaaaatgagcacaagctacctgatgcggtggtgtatttgttagttccaggtttatttagtaaccacgggccactttactttgtgaagacaaaagcatacttctccaaaatgggtctggtttgtcacattgccaagattcacagtgagtcttcagtaagtaaaaacgcaagggagataaaggaatacattgaagaaatatactggggatcaaggaaacgtgtgctacttctcggtcacagcaagggtggtgtagatgcggcagcagctctgtcactctactggccacaactgaaagacaaggttgcaggtttggtactagctcaaagcccctatggaggaagcccagttgcttctgatatcctgagagaggggcagcttggtgactatgtcatgctacgcaagcttatggagattttggtttcaaaagtccttaagggtgatctgcaggcactagaagatctgacatatgaaaggaggaaagaattcgtggcgcagcacccattgccccccgaggtgccaattgtatcattccacacggaggcaagcatcaccccaagtgtgctgacagccctctctcatgtcgcgcatgtggagctcccggttgccgctgacggcaatcctgcgaggattccggttgtaatgccactttcagctgccttggcagcatgctcgcagctgctggtggcgaggtatagtgagaagagtgacggtcttgtgacgaggaaggatgctgaagttcccggatcggtggcggtccgaccagagcggaagctggaccatgcgtggatggtgtattcctcgatgaatgaggagcccggggatcaggcgaacacgtcgcaggtatgcgaagctctgctgactctgcttgtcgaggttgcgcagaaaaggaggcatcagacggccatgaaagacgaatagggaaaacgttggagctgtgctgacagatttgtgtaactatagattgactaggtggttgttggtcgacgttgaaactgcttctggtaaccttgccgaagctgatctttatgcatatacttctgctttttttttgtcatgagataatatcatcaggaatcatag

SEQ ID NO: 2272 - DNA, 1767 bp, Triticum aestivum
cttcttgccgcagaaaccgactaccgtcccgtcccctcctacctccccacgaaacggaatttctcctctcccgccgccacacccccacctcacccccgctggagaagacagccgagccgccgcctcctggatccacagcgcgttaggactaataactgggactagcggatccatcggtccagcatggagccctcagcacagggagagccttctacttccgcgtcggttgacgatagccaatcagtctatagggctgaagattcagaactctttccctctgtcccagcattaaaccaagctgcgtctaatcttgcccaaatagcttcgtattttacccagtgcctcccggtgcctggttacacaggaataccagaggaaggccaagaactagcaatacttccaccggtctcaacttctggcaggcctgctcttcagacttcttctgcagagttggatggcagtagcttgtctcccagtgtaataagttcctctcaagaaacctcggaaatctcagggcagatggcaccttttcgtgtttttcagaatggagcttcactatttcaaggtctcgtagatcgtgctcggaaaactgtacgtggttcagcagatgatatcggatggcttcagcgcactcaaggcttacctgcagctgaggatgggacgaccagatttttggagatccttgactccgtgagaaaaaatgagcacaagctacctgatgcggtggtgtatttgttagttccaggtttatttagtaaccatgggccactttactttgtgaagacaaaagcatacttctccaaaatgggtctggtttgtcacattgccaagattcacagtgagtcttcagtaagtaaaaacgcaagggagataaaggaatacattgaagaaatatactggggatcaaggaaacgtgtgctacttctcggtcacagcaagggtggtgtagatgcggcagcagctctgtcactctactggccacaactgaaagacaaggttgcaggtttggtactagctcaaagcccctatggaggaagcccagttgcttctgatatcctgagagaggggcagcttggtgactatgtcatgctacgcaagcttatggagattttggtttcaaaagtccttaagggtgatctgcaggcactagaagatctgacatatgaaaggaggaaagaattcgtggcgcagcacccattgccccccgaggtgccaattgtatcattccacacggaggcaagcatcaccccaagtgtgctgacagccctctctcatgttgcgcatgttgagctcccggttgccgctgacggcaatcctgcgaggattccggttgtaatgccactttcagctgccttggcagcatgctcgcagctgctggtggcgaggtatagtgagaagagtgacggtcttgtgacgaggaaggatgctgaagttcccggatcggtggcggtccgaccagagcggaagctggaccatgcgtggatggtgtattcctcgatgaatgaggagcccggggatcaggcgaacacgtcgcaggtatgcgaagctctgctgactctgcttgtcgaggttgcgcagaaaaggaggcatcagacggccatgaaagacgaatagggaaaacgttggagctgtgctgacagatttgtgtaactatagattgactaggtggttgttggtagacgttgaaactgcttctggtaaccttgccgaagctgatctttatgcatatacttctggttttttgacatggaatatctttattccatt

SEQ ID NO: 2273 - DNA, 1991 bp, Brachypodium distachyon
gttcttttcgccgcagaaagaaagaaacccaactcaactcatccatcggccgcctcttcccaacgcccaagccaaggaatcgcccacggaatcggaaatttctctcgccgcaaacgctattcagatccccatcggcttcgatcacgtctgttccccactcctgggcttggagatttccttccttcctttgcttgctagcgcgccgcttagctagggtttccaaatccatccatccaccatgccggagccttcttccgcttctacctctgcttctgcctcggccgatgattcagtcgatagggttgaggattcacagctcttctcccctgtcccagcaataaaccaagctgcgtccaatctcgcaaatttagcttcctattttacccagtgcctcccagtacctggtggttacacaggaatacccgaggaaggccaagaactagcaatacttgcgcctgtctcgactactggcaggcctgctcttcaggcttcttcttcttcttcttcttcttcttcttcttcttcttcttcttcttcagagtttgatgccagcagtagcttgtctcacagtgaaatagatcttactgtgagttcctctcaagaaaactcaggccagatgtcgcctttccgcgtttttcagaatggagcttcaatgttccaaggtctcgtggaacgtgctcggaaaactgtacgtggttcggcagatgatattggatggctccaacgcgttcagagcttacctccaactgaggatgggacagcccgattcttggagattctagactctgtgagaaacaaggagcacaaactacctgattcgctggtatatttgttgatcccaggtttgtttagtaaccatgggccactttactttgtgaagacgaaggcatatttctccaagatgggtctggtctgtcacattgccaagattcacagcgagtcttcagtaagtaaaaatgcaagggagataaaggattacatagaagaaatatactggggatcaaggaaacgtgtgctacttcttggtcatagcaagggtggtgtagatgcagcagcagccttgtctctctactggccacaattgaaagataaggttgcagggttggccctggctcaaagcccatatggaggaagcccagttgcttcagatatcctgagagacgggcagcttggtgactatgtcatgctacgcaaacttatggagattttggtgtccaaagtcctgaagggtgacctgcaggcactagaagatctgacatatgaaaggaggaaagaattcctgtcgcggcacccattgcctcccgaggttccaattgtgtcattccacactgaggcgagcatcacccccagtgtgctgacagctctctctcatgtcgcgcacgtggagctcccgattgctggtgacggaaatcctgcaaggattccggttgtaatgccactttcagcagcaatggcagcatgctcgcagctgctggtggcaaggtacggcgagaagagtgatggtcttgtgacaaggaaggatgctgaagttcctgggtcactggcagtccgaccagagcggaagctagatcatgcctggatggtttattcttcgatgagagaggaggctggggatgaggcggacacgtcgcaggtatgcgaagccctgctgagtctgctggtcgaggttgcgcagaagcggaggcatgagatggccatgaaagacgaataaatacgaaaaaaagaatgttgggatctgtacaacgtcctggtagatttttttaaccatacgtagatcataaattgactctttttttgacaatctgactttagttagttgttggctgtaggaaaagaaagttgtgttgagatgtgagaagctatatatgtggcctatcctatgttgaaacttcacgtttgcttctgggcgaagctaattagcttatgaatgttcctagtcagtcatatttttagattattgcaagcaagaaagaaagagattgttgtctcat

SEQ ID NO: 2274 - DNA, 2123 bp, Zea mays
gtcaatttaaccggcccggcccataatcccttgtaagagaggattttgctaggtttttgcccccaaccgcccaactgcgcgtgctcctgccgacctcccacccctccactcccctgcggttggcggctgtctcgccgaagcgacccagccggcgcagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgagggcatgtgcttctcgctccccacgcccgacgacccgttcaacgagcgccatggcaggaagcacaagctcgatgacgagccggccgacgacacagccgccgacgccgctgaggacagcggcaaccccaagaagaagggcgcgaacaccaaaaagcagcagccggtggcaaagtatggcgccgaggcgaagtcgaaggcggttcgcgagagggagacgggtgcggaggtggtccgcggggacttcgaccggccgtccaagttcctggtggtctgtctcaacgctatccgggatgcggtggcgcccgaggaaggcggtggcagcatccacggcgccggcgactggggcgtggagctctggcggtgctgctccgcccaggcgccgtccgacgtgctcgacgctagcggcgcgtgcgccacggtggcgcagaccgcgtggctcgtctccaccgcctgcgacatcgtcgctaggaaagagaggcatgggatggtcgtgtcttgccccttcctgctgtacctcgtctcgtcgcaggataaggccgcgcaggtgcgatcgatatgcaaacccctgaagcctcttgggattcattcagtgagcttgcatcctggcgcatccattgaacaccagatctctggactgaaaacttgtgagccggagtttcttattgctacccccgagaggcttcttgaacttgtttcgttaaaggcgattgacatatcaggtgtatcaatgttggtcattgatggactgaaatgtttcgtagaccacaatgttagtgacaaaatattttctattagagacgccatatcaaacaatcttcagattactatcttcaccgatccatctgataaaaatattgcaacaatggctaaaaatctactccgtggaagaattacaaagctttctatcaatgattctgtttcttcacgaagtgcatttatagcccagcatgtacacttctgtccatcggaggagctgaaaacaacaaaggttaaggaaattcttgagcagatattgcaagatcatcctaaaaagacatcaaaggtgcttctagtagctgcaagcgataaaaaagcacggctcatgtcactgtcgctgaagctggaaaattgcacagtgattgatgactcatgtggcaactcctttacaatatgcagcagtgtggggctgatgaatgtcattgtgaaagaccgggagaacatgtcagtgacagatgtagaggcattcgaaaccgtgctggtggtggatctgcctccttcagtcgacgaatacattgagatcctcactggggctgctcttcatgtgattggaggcgaagtgcatagcatattctgtaacactgatgcttctgttgcaaaacctctggctcagcttcttgcagactgcggtcaggtggtgcctgaattcctcaaaagcctgaagtcttcatagcagagacttgtgtacgcaatcagagtagtcagatcacaccgtggcgattcagatcatatcggagcagtgtgtgttctacatgttattctcatttatcagcacagcattggtattcaggcctcgtccttggtatgtactattatgtcgtgcattgtgaaatgtgaatgccttgaggcccttttcctgggagttgtttattgtcaattgtgtcaaaggaactgagtcagtcatccctttgctccctccccagcttcctttgtccaaaggcaagcagaaacagggacctccactgagagatcttggcaccttcaaagtgcatcaaccaaaatgtcaaagacacagcttcttttaatcaagttatttttcacatctttacagcacct

SEQ ID NO: 2275 - DNA, 3038 bp, Zea mays
ccctgacttctaccgtctcccgtccgcccgtcgcagagtcacggacgatgcgccgcagcccgccgtcctgccgaggcaccgacggttgccgcctaccccagcacggctgcacttcgatccggtcttgctcgtgcttcgtgctgtcttagcggtcgatcgtcgccatctcccctcggtgcttggccgtccagcgggaacggcgcagccgcgcaggcgcaacgggtgctcgcctttcgacaagggcgccccccgcgccagcccaagcgccagcaccagcgaggccggggcggagcacaggagcccgccgctggcctgctgctcaagccccaggggcggcggatctacagccggcgccgagggaggcgccaagcccttcctccagctgatgtagcaatatttactcacatttgatcctcacaacactgatacttcaagatggaacaaatttcacttggcaacagatacaaggagtgcaggacacaaagaactaccagctgtcaaacaaaaatacttgttggaaaggatgtattaaacgaaatagagcaaaggcgttcatcaccaagtgtgattgcaaaactgatgggaattgaggtgttgccaccttctaaagtggtcaatagtcggcatcaagaatttaaggatgtttttgaagtgtcagaggaaccaccagaggctgtcgcaaaagagaagtcccaaggcttgccgagcttgaaacgaagagcgctaagcttgaaaaagcttatgccatcaaaaacactctacagagatgatacacatgattgttatgtggattgtgtagctggcttgggtcgcttgaactcagtggaaataaataatcctttatttgagaagcaccttcatgacatgaactattctgcaaattatcagtatgtaaaagatacatcaagtgtttgcaggacataccctgtgggtttagccaattcatcactcagcaatttcagccttttatcaagagggaaaaacaaagatttcaacagcattgtagttctggaaccaccatgcttggaaaaagggcatgatccagaaaacattttttccattccatacctttctcctgtcaataaaaactgcagtagaggcatgaaacataagaaatttgagtttcctgtaatggagaatggaagagttcgggaacatatattaggtactgaagctaacaatgtgcttcgaattagaaaagaaagacccttgactagtgactccattgatccactgcaaattggacaggaagcatcagttcatcagtttgggaatactgatgtgagttgttctggatcatctcagaggtattcttgtggtaacgatagctttaggaaaactaacaggtcatcatcaagcagaatatgccggcatgcagaatctgctgttggttcgaaaactcttgcagaaatgtttgctttatctgattctgaaagactgaagctaaattcagactcaaatgctccagttctatgtaatatgattgaccgtgataatggtcatagcaaggatggatgctttatagttttaccaaagcatgcacctgtgctgtctatccgaagctcaatggacatgccttcttgcttggaaggctcctctcagggtaaaaataatctaaacatatccaatatttacaacaatggtaagtttcagattgattcttcccgggataaaccaagatcactgaagcaaattggcagtggcactgaagctcacttgagcagtgctcactgtttccaaaatcttacaggtgacaacttttcaactcctgattgcttaaatgataaagtattgttgacaacagatgaagacgtagttcgacaatcagctgaatctgagccttccaggttcaacttgcaggtttctaggaaacaacgggtgacagtattgcctttccattgtcacgaggatgaatcgatatctgtttcggatcatactgatggtacaaaattttgtaaaggctcaaaagaggttgagcaaccgagcccagtgtccatccttgagcctccaattaatgaagatatttgttttccacgatgtttcaactatgacttgcaagggatggctaacaaacagagaggttgccatcaatatcacaatgaatctgaagttaacatgtcaagtgatgatgaagaccattctttttaccaatctttggaagcatttcaggtcgaggaaaactgggacttctcatatcttctcgacatacttatatgctctggtatcatagttgttgactggcagctcatctgcaagtcatggtacttgcctggttaccctgttggccctcatgtctttgataggcttgaaaggaaatacaataaaatcgcaacatgggcaaagcctgagaggaggcttctttttgacctcgtgaattcaattctttccgaggtccttgcaccatgtgttgatgtgcacccatgggtgcagcctagtagacactgtgtggcattttggggccctgaagggcctgttgagaaggtttggcagacaattgttaggctgcaggaagactgtgtcacaaggcatcctgatgagatggttcttgatacaaattggctggaagtaggcaccgacatcaatatggtggggaagcagatagctaggatgttacatggcgacctcttggaagaagtcatagtggacttccttggttgagttggtagtttcatgtggacataactagtaactaacaacttcggcaacatggggttcgctcaaacttcaagcagattatgctgaatatgtaacggcttttcaagtgcacacatgctgcatttttcttctggttataataggagctatgtattatgtaattacattggagagcaaaatatacaggccaaaaaaacactactgcaggtatttttcgattctgtactgctaagctgtacttcctggtcctatctgatactttgatgggtgtagtaattgtaaggaaaatggaccttaatctagtttggttatgatgtttgatgaccaacatgattatttggactaatatttgattggtgaaaaagtggactgatttagacaaa

SEQ ID NO: 2276 - DNA, 2864 bp, Zea mays
ccctgacttctaccgtctcccgtccgcccgtcgcagagtcacggacgatgcgccgcagcccgccgtcctgccgaggcaccgacggttgccgcctaccccagcacggctgcacttcgatccggtcttgctcgtgcttcgtgctgtcttagcggtcgatcgtcgccatctcccctcggtgcttggccgtccagcgggaacggcgcagccgcgcaggcgcaacgggtgctcgcctttcgacaagggcgccccccgcgccagcccaagcgccagcaccagcgaggccggggcggagcacaggagcccgccgctggcctgctgctcaagccccaggggcggcggatctacagccggcgccgagggaggcgccaagcccttcctccagctgatgtagcaatatttactcacatttgatcctcacaacactgatacttcaagatggaacaaatttcacttggcaacagatacaaggagtgcaggacacaaagaactaccagctgtcaaacaaaaatacttgttggaaaggatgtattaaacgaaatagagcaaaggcgttcatcaccaagtgtgattgcaaaactgatgggaattgaggtgttgccaccttctaaagtggtcaatagtcggcatcaagaatttaaggatgtttttgaagtgtcagaggaaccaccagaggctgtcgcaaaagagaagtcccaaggcttgccgagcttgaaacgaagagcgctaagcttgaaaaagcttatgccatcaaaaacactctacagagatgatacacatgattgttatgtggattgtgtagctggcttgggtcgcttgaactcagtggaaataaataatcctttatttgagaagcaccttcatgacatgaactattctgcaaattatcagtatgtaaaagatacatcaagtgtttgcaggacataccctgtgggtttagccaattcatcactcagcaatttcagccttttatcaagagggaaaaacaaagatttcaacagcattgtagttctggaaccaccatgcttggaaaaagggcatgatccagaaaacattttttccattccatacctttctcctgtcaataaaaactgcagtagaggcatgaaacataagaaatttgagtttcctgtaatggagaatggaagagttcgggaacatatattaggtactgaagctaacaatgtgcttcgaattagaaaagaaagacccttgactagtgactccattgatccactgcaaattggacaggaagcatcagttcatcagtttgggaatactgatgtgagttgttctggatcatctcagaggtattcttgtggtaacgatagctttaggaaaactaacaggtcatcatcaagcagaatatgccggcatgcagaatctgctgttggttcgaaaactcttgcagaaatgtttgctttatctgattctgaaagactgaagctaaattcagactcaaatgctccagttctatgtaatatgattgaccgtgataatggtcatagcaaggatggatgctttatagttttaccaaagcatgcacctgtgctgtctatccgaagctcaatggacatgccttcttgcttggaaggctcctctcagggtaaaaataatctaaacatatccaatatttacaacaatggtaagtttcagattgattcttcccgggataaaccaagatcactgaagcaaattggcagtggcactgaagctcacttgagcagtgctcactgtttccaaaatcttacaggtgacaacttttcaactcctgattgcttaaatgataaagtattgttgacaacagatgaagacgtagttcgacaatcagctgaatctgagccttccaggttcaacttgcaggtttctaggaaacaacgggtgacagtattgcctttccattgtcacgaggatgaatcgatatctgtttcggatcatactgatggtacaaaattttgtaaaggctcaaaagaggttgagcaaccgagcccagtgtccatccttgagcctccaattaatgaagatatttgttttccacgatgtttcaactatgacttgcaagggatggctaacaaacagagaggttgccatcaatatcacaatgaatctgaagttaacatgtcaagtgatgatgaagaccattctttttaccaatctttggaagcatttcaggtcgaggaaaactgggacttctcatatcttctcgacatacttatatgctctggtatcatagttgttgactggcagctcatctgcaagtcatggtacttgcctggttaccctgttggccctcatgtctttgataggcttgaaaggaaatacaataaaatcgcaacatgggcaaagcctgagaggaggcttctttttgacctcgtgaattcaattctttccgaggtccttgcaccatgtgttgatgtgcacccatgggtgcagcctagtagacactgtgtggcattttggggccctgaagggcctgttgagaaggtttggcagacaattgttaggctgcaggaagactgtgtcacaaggcatcctgatgagatggttcttgatacaaattggctggaagtaggcaccgacatcaatatggtggggaagcagatagctaggatgttacatggcgacctcttggaagaagtcatagtggacttccttggttgagttggtagtttcatgtggacataactagtaactaacaacttcggcaacatggggttcgctcaaacttcaagcagattatgctgaatatgtaacggcttttcaagtgcacacatgctgcatttttcttctggttataataggagctatgtattatgtaattacattggagagcaaaatatacaggccaaaaaaacactactgcaggt

SEQ ID NO: 2277 - DNA, 1674 bp, Zea mays
ctattcatttcagctccaatcgcttcgcttgcttcgtctccagtacctgccttgccacgccagtcgccagctcagacctcgctcctctgccctgctcctccgtaaactaaagaggccctcccgcggtcccgcccggtggcctctcgccgtgctcatccgttcggtaccgggtcagtgccgccgtcagtaggtggtcagtcaatcatccgctcgtccattccagctctctcctgctcttgaccggccaaccatccatccatccatcggcgggcgcgcagccagccaagcggtcccgccataaaggtggcgagcgcgagtatgctgttgcattgctgctgattgctccgtctcctccgcctctcgctcgctctctgaggtgaggaagaagaagcggagaggttacgggtttgcgggttgcgttgcgtgcgacatggggagagcggcggggctggcgcgcgacggtgtgacgacagcggggcgggcgacgacgacgagggtcatgcgggctgccgtgtccgcgttcttcgccgggtaccaccgcttcacctccgtggcggcgctgctggcgctgccgttctcggcggcggtgctggcgtcggaggcgatggcgccgtcgtcgtgggcgctgcgcgctgtggcggcgcggctccgctccgtgttcgcggccgcggggttcccgccctcccccttcttcgcgctgctcgaggccaagctgtcgcagaccgtcttcacgttcgcggccacgctgccgttcgcgctcaccttcctgctgctggccaaggcctgcgtcgccgccatgctccgcctccgggacgacgacgcgtcggagtcgccgccgcctcggcggcggcgggtcgccgtggccgcgctcccgccgtgcgcggccgtggcgcgcgcgtacccggccgtcgtcgccacgcacctcctcaacgccttcctcatgctctccgccaacgccgcggtgttctcgctgctgctgctggctttcggcgccgccgacctgctgggtctcacctcccacgtctggacgctcgcgctctcggccgcgggcgccatcgtctactcgctcgtcgtcggcgtcgccaccgtggtctgcaacctcgccatcgtcgtggccgccacggagcccgggtgcgcgggccacgccgcggtgctcagggcctgcgtcgcgatccggggccgggtgtccacggcgctggcgctggcgctgcccaccaacctcggcatggcggcggccgaggcgctgttcggactccgcgtcgtcgcgcagcgtcggagggacgggaggctcgcgccgggtgtcgccggcgaggccttctcgatcgcctacatccacgcgatctgcgtcgtgctggagatcatcgtcacctgcatgttctacaggagctgcaagaggagtgaagccgacgagctcagagagctggagccagaggagaagggagacctccaggcttgatgccctctcaccttcagcttcagtctggtgcgtgcacaatacagatagtagcatcatcatagattgtgtttctgatcagaacaacaggatcagatcatagggtacagagctgatacaaagaaacatagtggtaagccgacataaatttctgcaaaatgtttctttttttatgcaaagcaaatggtaaacattgagttcaaataaacggttatttgtac

SEQ ID NO: 2278 - DNA, 1633 bp, Zea mays
agtacctgccttgccacgccagtcgccagctcagacctcgctcctctgccctgctcctccgtaaactaaagaggccctcccgcggtcccgcccggtggcctctcgccgtgctcatccgttcggtaccgggtcagtgccgccgtcagtaggtggtcagtcaatcatccgctcgtccattccagctctctcctgctcttgaccggccaaccatccatccatccatcggcgggcgcgcagccagccaagcggtcccgccataaaggtggcgagcgcgagtatgctgttgcattgctgctgattgctccgtctcctccgcctctcgctcgctctctgaggtgaggaagaagaagcggagaggttacgggtttgcgggttgcgttgcgtgcgacatggggagagcggcggggctggcgcgcgacggtgtgacgacagcggggcgggcgacgacgacgagggtcatgcgggctgccgtgtccgcgttcttcgccgggtaccaccgcttcacctccgtggcggcgctgctggcgctgccgttctcggcggcggtgctggcgtcggaggcgatggcgccgtcgtcgtgggcgctgcgcgctgtggcggcgcggctccgctccgtgttcgcggccgcggggttcccgccctcccccttcttcgcgctgctcgaggccaagctgtcgcagaccgtcttcacgttcgcggccacgctgccgttcgcgctcaccttcctgctgctggccaaggcctgcgtcgccgccatgctccgcctccgggacgacgacgcgtcggagtcgccgccgcctcggcggcggcgggtcgccgtggccgcgctcccgccgtgcgcggccgtggcgcgcgcgtacccggccgtcgtcgccacgcacctcctcaacgccttcctcatgctctccgccaacgccgcggtgttctcgctgctgctgctggctttcggcgccgccgacctgctgggtctcacctcccacgtctggacgctcgcgctctcggccgcgggcgccatcgtctactcgctcgtcgtcggcgtcgccaccgtggtctgcaacctcgccatcgtcgtggccgccacggagcccgggtgcgcgggccacgccgcggtgctcagggcctgcgtcgcgatccggggccgggtgtccacggcgctggcgctggcgctgcccaccaacctcggcatggcggcggccgaggcgctgttcggactccgcgtcgtcgcgcagcgtcggagggacgggaggctcgcgccgggtgtcgccggcgaggccttctcgatcgcctacatccacgcgatctgcgtcgtgctggagatcatcgtcacctgcatgttctacaggagctgcaagaggagtgaagccgacgagctcagagagctggagccagaggagaagggagacctccaggcttgatgccctctcaccttcagcttcagtctggtgcgtgcacaatacagatagtagcatcatcatagattgtgtttctgatcagaacaacaggatcagatcatagggtacagagctgatacaaagaaacatagtggtaagccgacataaatttctgcaaaatgtttctttttttatgcaaagcaaatggtaaacattgagttcaaataaacggttatttgtac

SEQ ID NO: 2279 - DNA, 1778 bp, Panicum virgatum
  misc_feature (371)..(371): n is a, c, g, or t
  misc_feature (447)..(447): n is a, c, g, or t
  misc_feature (799)..(799): n is a, c, g, or t
  misc_feature (1188)..(1188): n is a, c, g, or t
  misc_feature (1191)..(1191): n is a, c, g, or t
  misc_feature (1204)..(1204): n is a, c, g, or t
  misc_feature (1210)..(1210): n is a, c, g, or t
  misc_feature (1221)..(1221): n is a, c, g, or t
  misc_feature (1236)..(1236): n is a, c, g, or t
  misc_feature (1243)..(1243): n is a, c, g, or t
  misc_feature (1288)..(1288): n is a, c, g, or t
  misc_feature (1312)..(1312): n is a, c, g, or t
  misc_feature (1320)..(1320): n is a, c, g, or t
  misc_feature (1329)..(1329): n is a, c, g, or t
  misc_feature (1331)..(1331): n is a, c, g, or t
  misc_feature (1340)..(1340): n is a, c, g, or t
  misc_feature (1346)..(1346): n is a, c, g, or t
  misc_feature (1348)..(1348): n is a, c, g, or t
  misc_feature (1356)..(1356): n is a, c, g, or t
  misc_feature (1358)..(1359): n is a, c, g, or t
  misc_feature (1412)..(1412): n is a, c, g, or t
  misc_feature (1519)..(1519): n is a, c, g, or t
ctctgtcgtcgccgtccgtccgtcttgcttgctgaggaaggaggagagtggctgcggcatgaggcgagcggggatggcgcgcggcgcccgtggccatggcgcggcggggcgggcggggagggtgatgcgcgccgcggtgtcggagttcttcggcgggtaccactgcttcacctccgtggcggcgctgctggcgctgccgttctcggcggccgtgctggcgtccgaggcggtggcgccatcgtcggcgacgctgcgcggcgcggcggcgcggctccggtccgtggtcgccgccgcggggttcccgccgtcgcccttcttcgcgctgctcgaggccaagctcgcgcagaccgtcttcacgttcgccgccacgntgccgttcgcgctcacgttcctgctgctcgccaaggcctgcgtcgccgccatgctccgggacgacgacgccgcgcngccgccccggcggcagcggcggctgcggctcgccgcgctcccgccctgcggcgccgtcgcccgcgcgtacccggccgtcgtcgccacgcacctcctcaacgccttcctcatgctcaccgccaacgccgcggtgttctcgctgctgctgctcgccttcggcgccgccgacctgctcggcctcacctcccacctctggacgctcgcgctctccgccgcgggcgccatcgtctactcgctcgccatcggcgtcgccaccgtggtctgcaacctcgccgtcatcgtggccgccacggagcccgggtgcgcgggccacgccgcggtgctcagggcgtgcgtggcgatcaggggcagngtgtccaccgcgctggcgctggcgctgcccaccaacctcggcatggcggcggccgaggcgctgttcgggctccgcgtcgtcgcgcagcgccggagggccgggaggctcgcgccgggggtcgccggcgaggccttctcgatcgcctacatccacgcgatctgcgtcgtgctcgagatcatcgtcagctgcatgttctaccggagctgcaagaggagtgaagcggacgagctcagagagctcgagccggaggagaagggtgacctccaggcttgagctatcatgtctcagctcagcttcaactgcagtcaggtgtaaaagaaacggcaaatctcacacaaatagccacacaggatcagatcaaatggtacagagctgatccagagaaatanagngaattaagatagntttctncatatgttttntttttgttggcaagnagatganaggttgaggtcaaataaatcattgttatcttgtacagaaggaaanaataccttctactgaaagcacggnattttgcnttattcagngnttacgaggnacacantntgggactngnnaatttcgtattctgttcctcctatagacactgacagctccaaaagcttatgancaatgtttgtgctaccagcatctcttgagagttatctatcacagtacagaatatacagagacatgctcctgccctccggtccggtggaccacacaagccatagtggntgttctctatttttacaacagatattacagtgctgtataaacaccacaactgcgagtatagggggaagagaagatggtacaagaggataatgcaaaggcaaaccagcagcagggttacccttttttagtttttcctgtaactaaagtcacaaggggaaacagtgaagcttgcatttctcctggttttagtccatctccagagtccagaccattaagacgggggagtgggggcctgggtggggggggggggggggggcat

SEQ ID NO: 2280 - DNA, 1693 bp, Zea mays
accgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgtccactccgttcgagctctcctactcttcaccacccacccatccatccatccatccatcggcgagcgcgagagcacactgttgcattgctgatcgctccgtctccgctgccgacgaggacgaggaagaacgagggagagacgcagacaggctgcgttgcgccatgaggagagcaggggggctatcgcgcgcgggccacggcgcggcgccggcggcgggggtcatgcgggcggcggcgtccgcgttcttcgcggggtaccactgcttcacctccgtggcggcgctgctggcgctgccgttctcggcggcggtgctggtggccgaggcggcggcggcggcgccagcgccggcgccggtggcgctgcgcgcgctagcggcgcggctgcgcgccgtgttcgccgccgcggggttcccgccctcgcccttcttcgcgctgctcgaggccaagctgtcgcagaccgtcttcacgttcgccgccgcgctgccgttcgcgctcaccttcctgctgctcgccaaggcctgcgtcgccgccatgctccgggacgacgccgcgtcgccgaggcggcaccggcggcgcaggtggcccggcgtcgccgcgctcccggcgtgcggggccgtcgcgcgcgcgtacccggccgtgctcgccacgcacgtcctcggcgccttcctcatgctgtccgccaacgcggcggcgttctcgctgctgctgctggcgttcggcgcggccgacctgctggggctcacgtcccgcgcctggacgctggcgctctcggccgcgggcgccgtcgcctactcgctggcggtcggggtcgccgccgtggtctgcaacctcgccgtcgtcgtggccgccacggagcccgggtgcgcgggccacgccgcggtgctcagggcctgcgtcgcgatccggggccgggtgtccacggcgctcgcgctcgcgctgcctaccaacctcggcatggccgccgccgaggcgctcttcggcctccgcgtcgtcgcgcagcgacgcagggacgggaggctcgcgccggccgtcgccgccgaggccttctccatcgcctacatccacgcggtctgcgtcgtgctggagatcatcgtcgcctgcgtgttctacaggagctgcaagaggagcgaagcggacgagctcagagagctcgagccagaggagaagggagacctccaggcttgatcacctattcacctatcaccttcaggcagctccagtctgctgcatgcacattgcacaagggaagaagaaaggaaaaccccacacacaaatagtagcgccatagtttgtctttctggtgaaaaccaacaggatcagatcatagggtacagagctgatccagagaaatatagtggcaagccgacatagatttctgcaaaatgtttcttttttttatgtaaagcaaattgtaaaagttgagttcaaataatatctgtctattc

SEQ ID NO: 2281 - DNA, 1722 bp, Zea mays
accgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgtccactccgttcgagctctcctactcttcaccacccacccatccatccatccatccatcggcgagcgcgagagcacactgttgcattgctgatcgctccgtctccgctgccgacgaggacgaggaagaacgagggagagacgcagacaggctgcgttgcgccatgaggagagcaggggggctatcgcgcgcgggccacggcgcggcgccggcggcgggggtcatgcgggcggcggcgtccgcgttcttcgcggggtaccactgcttcacctccgtggcggcgctgctggcgctgccgttctcggcggcggtgctggtggccgaggcggcggcggcggcgccagcgccggcgccggtggcgctgcgcgcgctagcggcgcggctgcgcgccgtgttcgccgccgcggggttcccgccctcgcccttcttcgcgctgctcgaggccaagctgtcgcagaccgtcttcacgttcgccgccgcgctgccgttcgcgctcaccttcctgctgctcgccaaggcctgcgtcgccgccatgctccgggacgacgccgcgtcgccgaggcggcaccggcggcgcaggtggcccggcgtcgccgcgctcccggcgtgcggggccgtcgcgcgcgcgtacccggccgtgctcgccacgcacgtcctcggcgccttcctcatgctgtccgccaacgcggcggcgttctcgctgctgctgctggcgttcggcgcggccgacctgctggggctcacgtcccgcgcctggacgctggcgctctcggccgcgggcgccgtcgcctactcgctggcggtcggggtcgccgccgtggtctgcaacctcgccgtcgtcgtggccgccacggagcccgggtgcgcgggccacgccgcggtgctcagggcctgcgtcgcgatccggggccgggtgtccacggcgctcgcgctcgcgctgcctaccaacctcggcatggccgccgccgaggcgctcttcggcctccgcgtcgtcgcgcagcgacgcagggacgggaggctcgcgccggccgtcgccgccgaggccttctccatcgcctacatccacgcggtctgcgtcgtgctggagatcatcgtcgcctgcgtgttctacaggagctgcaagaggagcgaagcggacgagctcagagagctcgagccagaggagaagggagacctccaggcttgatcacctattcacctatcaccttcaggcagctccagtctgctgcatgcacattgcacaagggaagaagaaaggaaaaccccacacacaaatagtagcgccatagtttgtctttctggtgaaaaccaacaggatcagatcatagggtacagagctgatccagagaaatatagtggcaagccgacatagatttctgcaaaatgtttcttttttttatgtaaagcaaattgtaaaagttgagttcaaataatatctgtctattcgaaactgagatgttttaggtgctcctcac

SEQ ID NO: 2282 - DNA, 1588 bp, Zea mays
agcacccccgactccccgaggcctcccgtcccctcctcgacgacacccacaaacccatcccatctcccaacacctccgccggtccgccccagtctctcccactcccagcgcccaccggcaccgccgccgcacgcgacccctcgtccccgtcccccgccccgaccgcacgccggaatggctgcgggctcgtccgcggtgtgggccgcgcaacaccccgcctgcagcggcggcaagttccaccacctgtcgccgtcccactcccactgccgcccgcgccgcgccctccagacgccgcccgcgctccccgcgagacggagcggcgcctccccgccgcgcgccagcctcgccgccgccgcgcctgcggtggcggtgaggacggcttcggaggaggccgtgtacgaggtggtgctgcggcaggcggcactcgtggaggccgcgacgccacagaggcgccggacgcggcagccgaggtgggcggaggaagaggaggaggagagggtcctcggctggggcctcctcggcgacgcctacgaccgctgcggcgaggtctgcgccgagtacgccaagaccttttacctcggcacgcagctcatgactcctgagcggcgcaaagccgtctgggcgatctacgtgtggtgcagaagaactgacgagctagtggacggtcccaacgcgtcctacatcacgccgaccgctctcgaccgctgggagaagcggctggaggatctctttgagggccgcccgtacgacatgtacgacgccgcgctctcggacactgtgtccaagttccccgtcgatatccagccgttcaaagacatggtccaaggaatgaggctggacctgtggaagtcgaggtacatgaccttcgacgagctctacctctactgctactacgtcgccggcaccgtcggcctcatgacggtgcctgtcatgggcatcgctcccgactccaaggcctcgaccgagagcgtgtacaatgctgctctggctctcggcatcgctaaccagctgacgaatattctcagagacgtgggcgaagatgcgaggagggggagaatataccttccgttggacgagcttgcgcaggcaggtctcacggaagaggacatattcagagggaaagtgaccggcaagtggaggaggttcatgaagggccagatccagcgtgccaggctcttctttgatgaggcggagaagggcgtcacccatctcgactctgctagcagatggccggtgctcgcgtctctgtggctgtacaggcagatccttgatgccattgaggcaaacgactacaacaacttcaccaagcgtgcgtacgtcggcaaggccaagaagctgctgtcgttaccgcttgcatatgcaagggctgcggttgcaccatgaaccatccgtagatcacatcttttttttcttttcttttccaaacccaccttgttttgccccacccttccttttttttttgtatataatcagcttcagctgcctgcatggcataagccttgcctgttcagggtgattccatgtccctaaatactcaatcagctcttgttacaaggaatggagaattagaattcgagaagcgtatata

SEQ ID NO: 2283 - DNA, 1570 bp, Zea mays
ccccgaggcctcccgtcccctcctcgacgacacccacaaacccatcccatctcccaacacctccgccggtccgccccagtctctcccactcccagcgcccaccggcaccgccgccgcacgcgacccctcgtccccgtcccccgccccgaccgcacgccggaatggctgcgggctcgtccgcggtgtgggccgcgcaacaccccgcctgcagcggcggcaagttccaccacctgtcgccgtcccactcccactgccgcccgcgccgcgccctccagacgccgcccgcgctccccgcgagacggagcggcgcctccccgccgcgcgccagcctcgccgccgccgcgcctgcggtggcggtgaggacggcttcggaggaggccgtgtacgaggtggtgctgcggcaggcggcactcgtggaggccgcgacgccacagaggcgccggacgcggcagccgaggtgggcggaggaagaggaggaggagagggtcctcggctggggcctcctcggcgacgcctacgaccgctgcggcgaggtctgcgccgagtacgccaagaccttttacctcggcacgcagctcatgactcctgagcggcgcaaagccgtctgggcgatctacgtgtggtgcagaagaactgacgagctagtggacggtcccaacgcgtcctacatcacgccgaccgctctcgaccgctgggagaagcggctggaggatctctttgagggccgcccgtacgacatgtacgacgccgcgctctcggacactgtgtccaagttccccgtcgatatccagccgttcaaagacatggtccaaggaatgaggctggacctgtggaagtcgaggtacatgaccttcgacgagctctacctctactgctactacgtcgccggcaccgtcggcctcatgacggtgcctgtcatgggcatcgctcccgactccaaggcctcgaccgagagcgtgtacaatgctgctctggctctcggcatcgctaaccagctgacgaatattctcagagacgtgggcgaagatgcgaggagggggagaatataccttccgttggacgagcttgcgcaggcaggtctcacggaagaggacatattcagagggaaagtgaccggcaagtggaggaggttcatgaagggccagatccagcgtgccaggctcttctttgatgaggcggagaagggcgtcacccatctcgactctgctagcagatggccggtgctcgcgtctctgtggctgtacaggcagatccttgatgccattgaggcaaacgactacaacaacttcaccaagcgtgcgtacgtcggcaaggccaagaagctgctgtcgttaccgcttgcatatgcaagggctgcggttgcaccatgaaccatccgtagatcacatcttttttttcttttcttttccaaacccaccttgttttgccccacccttccttttttttttgtatataatcagcttcagctgcctgcatggcataagccttgcctgttcagggtgattccatgtccctaaatactcaatcagctcttgttacaaggaatggagaattagaattcgagaagcgt

SEQ ID NO: 2284 - DNA, 1686 bp, Panicum virgatum
gagcccacccaacagcacgaggcacgagcgctcaccaacacgactcacacacacttcccacccaatccatccgccaccgccgcccgattcctccctccgatcctcgccggaatggcggtctgggccgcgcaccacgccagctgcaggccccaccaaccgtcctcctcctcctcgtcccagcgcccgcgccggggcgcccgcctcctcccgctcccgctcccgctcccgaccaggcggggcggcgcctccctcgcgaggccgcgcgcgagcctcgccgccgcggcgcccgtggcgaggacggcgtcggaggaggccgtctacgaggtcgtgctgcggcaggcggcgctcgtggagggcgccgtcgcgagcaagggagcggcagcggcggcggggcggcggcggcagcagcagcagcagcgcccgcgctgggcggaggagaaggaggacgaggggctccgcgggtggggcctcctcggcgacgcctacgaccgatgcggcgaggtctgcgccgagtacgccaagaccttctacctcggcacacagcttatgactcctgaaaggcgcaaagctgtctgggcaatctatgtatggtgcagaagaactgacgaactagtggatggtcctaacgcgtcttacattacaccaactgctcttgatcggtgggagaagcggctagaagatcttttcgaaggtcgtccgtatgatatgtacgatgcagccctcgcagacactgtgtcaaagtttccggtagatatccagccattcaaagatatgattgaagggatgaggcttgacttgtggaagtccagatacaggacctttgatgagctctacctctactgctactacgtcgccggcacagttggcctcatgacagttcctgtgatgggcatcgccccagactcaaaggcctctactgagagtgtgtacaatgctgcactggctcttggcatcgctaaccagctgacgaatattctcagagatgtaggcgaagatgcaaggagagggagaatataccttccactggacgagcttgcacaggcaggtctgaacgaagatgacattttcagagggaaagtgactgataagtggaggaggttcatgaagggccagattcagcgtgccaggttgttcttcgatgaggctgagaagggtgtggcccatctagattctgcgagcagatggccggtcctcgcgtctctctggctgtacaggcagatccttgatgccatcgaggcgaacgactacaacaacttcaccaagcgcgcctacgtaggcaaggcgaagaagctgctgtcgctaccggccgcttacgcaagagctgctgttgggtcatgatgcgtctgtagatcagatattcgttttttgtttttcttcttctctcagcttggtgttcccttttttttccttcatctttgggagatctgttgggtgttgtatataatcagtttcagctgcctgcatggcataagcctgtctgtcacacacagtttttagcctagggaactcattccaggtccctcaatactcagctcttgtcacgacacagaatggaaagaaagttagaattcaagaagcattattagttgtggataactgttctccctgcaccacttctcttcggagtccaggctcagatacttttcaggtgctgttattctgttttggggtaaatcagactgcctt

SEQ ID NO: 2285 - DNA, 2793 bp, Avena sativa
gcatcagcaaaccgttgctgcatcgtttgctttacttcattgtatccacaaaagtttggcaatacatcaaggcgtatgtgaacaatttattcaacaatcataattgaccttttattgttagtgtcagctccgatgcatatatgaattactggagacaacatgcccacaaattccaaacaatgttctttcatttggttgccttggataatactatttcaatcaccacatcaccaggcaaggctgcagatgcacacatttgactctatcaactaatggcaaatatacccgttgcaatggatttcatctggccgagctaatgcccgaactcagacattaggcttgctgaataccactgggccaggtcaagttcttaacaggctctaacattgcttcaacttcgtgcaaaagttcctcatctatgcctgaactcgataactccaatgctgcagcaacattctcctccacctgttctggagagttcattccaacaagaactgtggaaatttcattgttcatcaagctatactccatggctagctttgcaatacgtttccccttctttctgcagtgatctgccgctgccctgcatgccaacttgagttcttctggtgcagggtgccaatctggtggcccattatccgtgagaagccccattgcaaggggtgaagcactgatcactccaacacctttgctcttcaaataaggtagcaaattcaccagcatagtatcattgattccgtagtggcagtaggacaggatcaaatctacggagccaggaggcacccggtcgagcacgtaagtgaagatgctcaacggcaacccagtaattccaatataccgggccttcccactctccttgatctttaggagcgcaggaatcgtctcgttcacaatctggtctaggttagtgaactcgatgtcgtggcagtggaggatatcgacatacttgagtccgaggcgcgcgaggctctcatcgatgctgcgcgtgacgcggccctcgctgaagtcgaagccttccttgtagcggccgcacttggtggcgaccacgaagctgtcgcgcgggacggccgcgaagcggaggcagtccccgagcaccgactccgacaccgtgccgccgtagtacggggatgtgtcaaagaagttgatgccgaggtcgagggcgcggcggacggtggcgcgggcgacgtcgcgggggatgtcaccgaaaacgtttccgagcggggaggcgccgaagccgacggggctgacgcgtaggcccgtgccgccgagctcgcggagccacacacgcacgcacgctcatcccccgccggccagccagccaccacaaacccaaatccgccccacccaccgccggcaccgcgcgtcccccacaccaccaaaagatggcgggttcctccgccgtgtacacgccctgccggcccagcgcgcacggccgccaccgcgccctccgcccggtcggcctgctccccgcccccgggagggtcggcctcctccccgccaggaccagggcgagggcgagcctggtggcgacggcgcccgcgcggacggcgaccgaggaggcggtgtacgaggtcgtgctgcggcaggcggcgctggtggaggagctgcaggggaagaagaggaccagggacgccgggacgcggcgctggcgggaggaggagcaggaggctgagctcggctggggcctcctcggcgacgcctacgaccgatgcggcgaggtctgcgccgagtacgccaagaccttctacctcggtacacagcttatgactcctgaaaggcgcaaagctgtttgggcaatctatgtatggtgcagaagaactgatgagctagtagacggccctaactcatcttacatcacacccaaggcacttgatcggtgggagaagagactggaagatctgttcgaaggccgcccatatgatatgtacgatgcagcactttcagacaccgtgacgaagtttccaatagatatccagccattcaaagacatgattgaagggatgaggcttgacctgtggaagtcgaggtacaggaccttcgacgagctttacctctactgctactacgtcgctggtactgttggtctcatgacagtgccggtgatgggcatcgccccagactcaaaggcctcagccgagagtgtgtacaacgccgcactagctctgggcatcgctaaccagctgacaaacatactccgagatgtaggagaagactcgaggagggggagaatataccttccactggacgaactggcacaagctggcctgacggaagaggacatattcagagggaaagtgacggataaatggaggaggttcatgaagggacagatccagcgcgcaaggctgttcttcgacgaggctgaggagggtgtgatgagcttagactctgcgagcagatggccggttctagcgtcgctgtggctgtacaggcagatcctggacgccatcgaggcaaacgactacaacaacttcaccaagcgcgcctacgtgggcaaggcgaagaagttcctgtccctaccggccgcgtacgcgagggcggccatctcgtcatgagcaaagcgatacctagatcagatgtttattttttctttctttcttgtttctcttgtttttgttttggtccttccacacgtcacaagatctctattgtctgttgtatatagtcagctgtatagccagctgtatgtttttccataagcctgccgcagtatttagttcaagggactggtttcaggtcccacagtctgaactcttgttaccacacacagaggagaatgaagatcactccaat

SEQ ID NO: 2286 - DNA, 2049 bp, Brachypodium distachyon
atggcggggtcgtccgccgtgtacacgccctgcaggccgcaccacgcccacggccaccagcagcggaggtggcggaggagcgccctcgcccacggcctgctccccaccgccaccaccgggaggaggggcgtcctcgcgagggcaagcctggcggcggcggcggccgcggggaggacggcggcggaggaggcggtgtacgaggtggtgctgcggcaggcggcgctgcaggggagcgggacgagggaggccgcggctggtaaagggaggcggcggtggcgggaggaggaggtggacgacgccgagctcggatggggactcctcggcgacgcctacgaacgatgcggcgaggtctgcgccgagtacgccaagaccttctacctcggtacacaactcatgactcctgaaaggcgcaaggctgtttgggcgatctatgtatggtgcagaagaactgatgagctagtggatggtcctaactcatcttatatcacaccaaaggcacttgatcggtgggagaagagattagaagatctctttgaaggccgcccgtatgatatgtacgacgcagccctctcagacacagcgtcaaagtttccaattgatatccagccattcagagacatgattgaaggaatgaggcttgacttgtggaagtcaaggtacaagagctttgatgagctttacctctactgctactatgtcgctggtactgttggtctcatgacagtgccggtgatgggcatagctccagactcaaaggcctctgcagagactgtctacaatgccgcactagctcttggcattgccaaccaactgacgaacattctcagagatgtaggagaagacgcgaggagggggagaatataccttccactggacgaattggcacaagcgggactgacagaagaggacatattcagagggaaagtgaccgataaatggaggagattcatgaaaggccaaattcagcgcgccaggttgttctttgatgaggccgaggaaggcgtcatgcatctagactccgcgagcagatggccggttctagcatcgttatggctgtacaggcagatcctggatgccatcgaagcaaacgactacaacaacttcaccaagcgtgcttatgtaggcaaggcgaagaagctactgtccttaccggtcgcatatgcgagggcggctgtttcatcatgagcaaagcaattcctagatcagattttctttttccttcttccctttctccatgcatttattttttacttccgttgttgtatatataagtcagctggctgtttgccataggcctgccacagtatttagttcaaggggctgattctaggtccaacagcactgaacccttgtttatcgacacggaggagaatcaaatcaaatcaaatcacaattcaagaaccatcactttttcaggagagaagaaccatagttaggactcagtcatagttcacctgcgttgtacaagctttcttgttacatatacatcaaagtcctggcatagccaagccaacatcagtgaaaccatagatgagtagtgctccagccttttttatgtccagatgctgttatatatacatatgactaatgagttaatcacggagtcgtcaataaaccgtcttaatcttgagtttgtgaactgatcgatggtgatcttggcaagtgatggccaactgtggcatctggtgatgaactctgaagaattgatgtggtatcttgtgatagaaactctgaagaatgagagccacatgtctcctcctagctgcaggctgcagcaccactagtgaggcctgaagtgtgtgtgaaccacaacagcctgtgatgatatgggttggataggtagagggtacggtatatgctactggaggagtgctagcaaacatgggacaaaaagagaaaagggagaagccgaactgccttttggttccgttcgctgtcatgttgattttgctgtgctggtgacttgtatgtgtattatctgctgttgtctggttgtccatgtctgggcacaccgtgcaaaattggattatcgttcgattttcttttttt

SEQ ID NO: 2287 - DNA, 1518 bp, Oryza sativa
ttccacacgaacacacaaccccaaccattcgacccgcgcagcgagccccaaccccacatcgccgcgcgcccccgatggcgtcctcctcgtcggcggcggcgctctggacggcggcgccccacccccacggcagctgcatcaggatccacgccatcttccaccagcgtcaccagcggagggggaggaggccggtcgtcgtcgcctcgtcggtgaggccgctgcaggccgcgagcctggcggtggccacggcgccggtggccgtggcgtcgaggaggacggcggcggaggaggccgtctacgaggtcgtgctgcggcaggcggcgctggtggaggaggccacccaccgccgcggcgcgggggcgccgcggtgggcggaggaggacgccgtcgactggggcctcctcctcggcgacgcctaccaccgctgcggcgaggtctgcgccgagtacgccaagaccttctacctaggtactcagcttatgactcctgaaaggcgcaaagctgtctgggcaatctatgtatggtgcagaagaactgatgaactggtagatggccctaactcgtcttacattacaccaaaggcacttgatcgatgggagaagagattagaagatctcttcgaaggcaggccatatgatatgtatgatgcagccctctcggacacagtgtcaaagtttccagtagatatccagccattcaaagacatgattgaaggaatgaggcttgacctgtggaaatcaaggtataggagctttgatgagctctacctctactgctactacgttgctggcacggttggtctcatgacagtaccggtgatggggattgcccccgactcgaaggcctcaaccgagagcgtgtacaacgctgcgctagctcttgggatcgccaaccagctgacgaatattctcagagacgtaggcgaagactcaaggaggggaagaatctaccttccattggatgaattggcagaggcaggtctgacagaagaagacatattcagagggaaagtgactgataaatggaggaagttcatgaagggacaaattctgcgtgccaggttattctttgatgaggcggagaagggcgttgcgcatctagactctgcgagtagatggccggttctggcatctttgtggttataccggcagatccttgatgctatcgaagcaaacgactacaacaacttcaccaagcgcgcgtatgtaaacaaggcaaagaagctgctgtctttaccggtcgcttatgcaagagcggcagttgcatcatgaacaatcactagatcagatgccttattattttttttctttcattttcttttcttttgatttcgcacgatttcttggctgttgtatatattcaagcagctacctgtatgccataagcctgccacagtttttctttagttcaagggactgatttcaggtccctcaatactcaactcttgttagaaacaaatacagagggggtaagccccacagttcaagaagcatattactcttcatttgtcttcaagaa

SEQ ID NO: 2288 - DNA, 1453 bp, Hordeum vulgare
aacccaacccagctcgcctctctctctcgtcccaccaaaaccaatccgcacatcggagcgagcatcgccgggccaccgcggcgggttgatggcgggatcctccgccgtgtacgcgtcgtgcaggccgcacgcgcgcgcgggcttcttccacccccacccggcggaccaggcccagcggggcgggctgctgctcccggccgcggcgtcggcgtggaggaggggcggcgcgggggcgccgagggcgagcctggtggcggcgcggacggcgacggaggaggcggtgtacgaggtggtgctgcggcaggcggcgctggtgggggacctgcaggggcggcgccgggaggcccgccggtggcgcgacgagcagatggagcaggagggcgacgccgagctcggctggggcctcctcggcgacgcctacgaccgctgcggcgaggtctgcgccgagtacgccaagacattctacctcggcacacagcttatgactcctgaaaggcgcaaagctgtttgggcaatctatgtatggtgcaggaggaccgatgagttagtggatggccctaacgcgtcttacatcacacccaaggcgctcgatcggtgggagaagagattagaggatctcttcgaaggccgcccatatgacatgtacgacgcggccctctcagacacagcgtcgaagtttccaattgatatccagccattcagagatatgattgaagggatgaggcttgacctgtggaaatcgaggtataggacctttgacgagctttacctctactgctattacgtcgctggcaccgtcggtctcatgacggtaccggtgatggggattgctccggactcaaaggcctcagcagagagcgtgtacaatgccgcactggcccttggcattgccaaccagctgacaaacatcctccgagatgtaggagaagactcgaggagggggagaatataccttccactggacgagctggcacaagcgggtctgacagaagaggacatattcagagggaaagtgacggataaatggaggaggttcatgaagggccaaatccagcgcgccaggctcttctttgatgaggccgagaagggcgtcatgcatctagactctgcgagcagatggccggtcctggcatcgctgtggctgtacaggcagatcctggacgccatcgaggcgaacgactacaacaacttcaccaagcgtgcgtatgtgggcaaggcgaagaagttcctgtcgttgccggccgcatatgcgagggcggctctttcaccataagcaaagcgaagcaatcctgtagatcagatgtcttttttttcttttgtcctgtcaccctacaaattttttgttggctgttgtatatattcagctgtgcatgtttgccatacgcccgccacggtatttagctcgaaggaccgatgtcgggtcgcgctgtactcaaacacttgttaccaccac

SEQ ID NO: 2289 - DNA, 1467 bp, Triticum aestivum
gagtgagcggcgagcgcaaccgatggcgggatcctccgccgtgtacacctcctgcaggccgcacgcgcgcgccttccaccaccacccggccgaccaggcccagcggggcggcgggctgcccggcctgctccccgccgcggcgtggaggaggggcggcgcggccgtgccgagggccagcctggtggcggcgcggacggcgacggaggaggcggtgtacgaggtggtgctgcggcaggccgcgctggtggaggacctgcaggggcggcgggaggccgacgccggccggcgccgccgctggcgggacgagcaggtggagcaggagggcgacgccgagctcggctggggcctcctcgacgacgcctacgaccgctgcggcgaggtctgcgccgagtacgccaagaccttctacctcggcacacagcttatgactcctgaaaggcgcaaagccgtttgggcaatctatgtatggtgcaggagaactgatgagctagtggatggccctaactcatcttacatcacgcccaaggcgctcgatcggtgggagaagagattagaggatctcttcgaaggccgcccatatgatatgtatgatgcagccctctcagacacagcgtcaaagtttccaattgatatccagccgttcagagatatgattgaagggatgaggcttgacctttggaaatcgaggtatatgacctttgacgagctttacctctactgctactacgtcgctggcactgtcggtctcatgacggtaccggtgatggggattgctccggactcaaaggcctcagcagagagcgtgtacaatgccgcactggcccttggcattgccaaccagctcacaaacatcctccgagatgtaggagaagactcaagaagggggagaatataccttccactggacgaactggcacaggcgggtctgacagaagaggacatattcagagggaaagtgacggataaatggaggaggttcatgaaggggcaaatccagcgcgccaggctcttctttgatgaggccgagaagggcgtcatgcatctagactccgcgagcagatggccggtcctggcatcgctgtggctgtacaggcagatcctggacgccatcgaggcgaacgactacaacaacttcaccaagcgcgcgtacgtgggcaaggcgaagaagttcctgtctctaccggccgcgtacgcgagggcggctctttcgccatgagcaaagcaaagcaaagcgatcccgtagatcagatgttttttttcttctttttctttcttttgtcctgtcaccctacaatgatttttgttggctgttgtatatattcagctatatgtttgccatacgcccgccgcggtatttaggtcaagggaccgacgtcgggccccgctgtactgaagtctgaaacacttgttgttaccacacagtggagaatcaaaattgctccagttgaatgaagaagaaacaaacac

SEQ ID NO: 2290 - DNA, 1470 bp, Triticum aestivum
tcgcgagcgagcggcgagcgcaaccgatggcgggatcctccgccgtgtacacctcctgcaggccgcacgcgcgcgccttccaccaccacccggccgaccaggcccagcggggcggcgggcagcccggcctgctccccgccgcggcgtggaggaggggcggcgcggccgtgccgagggccagcctggtggcggcgcggacggcgacggaggaggcggtgtacgaggtggtgctgcggcaggccgcgctggtggaggacctgcaggggcggcgggaggccgacgccggccggcgccgccgctggcgggacgagcaggtggagcaggagggcgacgccgagctcggctggggcctcctcgacgacgcctacgaccgctgcggcgaggtctgcgccgagtacgccaagaccttctacctcggcacacagcttatgactcctgaaaggcgcaaagccgtttgggcaatctatgtatggtgcaggagaactgatgagctagtggatggccctaactcatcttacatcacgcccaaggcgctcgatcggtgggagaagagattagaggatctcttcgaaggccgcccatatgatatgtatgatgcagccctctcagatacagcgtcaaagtttccaattgatatccagccattcagagacatgattgaagggatgaggctcgacctttggaaatcgaggtataggacctttgacgagctctacctctactgctactacgtcgctggcactgtcggtctcatgacggtaccggtgatggggattgctccggactcaaaggcctcagcagagagcgtgtacaatgccgcactggcccttggcattgccaaccagctcacaaacatcctccgagacgtaggagaagactcaagaagggggagaatataccttccactggacgaactggcacaggcgggtctgacagaagaggacatattcagagggaaagtgacggataaatggaggaggttcatgaaggggcaaatccagcgcgccaggctcttctttgacgaggccgagaagggcgtcatgcatctagactccgcgagcagatggccggtcctggcatcgctgtggctgtacaggcagatcctggacgccatcgaggccaacgactacaacaacttcaccaagcgcgcgtacgtgggcaaggcaaagaagttcctgtctctaccggccgcgtacgcgagggcggctctctcgccatgagcaaagcaatcccgtagatcagatgttttttcttcttctttttctttctttttgtcctgtcaccctacaatgatttttgttggctgttgtatatactcagctatatgtttgccatacgcccgccgcggtatttaggtcaagggaccgacgtcgggccccgctgtactgaagtctgaaacacttgttgttaccacacagtggagaatcaaaattgctccagttgaatgaagaagaaacaaacactctttct

SEQ ID NO: 2291 - DNA, 1555 bp, Leymus cinereus x Leymus triticoides
  misc_feature (5)..(8): n is a, c, g, or t
  misc_feature (14)..(14): n is a, c, g, or t
  misc_feature (204)..(204): n is a, c, g, or t
  misc_feature (1109)..(1109): n is a, c, g, or t
  misc_feature (1208)..(1208): n is a, c, g, or t
  misc_feature (1214)..(1214): n is a, c, g, or t
  misc_feature (1537)..(1537): n is a, c, g, or t
cacgnnnncaggcngcagctcgcctctctctcgtcccaccaaaatcaatccatccatccatccacccgaggagcatcgccaccaccgccgcgcgcggccgagcccaatccatggcgggatcctccgccgtgtacacgtcctgcaggccgcacgcgcgcgccttcctccacccggtcgaccagacccagcggggcggccagctcngcctgctccccgccgccaccaccgccgcggcctggaggaggggcggcgccgcgccgagggcgagcctggtggcggcgcggacggccacggaggaggcggtgtacgaggtggtgctgcggcaggccgcgctggtggaggacctgcaggggcggcgggcgcgggaggccgaggcgggcaggcgccggtggcgggacgagcagcaggagcaggagggcgacgccgagctcggctggggcctcctcggcgacgcctacgaccgctgcggcgaggtctgcgccgagtacgccaagaccttctacctaggcacacagcttatgactcctgaaaggcgcaaagctgtttgggcaatttatgtatggtgcaggagaactgatgagctagtggatggccctaactcatcttacatcacacccaaggcgctcgatcggtgggagaagagattagaggatctcttcgaaggccgcccatatgatatgtatgacgcagccctctcagacacagcgtcaaagtttccaattgatatccagccattcagagatatgattgaagggatgaggcttgacctgtggaaatcgaggtataggacctttgacgagctttacctctactgctactacgtcgccggcaccgtcggtctcatgacggtaccggtgatggggattgctccggactcaaaggcctcagcagagcgcgtgtacaatgccgcactggcccttggcattgccaaccaactgacaaacatcctccgagatgtaggagaagactcgaggagggggagaatataccttccactggacgaactggcacaggcgggtctgacagaagaggacatattcagagggaaagtgacggataaatggaggaggttcatgaagggccaaatccagcgcgctaggctcttcttngatgaggccgagaagggcgtcatgcatctagactccgcgagcagatggccggtcctggcatcgctgtggctgtacaggcagatcctggacgccatcgangcgaangactacaacaacttcaccaagcgcgcgtacgtgggcaaggcgaagaagttcctgtcgttgccggccgcgtacgcgagggcggctctttcgtcatgagcaaagcaaagcaatcccgtagatcagatgttttttttcttctttttctttctttttgtcctgtcaccctacaaagatttttgctggctgttgtatatattcagctgtatgtttgccatacgcccgccgcggtatttaggtcaagggaccgatgtcgggtcccactgtactgaaacacttgttaccaccacacagtggagaatcaaaattgctccagttgaatgaanaacgaacgacactttcta

SEQ ID NO: 2292 - DNA, 1634 bp, Saccharum officinarum
ccgccagccgccgacactccattactgctctgctctctccactcacaaactcccctgcctcgcccccatccgctagctcgccggcgatggacctgcggcggcgccggctggccgtggcggcggcggtggtggcggtgtgcgccgccacgctgacgccggcggcggaggggttcgacatcctgcagatcctggggaagcacgacgagttctcgcagttctgcaagctgctcaacgagacgcacctggccggcgacatcaaccgggaccggaccatcaccgtgctcgccgtggccaacggcgacatgggccacctcacggggggacactactcgctcggcaccctccgccacatcctcgagctccacgtcgtcgccgactactacgacgacaagaagctcaagcagctgtcgcacgccgccaccgccgcatccaccttgttccagcgatccggatttgcccccggcatggcaggatacgtgaacataacgcagcaccgcggcggcaaggtgtcgttcatcgtggacgacgcggcggacacggtgaagcccgtgacctacgtgaagcagatcgagagccaccggtacgactactcggtgctccaggtgagcggcgtgctgtcgtccccggaggcggaggcgcccgtggccccgccggcgcccgtcaacctcaccgacatcctctccaagaagtactgcaagagcttcgcggggctcctggccgccgaccccaaggtgttcgacaccctcaacggcaccaaggacacggcgctgaccatcttctgtcccgtcgacgcggcggtggcggccttcatgcccaagttcaagaacctgacggccaaggccaagacggccatcctgctgtaccacgccgtgccggactactactccatgcagttcctcaagtccaacaagggcaaggtcaccacgctggccaccaccagcgtcgccaagaaggactacacctacgaggccgagagcaaggaggacaccgtcacgctcgacaccacggtcatcacctccaccatccaggccaccgtcagggacgacgacccgctcgccgtctatgccgtgtccaagttcctgcagcctaaggagctgttcaaggcaaaaacggcagacctagcgcctgcacccgctccagaagcagggccaaagaagaagaagaagaagcctagcagcggctccgccgcctctgcgccttcggacgaatctgcagatggcccgtctgctgatgactcaaccgacgatgcagcggacaaggccgccgctgcgccatcgtccctgttcgcccggtgggtgacgatcgccatggcgctggtgctggtgttggcggcctaaggtgtgcactcatgtgctatgttcttctttaacttattctggaccctatcttattttctttgtccaaattcgtgtcccttccttcttggtgcagaaaataagaagggctatttttatttttatatttattactgcattccataaaaaaagaaaaaattagaggtgtgtgtgagtgatgtaactcttttgattttgttcattgggttgtggtgatcattttgtaatgatagtggccaatggaaatggagagtgggttaagttttcacacatgagtcatcatatgggagttacaggtgc

SEQ ID NO: 2293 - DNA, 1683 bp, Saccharum officinarum
  misc_feature (371)..(371): n is a, c, g, or t
tccatcagtgcagtgctctctccactcacgaactgcccccccccccctccgccagccgccgacactccattactgctctgctctctccactcacaaactcccctgcctcgcccccatccgctagctcgccggcgatggacctgcggcggcgccggctggccgtggcggcggcggtggtggcggtgtgcgccgccacgctgacgccggcggcggaggggttcgacatcctgcagatcctggggaagcacgacgagttctcgcagttctgcaagctgctcaacgagacgcacctggccggcgacatcaaccgggaccggaccatcaccgtgctcgccgtggccaacggcgacatgggccacctcacggggggncactactcgctcggcaccctccgccacatcctcgagctccacgtcgtcgccgactactacgacgacaagaagctcaagcagctgtcgcacgccgccaccgccgcatccaccttgttccagcgatccggatttgcccccggcatggcaggatacgtgaacataacgcagcaccgcggcggcaaggtgtcgttcatcgtggacgacgcggcggacacggtgaagcccgtgacctacgtgaagcagatcgagagccaccggtacgactactcggtgctccaggtgagcggcgtgctgtcgtccccggaggcggaggcgcccgtggccccgccggcgcccgtcaacctcaccgacatcctctccaagaagtactgcaagagcttcgcggggctcctggccgccgaccccaaggtgttcgacaccctcaacggcaccaaggacacggcgctgaccatcttctgtcccgtcgacgcggcggtggcggccttcatgcccaagttcaagaacctgacggccaaggccaagacggccatcctgctgtaccacgccgtgccggactactactccatgcagttcctcaagtccaacaagggcaaggtcaccacgctggccaccaccagcgtcgccaagaaggactacacctacgaggccgagagcaaggaggacaccgtcacgctcgacaccacggtcatcacctccaccatccaggccaccgtcagggacgacgacccgctcgccgtctatgccgtgtccaagttcctgcagcctaaggagctgttcaaggcaaaaacggcagacctagcgcctgcacccgctccagaagcagggccaaagaagaagaagaagaagcctagcagcggctccgccgcctctgcgccttcggacgaatctgcagatggcccgtctgctgatgactcaaccgacgatgcagcggacaaggccgccgctgcgccatcgtccctgttcgcccggtgggtgacgatcgccatggcgctggtgctggtgttggcggcctaaggtgtgcactcatgtgctatgttcttctttaacttattctggaccctatcttattttctttgtccaaattcgtgtcccttccttcttggtgcagaaaataagaagggctatttttatttttatatttattactgcattccataaaaaaagaaaaaattagaggtgtgtgtgagtgatgtaactcttttgattttgttcattgggttgtggtgatcattttgtaatgatagtggccaatgggaatggagagtgggttaagttttcacacatgagtcatcatatgggagttacagggtgc

SEQ ID NO: 2294 - DNA, 1855 bp, Setaria italica
ccgcgtcccccgccagatcttgctggctgcacacggccaggcattacattaccccaccgtccacctgctcgggcatcatcactccgttattgctgtgctctgctctccactcactcccctagctagctcccctcccctagcaaagctcgccgccgacagcagcagcagctagctagccaggccagagcccggagtgatgggcctgcggcggctggccgtggcggcggcggtgctggccgtgtgcgctgccgcggtggaggggttcgacatcctccagatcctggggaagcacgacgagttctcacagttctgcaagctgctcaacgagacgcacctcgccggcgacatcaaccgggaccgcaccatcaccgtgctcgccgtcgccaacggcgacatgggccacctcaccagcgcccactactcgctcgggaccatccgccacatcctcgagctgcacgtcgtcgccgactactacgacgagaagaagctcaagcagctgtcgcacggcgccaccgctgcatcgacccttttccagcgatccgggtttgcccccggcatggcagggtacgtcaacataacgcagcaccgcggcggcaaggtgacgttcatcgtcgatgacgctgctgactccgtgaagcccgtcaccttcgtcaagcagatcgagagccaccgctacgattactcggtgctccaggtcagcagtgtgctgtcctccccggaggccgaggcgcccgtggccccgccggctccggtcaacctcaccgaactcctctccaaaaagtactgcaagagcttcgccggcctcctagctgccgatgccaaagccttcgataccatcaacggaaccaaggacactgcgctcacgctcttctgccctgtcgacgccgccgtggccgccttcatgccaaagttcaagaacctgacggccaaggccaagacggccatcctgctctaccacgccgtgccggactactactccatgcagttcctcaagtccaataaaggcaaggtgaccacgctcgccagcaccagcgttgccaagaaggactacacctacgaagcgcagaccgaggcagacaccgtcacgctcgacaccacggtcaccacctccaccatccaggccaccgtcagggacgatgaccctctcgccatctacgccgtctccaagttcctgcagcccaaggagttgttcaagcccaaaaaagctgaggacctggcgccgtcgcccgcaccggaggtgcccaagaagaagaccaagaagaagcctggaagcacatcggcggccgccgcgccctcggacgacgacagcgctgacggcccagctgccgacgactcagccgacgacgccgcggacaaggccggcgccgcgccatccatgctcacccggtggggcaccgcggctgcgatggtggccgcggcgctggcgttgggggcctaaggtgtgcgctgatgtgttatgtttttcttgtgacttattggaaccctcttcttttctttgtccaattcgtgtcccttgttggtgcagaaaataagaagggccattttactttatttatatatatattgttgctggattcttcagagaagaaggggaaaaaaggaaggcttagaggtgtgtgatgtagctctttggattgtttattgggttgtggtgatcattttgtaatgatagtggtcagtggaatcggatagagtgtgtttacatgtgatactataatgcatcatggagtttagtactccattgtttcgctttcagtctgtccaagttttagctttcggggtcacatgccttgcatattcttttaacccacaaagaaaagttgcaagggtgcaaaggggaccttggcacgtggtg

SEQ ID NO: 2295 - DNA, 1220 bp, Pennisetum glaucum
ggagtcatgggcctgcggcggctggccgtggcggcggcggtgctggccgtgtgcgctgccgcggtggaggggttcgacatcctccagatcctggggaagcacgacgagttctcccagttctgcaagctgctcaacgagacgcacctcgccggcgacatcaaccgggaccgcaccatcaccgtactcgccgttgccaacggcgacatgggccacctcaccggcggccactactcgctcgggaccatccgccacatcctcgagctgcacgtcgtcgccgactactacgacgagaagaagctcaagcagctgtcgcacggcgccaccgccgcatcgacccttttccagcgatccgggtttgcccccggcatggcagggtatgtcaacataacgcagcaccgcggcggcaaggtgacgttcatcgtcgatgatgctgccgactccgtgaagccggtcaccttcgtcaagcagatcgagagccaccgctacgattactcggtgctccaggtcagcagtgtgctgtcctcccccgaggccgaggcgcctgtggccccgccgactccggtcaacctcactgaactcctatccaagaagtactgcaagagctttgccggcctcctagctgccgacgccaaagtctttgacaccatcaacggaaccaaggatacggcgctcacactcttctgccccgtcgatgctgccgtggctgccttcatgccaaagttcaagaacctaacggccaaggccaagacagccatcctgctgtaccacgccgtgccggactactactccatgcagttcctcaagtccaacaaaggcaaggtgaccacgctcgccagcaccagcgctgcgaagaaggactacacctacgaagcggagagtgaggcagatactgtcacgatcgacaccacggtcacaacctccaccatccaggccaccgtcagggacgatgaccctctcgccatctacgccatctccaagttcctgcagcccaaggagctgttcaagcctaaaaaaggtgaggacctggcgccggcgcctgcaccggaggggcccaagaagaagaagaccaagaagaagcccggcagcacatcggcagccgctgcaccctcggacgacgacagcgccgatgggccggctgcagacgactcggccgacgacgccgcagataagactggtgccgccgcgccatccatgctcgcccggtggagcactgtggctgc

SEQ ID NO: 2296 - DNA, 1623 bp, Panicum virgatum
tccattagtgctctgctctccagtcgctcccctcccggcctcccctagctaagaaaagggccaaattaagctcgccgccgacgggagcagcagctactagctagacagagagcccggagtgatggaccttatgaggccgctggccgtggtggtggcgctgctggccgtgtgggccgccgcggcggaggggttcgacatcctccagatcctgggcaagcaggacgagttctcgcagttctgcaagctgctcaacgagacgcacctggccggcgacatcaaccgagaccgcactatcaccgtgctcgccgtggccaacggcgacatgggacacctcaccagcggccactactcgctcgggaccatccgccacatcctcgagctgcacgtcgtcgccgactactacgacgagaagaagctcaagcagctgtcgcacggcgccaccgccgcatccaccttgttccagcgatccgggtttgcccccggcatggcaggttacgtcaacataacgcagcaccgcggcggcaaggtgacatttatcgtcgatgacgcagccgactccgtgaagccggtcacctttgtcaagcagatcgagagccaccgctacgattactcggtgctccaggtcagcagtgtgctctcctcgccggaggccgaggcgcccgtggccccgccggctcccgtcaacctcaccgacctcctctccaagaagtactgcaagagcttcgcgggccttcttgctgccgacgctaaggccttcgacaccatcaacggaaccaaggacaccgcgctgacgctcttttgccctgtcgacgccgccgtggccgccttcttgcccaagttcaagaacctgacggccaaggccaagacggccatcctgctctaccacgccgtgccggactactactccatgcagttcctcaagtccaataaaggcgaggtgaccacgctcgccaccaccagcgtcgccaagaaggactacacctacgaagcgcagaccgaggctgacaccgtcacgctcgacaccacggtcaccacctctaccatccaggccaccgtcagggacgacgacccgctcgccatctacgccgtctccaagttcctgcagcccaaggagctgtttaagtccaaaaccaaggacctcgcgccggcgcccgcgccagagggggccaagaagaagaccaagaagaagcccggcagcacctcgacggctgccgcgccctcaggcgacgaagccgcggacggcccggctgccgacgactcagctgacgacgctgcggacaaggccggcgccgcgccgtctccgctcgtccggtgggtcaccgcggttgcgacggtggcagccgtgctggcgctggtggcctaaggtgtgccctgatgtgttatgttttctttttaacttattggaaccctcttcttttctttgtccaattcgtgtcccttgttggtgcagaaaataagaagggtcattttactttatttttatatttattgctgcattctcatggaaaaggggaaaaaaagaggaaagcttagaggtgtgtcagatcatgtagctctttggattgtggtgatcattttgtaatgatagtgatcaatggaattgaagagtgtgtttatatgtgc

SEQ ID NO: 2297 - DNA, 1358 bp, Zea mays
gactcagtggcacgggcgcggacactgccgctcgcgatatttgcgagagagagagagagagggcccgagagccgaggacgagtgaagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcatgggccggtgctgtgccgcgccatgtccgagggggacctcgccgcgccgctcgtgcccaagaaggacgatggacacgggagggcgccgaggctgtccctgtccgcgtccttgtcctcgtccgcctccatcttcgtcgaggaggaggacggcgagggcgaggaggaggaggacctggtcgcggtcgcgggggccggcgtggacgtgccgctgccgctgcgtcggctgctgacgaacacggggctggacgtgtccgccgccgcggcgctggcgttcgtggagcagggcgtcgggggcagcggcgggggcgggaaggcgtgcggcagcagcggcggcaagggtgggatcggggacggcgacggtggcagcaaccgcgccgccacggacgcccactaccggcagatgatcgaggcggacccgggcaactcgctgctcctggtcaactacgccaggttcctcaaggaggtggccggggacgcggcaagggcgcaggagtactgcgagcgcgccatcctcgccagccccggcgacgccgaggcgctgtcgctctacgcgggcctcgtttgggagaccagccgcgacgctggccgcgccgaggactactacagccgcgccgtccaggccgcgcccgacgactgctacgtcctgggctcttacgccgggttcctgtgggacgccgaggaagacgaggaagagaactccgagcccttgccaccgccttcgctgttccagggggcagctcagcgtccttccatcacagcggcctcttagatgatcgtgaactcgatctagatctcaccaccgcctgtgaacgaagctgaatctggaaccctggagagtggagagtgactgggtgataaccgtgcagaaacccccgacgagtgactcacatcgccggcaggctcctcgccgcttgtgaactgaatcacggcacatgtaaaactgaatctggcagagcacacacgcgcctaagcctattagcgtctatagactttgcagggctatgtatagtagatatgtagattgagaccctgctgaacttgtacgtgcagtatgttcctagtcacttgtgtatcattactagtaatgcagtatccctcgtgaaataaacgtcaaaaccccttcctgctgcttc

SEQ ID NO: 2298 - DNA, 1560 bp, Zea mays
gcgccaagggccggcctagagattcggcccatcgccggtgttctggtggatcacgcgtccttctctccaaccgcaccgaccgatatcttcctctccgctagggcaagggcggtgccggtgaggcgatccgtcggtggtgtcggagcggtggaggaggatggccgacgtgcagggagacaacgaagcagttctggaggacgacgctttccccgacgacgggcccttagatacggaggagggaggtggaggagaacccatcagcggaggcgacgaggaagaggaggaggacgtcgacggcctcgccagcttccttgagtcggagatcctctccggatccagcgacgaggatcctattgacgagcagcggcagcagaaggaggaaggtgatgctgcgaagaataagcggaagcagggttcaggatcggacggggatggctgcagcggcagcgagggggagcagacgaagagggcgaggagggaggagaagaggaggcaggcgaaagggaaagccgtggcgcctcagatcgacacgggcttgttcagcaacgtcccccctgagctgttcctgcagatcttcaagttcctctcctcggaggacctcatctcctgcgctctagtctgccgcttcatgaatgctgccgcgtccgacgagaccctctggcgccgcctgtactgcatgaggtggggactggcctccaatgccaaattcagggagtgcgcttggaagaacctctacatacagagagatagagaggatatggttgaatttgtgaggaatactcctacagagttcaaggagtactatattcagatgcaggctgcaaaaaggagtcaagctccccgtccgtcagaagtcaacgacgacaaggttatgcttgataagacagtagctgaccaggtatctagttggaaaaacagccgggggcttactgatgaagctgtcaaggggcactcttgttctggaaatacatgctcgtacacccagattggtgatgcttacatttgtgagaagactggtcgtgtccacgtttgtgatgacgcttgtcgtgaatttgtcttggaccaatctagtgggctgcttctttgtacgatatctggccactgctttgagaggtggctgtgtcctgatgatgaatgggatgctgatgataccgatctgcaacaggctggtgtagtggatgaagcagagccattcatgggatctggacgttacgcacgggcgattatgttgggctacaactgcactgatgagaaggagcttgaggatgccttgcgtttctgttgacgtgtttctgtcgatatgcccttcactcttgatcaagtgaagacgaagccagcggggatatgccggatgtatagctctgtgctatgttttcactgtatttcaccctcgagcatgtacctaagaatagaaggatgtacctaagaatagaacttgtttttgaggtagatcgctgatatgttttgatcagcagagggagccgttatgttgtcgtatgatttcataaattatgcctgtaataaaatataatttacataatgagttttttgtttgtatga

SEQ ID NO: 2299 - DNA, 1482 bp, Saccharum officinarum
ggcggtgaggcgatccgtcggcggcgtcgggggcggtggaggaggatggccgacgtgcagggagacaaggaggcaggcctggaggacgacgatttccccgacgacggtcctttggatccggaggagccaggtgaaggaggagaaccccgcagcggaggcgacgaggaagaggaggacgacgtcgacggcctcgccagcttcctcgagtcggagatcctctccggatccagcgaccaggatcctattgaccaggagcagcggcagcaggaggaggacggtgatgccgcgaagaataagcggaagcagggctcgggaccggacggggatggctgcagcggcagctgcagcgagggggagcagaccaagagggcgaggagggaggagatgaggaggcaggcgaaaggtaaggccgtggcgcctcagatcgacacgggcatgttcagcaacatcccccctgagctgttcctgcagatcttcaagttcctctcttccgaggacctcatctcctgcgctctagtctgccgcttcatgaatgctgccgcgtccgatgagaccctctggcgccgcctgtactgcatgaggtggggactggcctccaatgccaaattcagggagtgtgcttggaagaacctctacatacagagagatagagaggatatggttgaatttgtgaggaataccccgacagagttcaaggagtactatattcagatgcaggctgcaaaaaggagtcaagttccccgtccatcagaagtcaatgacgacaaggttatgcttgataagacggtagctgatcaggtatctagttggaaaaacagccgggggcttactgatgaagctgtcaaggggcactcttgttctggaaatacatgttcctacacccagattggtgatgcttacatttgtgagaagactggtcgtgtccacgtttgtgatgacgcttgtcgtgaatttgtcttggaccaatctagtgggctgcttctttgtacgatatctggccactgctttgagaggtggctgtgtcctgatgatgaatgggatgccgatgatacttttcaggatatgcaacaggctggtgtagcggatgaagcatagccattcatgggatctggacgttacgcgcgagcgattatgttgggttacaactgcactgatgagaaggaacttgaggatgccttgggtctctgttgatgtgtttctgttgatatgtccttcactcttgctacattcaagcttttctacttgtgaagatgagacaagcgggaatgcgggatgtacagctgtgtgctatgttttaccatatttcaccctccagaatgtacctaagaatagaacttttgaggtagatcgctgatatgttttgatcagctgagggagctgttatgttgtatggtttcctaaattatcgagatgtatgcctgtaataaaatattgtttacatgatgagttttttgtttgtatgatatgatgttgatatactgt

SEQ ID NO: 2300 - DNA, 1536 bp, Saccharum officinarum
  misc_feature (46)..(46): n is a, c, g, or t
  misc_feature (1037)..(1037): n is a, c, g, or t
  misc_feature (1114)..(1114): n is a, c, g, or t
  misc_feature (1136)..(1137): n is a, c, g, or t
  misc_feature (1139)..(1139): n is a, c, g, or t
  misc_feature (1185)..(1185): n is a, c, g, or t
  misc_feature (1189)..(1190): n is a, c, g, or t
  misc_feature (1193)..(1193): n is a, c, g, or t
gatcacgcgtcttctcctccaaccgcaccgatatcttcctctcccntagggcaagggcggtgaggcgatccgtcggcggcgtcgggggcggtggaggaggatggccgacgtgcagggagacaaggaggcaggcctggaggacgacgatttccccgacgacggtcctttggatccggaggagccaggtgaaggaggagaaccccgcagcggaggcgacgaggaagaggaggacgacgtcgacggcctcgccagcttcctcgagtcggagatcctctccggatccagcgaccaggatcctattgaccaggagcagcggcagcaggaggaggacggtgatgccgcgaagaataagcggaagcagggctcgggaccggacggggatggctgcagcggcagctgcagcgagggggagcagaccaagagggcgaggagggaggagatgaggaggcaggcgaaaggtaaggccgtggcgcctcagatcgacacgggcatgttcagcaacatcccccctgagctgttcctgcagatcttcaagttcctctcttccgaggacctcatctcctgcgctctagtctgccgcttcatgaatgctgccgcgtccgatgagaccctctggcgccgcctgtactgcatgaggtggggactggcctccaatgccaaattcagggagtgtgcttggaagaacctctacatacagagagatagagaggatatggttgaatttgtgaggaataccccgacagagttcaaggagtactatattcagatgcaggctgcaaaaaggagtcaagttccccgtccatcagaagtcaatgacgacaaggttatgcttgataagacggtagctgatcaggtatctagttggaaaaacagccgggggcttactgatgaagctgtcaaggggcactcttgttctggaaatacatgttcctacacccagattggtgatgcttacatttgtgagaagactggtcgtgtccacgtttgtgatgacgcttgtcgtgaatttgtcttggaccaatctagtgggctgcttntttgtacgatatctggccactgctttgagaggtggctgtgtcctgatgatgaatgggatgccgatgatacttttcangatatgcaacaggctggtgtanngnatgaagcatagccattcatgggatctggacgttacgcgcgagcgantatnntgngttacaactgcactgatgagaaggaacttgaggatgccttgggtctctgttgatgtgtttctgttgatatgtccttcactcttgctacattcaagcttttctacttgtgaagatgagacaagcgggaatgcgggatgtacagctgtgtgctatgttttaccatatttcaccctccagaatgtacctaagaatagaacttttgaggtagatcgctgatatgttttgatcagctgagggagctgttatgttgtatggtttcctaaattatcgagatgtatgcctgtaataaaatattgtttacatgatgagtttttgtttgtatgatatgatgttgatatactgt

SEQ ID NO: 2301 - DNA, 1508 bp, Panicum virgatum
cttcctctcgctagggtaagggaggggagcggcgatccgtcggcggcggcgagggcggtggagcagcatggccggcgtgcagggcgacgagtcgggcctggaggacgaccctttccccgaggaagggcctgtggatctggaagagggaggtgaaggagaaatcggcggcggaggcgacgaggaggaggaggacgtcgccggcctcgccagcttcctcgaatcggagatactgtccggatccatcgccgaggatgctatcgataaaggaggaggaggaggaaggtgatattgcgaagaacaagcggaagcaggactcgggatctgacggagatggtggcaacggcagtggcagcgaggagggggagcagaacaagaggatgaggagggaggagaggagaaggcaggcgaaagggaaagccgtggcgcctcagatcgacacgggcatgttcagcagtataccgccggagctgttcctgcagatcttcaaattcctctcctccgaggacctcatctcctgcgcgctggtttgccgtttcatgaatgctgccgcgtccgacgagaccctctggcgccgcctgtattgcatgaggtggggactggcctccaatgccaaattcagggagtgcgcatggaagaacctctacatacagcgagatagagaggatatggttgaatttgtgaggaatacccctacagagttcagggagtactatattcagatgcaggcatcaaaaaggagtcaagctccccttccttcagaagtcaacgatgacaaggttatccttgataaaaccatagctgatcaggtgtctacctggaaaagcagcagagggcttactgatgaatcagtcaaggggcactcttgttctggaaacacatgctcttacacccagattggtgatgcttacatttgtgagaagacaggtcgtgtccacgtttgtgatgatgcttgtcgtgaatttgtcttggaccaatctagtgggctgcttctttgtacgatatctgggcactgctttgagaggtggctgtgtcctgatgatgaatgggacgctgatgatactgatcagcaacaaggtggtgttgttgatgaaccagagccgttcatgggatctggacgattcgcccgggcaattatgttgggttacaactgcactgatgagaaggaacttgagcaggccttgcgtttctgttgatatgccttgcattactgatttactgtcagaatgcccttcaactcttggaacatgagatcaagcttgtacttgtgatgaggaaataagcagaatgtaactctgtgtgttatcatatttaccttccagaatgtataaaggatggaactcctgcgcaagtgctaatacttgttgagttagattgctcatctgttttgatcagttgagggagctgtaatgttgttgtatagtttcctaagctatcgagatgtatgcatgtaataaaattataattgcaatgatgagccttttgtttatatgagaaacaagaagaacaga

SEQ ID NO: 2302 - DNA, 1735 bp, Setaria italica
cacgggccgggcttgagattcggcccaccttcccgcgttctggtggctcacgcgtccggcgtcctccaaccgcaccgatatcttcctctgctagggtaagggaagagcggcgatccgtcggcggcggctaggtggaggcggtggaggagcatggccgacgtgcagggcgacgaggcgggcctggaggacgaccctccccccgaggaagggcttgtggatccggatgagggagttgaagccgatgtcggcggcggaggcgacgaggatgaggaggacgtcgacggcctcgccagcttcctcgagtcggagatactgtccggatccagcgcggaggatcctattgataagcagcagcaggaggaaggtgatgcggtgaagaataagcggaagcaggagtcgggatcggacggagatggtggtaacggcagtggcagcggcagcggcagcagcagcgatggggagcagaacaagagggcgaggagggaggagaagagaaggcaggccaaagggaaattcgtggcggtggcgcctcagatcgacacgggcatgttcagcagtatccccccggagctgttcctgcagatcttcaagttcctctcctccgaggacctcatctcctgcgcgctagtttgccgcttcatgaacgctgctgcatccgacgagaccctctggcgccgcctgtattgcatgaggtggggactggcctccaatgccaaattcagggagcgcgcttggaagaacctctacatacagcgagatagagaggatatggttgaatttgtgaggaatacacctacagagttcagggagtactatattcagatgcaagcggcaaaaaggagtcaagctccccttccttcagaagtcaacgacgacaaggttatccttgataaaacagtagctgatcaggtgtctacttggaaaagcagcagagggcttactgatgaatcagtcaaggggcactcttgttctggaaatacatgctcttacacccagattggtgatgcttacatttgtgagaagactggtcgtgtccatgtttgtgatgatgcttgccgtgaattcgtcttggaccagtctagtgggctgcttctttgtacgatatctgggcactgctttgagaggtggctgtgtcctgatgatgaatgggacgctgatgatactgatcagcaacaaggtggtgtagctgatgaaccagagccgttcatgggatctggacgattcgcccgggcgattatgttgggttacaactgcagtgatgagaaggaactcgagcatgccttgcgtttctgttgatatgccttttgtttctgtcggaatgccctcccctcttaggtactacatgaggtcagagacttctacttgtgaagaggaaataagcagaatgcagccctgtgctgtgcgttatcatgtttaccctccagaatgtatctaagaatggaactcctgcgctagtaccagtacttgagctagattgctgatctgttttgatcagctgagggagctgtaatgttgttgtatagtttccctttcctaagctatcgagatgtatgtctgtaataaaataatggttgcagtaatgagccttttatttgtatgatattggtatatcggcatatgcgtgaagcatactggtgcttcatgagtttaacttctcactggtgatgtgggagggcatgacttgctgaaaaatagctaaaatgtagtacatcaagcacgaatggcttcattttcc

SEQ ID NO: 2303 - DNA, 1588 bp, Pennisetum glaucum
ttcggcccaccaacccgcgttctggtggctcacgcgttcggcatcctcccaaccgcaccgatatcttcctctgctagggtaagggaagagcggcgatccgtcggcggtggcgaggcggaggcggtggaggagcatggccaacgtgcagggcgacgaggcgggtctggaggacgacctttcccccgaggaagggcctgtggatccggaagatggagttgaagccgatgtcgacggcggaggcgacgaggatgaggaggaggacgtcgacggcctcgctagcttcctcgagtcggagatactgtccggatccagcgcggaggatactattgacaagcaacaggaggaggaggagggtgatgcggcgaagaataagcggaagcaagagtccggatcggacggagatggtggtaacggcagcggcagcgacggggagcagaacaagagggcgaggagggaggagagaaggcaggccaaagggaaagctgtggcggtggcgcctcagatcgacacgggcatgttcagcagtgtcccaccggagctgttcctgcagatcttcaaattcctctcctccgaggacctcatctcctgcgcactagtttgccgcttcatgaatgctgctgcatccgacgagaccctctggcgtcgcctgtattgcatgaggtggggactggcctccaatgccaaattcagggagtgtgcttggaagaacctctacatacagcgagatagagaggatatggttgattttgtgagggatacccctacagagttcagggagtactatattcagatgcaggcatctaaaaggagtcaagctccccttccttcagaagtcaacgacgacaaggttatccttgataaaacggtagctgatcaggtgtctacttggaaaagcagcagagggcttactgatgaatcagtcaaggggcactcttgttctggaaatacatgctcttacacccagattggtgatgcttacatttgtgagaagactggtcgtgtccatgtttgtgatgatgcttgccgtgaattcgtctatgaccagtctagtgggatgcttctttgtacgatatctgggcactgctttgagaggtggctgtgtcctgatgatgaatgggatgttgatgatactgatcagcaacaaggtggtgtagctgatgaaccagagccgttcatgggatctggacgattcgcacgagcgattatgttgggttacaactgcagtgatgagaaggaactcgagcatgctttgcgtttctgttgatatgccttgcatctttgttggaatgtcctcccctcttaggcatgaggtcagagacttctaagcagaatgcagctctgtgctgtgtgttatcttcatcctccataatgtatctaagaatggaactcatgcgctagtaccaatacctgttgagctagattgccgatctgttttgatcagctgagggagctgtaatgttgtatagtttccttttcctaagctatcgaggtgtatgtctaataaattaatgtctgcaataatgtgccttttgtatttgtatgatactggtatgttggtaaatgcatgaagcctactggtgcttcaatt

SEQ ID NO: 2304 - DNA, 1145 bp, Hordeum vulgare
accagcaaatgatgccacggcaaccagctgcgtgaccggcaccacatcttttcctgtgctatgcctccactgcccaatcatggacatggactatcctcctcgctaccctggccaaccgagcggagtgtgcagtgacgacggcatccccgtcgtcgacttggccgtcctcgtcaacggcgatgcctgggaacgggcgcaggcgatccggcacctcggccgggcgtgccaagactggggcttcttcatggtgaccaaccatggggtgccggagactctccagagcgcgatgatggacgcgtgcagggagctgttcagcctgccgccggagcagaagcaggagcacctggacgccggcccgatggaccccgtgcgcgtcggcacgggcttcaactccgccgtcgacggcgccaggtactggcgggactacgtcaagatgttcgcgcaccctgagctccactgccccgccaaacccgaaagcctgcgtggcgtggccgcggagtacgcggcgtgcacgaggggcctgctgctggagctcacggcggccatctccgagagcctggggctcgagggcggcctcattgctcagcgcctggacctggcatccggcctccagatcctcgtcggcaaccattacccgccgtgcggtggtggcccaggcgacgatggggccgtcggtttgccggctcactctgaccacgggctccttactctggtctttccaaaacggggttgattggcctttaggtcaagacacgacggccgttggctcctcgccaaacccatccctgggtccttcttcgtcatcgccggcgatcagctggagatcgtgagcaccggaaggtacaagggcgtgctccaccgcgcactggtcgaccgcgagcaggtgaggatgtcgtgcgtgaccctcatcggaccgtgcctggacgccgtcgtcgaacccgtcccggagctggcagcgccaccactgggcctggagttcaggggggtaaagtacagggactacatggaacaccagcagagcaacaagctcaacgagaagggagcgctggacctcgtgcgggttgcaacggcagatacttactcaccagcccatatattcttcaattaactgagcatgattccggaggttaaaatcctgaagattc

SEQ ID NO: 2305 - DNA, 2333 bp, Panicum virgatum
gaaggcgccaaaccaattccccaagcgcggcaccagctccgcgccccgcgcctaccccctccggcctccgccgtcgccgcgcccctcgccgcctcgcgccggcggggcccccctcccgcccgcccgccaccgcccccgcgcgcggcgtcgacgcgtcggcgccccgcctcggaaggctgctccgtgcccgcgtcgaatcgaggtcagatcataaggcccaaatgcctctcttcaataggaaacctttctccttactggagccccctaaggacttggattcaaaggagaaggtgttccaaattcgcttcacaaaggagatattccgagattatcaagaatatctaaagaggctaaacctctatcgccaaagagtttggacatgtaagatgtctgggaaatctaatttaactttcgaagaagctttggtgtctgagcataatgcgatggagaaggctcaaaatatgccaactgagctgatggcttatgttcttcggatgattcagtatagcactcttggcttacatgagcttgtcaacaagatttatgctagtctgctggaagaagtatttgaaggaatagagttacattctaaaaaggatggttctgtggtaccttgcaagattttgaagattctatattctgatggcacaaagatgtgtgaagtgggttggctttgtcgagacaagacattgatcaacacatcagtagtcaaagctgtggatctcttctaccggagagcgcctgttagcaggaatacactgaagctttttattagggattcaacaacacagactatcccgtgggttatacatgagaatctcgccaaaaaatatgggatacctactgatccccctaacgatatgatgcattatgaaggtttgcacaagaaaggtagaaaaagagaagagaatggaactattgaaaatgggagaaaaaagatgaagaaagatgaaggacatgtgccaattaagtatccaatcgacgatctgttagtaaggcccgatggagatgatccagctttatctaaaagacctcctctggctacagattttagagtcccaagatgttctgtgggcgatctccttatggtatgggacttctgcttgtcttttggaagggttctgaatctgtccccatttctgctaacagatatggagaatgcaatttgccacaaagaaagcaatgttcttgttgtggaaatacatgcatccatgtttcacttgctcattaaggacaaaggtgactatttcactgtcctgcagaacaagaaacggaagttaaaggtaagtttagtaacatgggctgaatatctatgtgacttcttggaaatgacaaaaaatgaagaactattgagtaacattgcaacaataagaaggggttattatggtcatattgacactgatataaagcttaagatcctccatgagctagtggaagaggctattaaaacctctgccataagagagatactaagtgagcgggcggaccagaaacaagcccttaatgcaacaagaagagagagtattagaaagggcagagaagaacaaaacttgaacactgaaattgccatgaaaaatgaagagagccagacagatgccgtgaaagatggcaatgagactattgatgagctggctaggggaaaagaagaaaaggagaagagcaatgtttctcgaagcaagacagaaggcaaacgacatctggtacgccatgttgagatggagtttgataaactatccatccgttctagccctcttggtaaagacagacactacaataggtactggtttttcaggcgtgaaggaaggctttttgttgaaagtgcagattctagagaatggggttattacagctccaaggaagagcttgatgcactcatgggttcgttgaatgtgaaaggtataagggagagagctctgaaacggcagctagagaagttctataataagataagtaacgccttggagaagcgaacaaaagatattgtaaacaagatgttacttgaagagggcgtgctgcgccgctccacgcgagtccgagcacagccgaaggataacccttccatggcgttcctcaagtacgtcaacaaatggaaggataactgacctgcttcaagttgacagtgtatctcaaaataagatggcagtcttaactcggtcggctggaagaactgagcaacccaggtgataggtttggccgtacgccggtacccgtaccgccgtagtaagttatgtaggcttgcgattccccgtggctggtcaatcgcgtcctcgctagctccgatttttcctttccttttctgttttgaacattgattcgcaaatgaaaacacttct

SEQ ID NO: 2306 - DNA, 2098 bp, Triticum aestivum
  misc_feature (22)..(22): n is a, c, g, or t
  misc_feature (25)..(25): n is a, c, g, or t
  misc_feature (57)..(57): n is a, c, g, or t
  misc_feature (110)..(110): n is a, c, g, or t
  misc_feature (178)..(178): n is a, c, g, or t
  misc_feature (545)..(545): n is a, c, g, or t
  misc_feature (1640)..(1640): n is a, c, g, or t
ctgtttctattgtacagctcgnttngatgggcccaattgcacagatcaaccttcaantacacccttacttggttttaccggttgatgcgggttcttttacctcctaaggntcccatttcttgttgggattcagtatcctattatcaaggatccaatccggaggtccttctttcatctnccatcaaccaaccagacagttccagggagcaaatggatgtcatcgtcttggagcggaggaatcggtaggaacaacatacacggctatgttatcatggctgctggtttcggtcaggtggacatgtggattgcactccaccctgatctttcagcagaccagagtattttgatgcaatactgaatggtctggaggtcttcaagctacagaattacggatcaccgaacaatctttctgggctcaatcctccacttccacaaaagccagctgatgccagtcccagcgcggcatctggcaaaatgaaatcggtcgcggccatcataggtggagctgttggtggtttcatagtgctactggccgcgtgttttgncgtttgcatcatctgcaaacgaaagaacaagaagaagaagaagaagaagacatccaaggatcctggtggtaaatctgaagatggtcactggactcctctcaccgagtacagcggatcacgatcagccatgtcgggaaacacggccaccactgggtcgacactgccatccaatctctgccgccacttcactttcgccgaccttcagaccgccaccaagaacttcgaccaagccttcctgctcggcaaaggtgggttcgggaacgtgtacctcggggagatcgacagcggcaccaaggtggcgatcaagcggtgcaacccgatgtcggagcagggcgtccatgagttccagacggagatcgagatgctgtccaagctccggcaccgccacctcgtgtccctcatcggctactgcgaggacaagagcgagatgatcctggtgtacgactacatggcccacggcacgctccgggagcacctctacaacaccaagaacccgccgctgtcgtggaagaagcggctggagatctgcatcggcgccgcccggggcctctactacctgcacaccggcgtgaagcacaccatcatccaccgcgacgtcaagaccaccaacatcctgctggacgacaagtgggtcgccaaggtctccgacttcgggctgtccaagacggggcccaacatggacgccacccacgtcagcaccgtcgtcaagggcagcttcgggtacctcgacccggagtacttccggcggcagcagctctcggagaagtccgacgtctactccttcggcgtcgtgctgttcgaggtgctctgcgcgcgccccgcgctgagcccctcgctgcccaaggagcagatcagcctcgccgactgggcgctgcgctgccagaagcagggcgtgctcggccaggtcatcgacccggtgctccaggggaagatcgcgccccagtgcttcctcaagttcacggacaccgcggagaaatgcgtggccgaccgcagcgtcgacaggccgtccatgggcgacgtcctctggaacctcgagttcgcgctccagctgcaggagagcgaggaggacaccggcagcctcacggaggggacgcngtcgtcgtccggcgcgtcgcccctcgtcatgaccaggctgcagtcggacgagccgtcgacggacgcaagcaccaccacgacgtccacgaccacgatgagcatgacggggcggagcatcgcgagcatggactcggacgggctgaccccgagcgccgttttctcgcagatcatgcatccggatggcaggtgaagttggactgtgacggtccctctgcggattcatggacaacattcttggtccacattcatgttgcaggtgctagtaattactgtagtaattagactgcttattatagtatgatgatacacaccttatggtaattcaggtacggagtcacttattaggactctgtatgtattgtatgtaccggacatcaacgtcattgtaactgtatagatgtcgccgaggcagtggagctgcgcttcttattactacttgctggtcagtctgaatttgg

SEQ ID NO: 2307 - DNA, 2069 bp, Triticum aestivum
ctgtttctattgtacagctcgcttcgatgggcccaattgcacagatcaaccttcaactacacccttacttggttttaccggttgatgcgggttcttttacctcctaaggctcccatttcttgttgggattcagtatcctattatcaaggatccaatccggaggtccttctttcatctcccatcaaccaaccagacagttccagggagcaaatggatgtcatcgtcttggagcggaggaatcggtaggaacaacatacacggctatgttatcatggctgctggtttcggtcaggtggacatgtggattgcactccaccctgatctttcaagcagacccagagtattttgatgcaatactgaatggtctggaggtcttcaagctacagaattacggatcaccgaacaatctttctgggctcaatcctccacttccacaaaagccagctgatgccagtcccagcgcggcatctggcaaaatgaaatcggtcgcggccatcataggtggagctgttggtggtttcatagtgctactggccgcgtgttttgacgtttgcatcatctgcaaacgaaagaacaagaagaagaagaagaagaagacatccaaggatcctggtggtaaatctgaagatggtcactggactcctctcaccgagtacagcggatcacgatcagccatgtcgggaaacacggccaccactgggtcgacactgccatccaatctctgccgccacttcactttcgccgaccttcagaccgccaccaagaacttcgaccaagccttcctgctcggcaaaggtgggttcgggaacgtgtacctcggggagatcgacagcggcaccaaggtggcgatcaagcggtgcaacccgatgtcggagcagggcgtccatgagttccagacggagatcgagatgctgtccaagctccggcaccgccacctcgtgtccctcatcggctactgcgaggacaagagcgagatgatcctggtgtacgactacatggcccacggcacgctccgggagcacctgtacaacaccaagaacccgccgctgtcgtggaagcagcggctggagatctgcatcggcgccgcccgggggctctactacctgcacaccggcgtgaagcacaccatcatccaccgcgacgtcaagaccaccaacatcctgctggacgacaagtgggtcgccaaggtgtccgacttcgggctgtccaagacggggcccaacatggacgccacccacgtcagcaccgtcgtcaagggcagcttcgggtacctggacccggagtacttcaagaggcagcagctcacggaccggtccgacgtctactccttcggcgtggtgctcttcgaggtgctctgcgcgcgcccggcgctgagcccctcgctgcccaaggagcagatcagcctcgccgactgggcgctgcgctgccagaagcagggcgtgctcggccaggtcatcgacccggcgctccaggggaagatcgcgccccagtgcttcctcaagttcacggacaccgcggagaaatgcgtggccgaccgcagcgtcgacaggccgtccatgggcgacgtcctctggaacctcgagttcgcgctccagctgcaggagagcgaggaggacaccggcagcctcacggaggggacgctgtcgtcgtccggcgcgtcgcccctcgtcatgaccaggctgcagtcggacgagccgtcgacggacgcaagcaccaccacgacgtccacgaccacgatgagcatgacggggcggagcatcgcgagcatggactcggacgggctgacgccgagcgccgttttctcgcagatcatgcatccggatggcaggtgaagttggactgtgacagtccctctgcagattcatggacaacattcttggtccacattcatgttgcaggtgctagtaattactgtagtaattagagtgcttatagtatgatgatacacaccttatgataattcaggtacggagtcacttattaggactccgtatgtattgtatgtaccggacatcaacgtcattgtaactgtatagatgtcgccgaggcagtggagctgcgcttcttat

SEQ ID NO: 2308 - DNA, 1319 bp, Avena sativa
cttggtaaaggcgggtttgggaatgtgtatctgggagaaatagatagtggcaccaaggtggcaatcaagcgttgcaacccgatgtccgagcagggtgttcatgagttccagacagagattgagatgctgtccaagctccgccaccgccaccttgtgtccctgatcggctactgcgaggataggagtgagatgattctggtgtatgactatatggcccatggaactctgcgggagcacctgtacaacaccaagaacccaccactctcatggaagcagcgccttgagatctgcattggtgctgcgcgcgggctgtactacctgcacacaggcgtaaaggaaaccatcatccaccgcgacgtcaagacaaccaacattttattggatcataagtgggtcgctaaggtttccgactttgggctgtccaagacaggtccaaacgtggacaacacccatgtgagcacggttgtgaagggcagcttcggataccttgacccagagtacttccgtaggcaacagctgtctgagaaatctgatgtctactcctttggagttgtgctgtttgaggttctgtgtgcgcgccctgccttgagcccctcgcttccgaaagagcaagtgagccttgcagattgggcactccgctgccagaagaaaggcatactcggtcagatcatagacccatgtctccaagggaaaattgctccccagtgcttcataaaatttgcagagaccgccgagaaatgtgtggcagatcacagcattgacaggccgtctatgggtgacgtcctctggaaccttgagtttgcactccagttgcaggagagtgatgtggacagtagcagcagcttcacagaggggacattgtcatcaggtgcatcacctcttgtcatgaccaggctgcagtcagatgaaccgtcgacgggcactactactaccacaacgacgacggtgagcatcactgggcaaagcatcgcgagtgtggagtcggatgggctgacgccaagcaccattttctcacaactcatgcatccagatggcaggtgaagttgcagttgcggtccttgtgcagattcatggtgtatcccagtccgtattcatcattgtataattgccaaatagagtggcatataatctatatacactcactgatgtacctctataagtattgtaccacactatgatgaacacgacgtgcagttcactctacttctcaaaatattcagttatgttcagcctgaccagaatatacaaacaaattgaattggctggttagagtaagctaaaggagtatggatatatttatgatgtaatagatttgcatt

SEQ ID NO: 2309 - DNA, 2955 bp, Brachypodium distachyon
ttagtttgataatcctagtacaccaaccacggcaatgggattcccaattctactagttattatcctcacactattgtctctcatcttgcttgttgtggtggctgataacaattctactgcctctggccacgttgccctaaattgcggagcatccggccaaaacaatgatgataatggtcggacttgggacggggacaccagctccaagttcgcgccattagttaaaggagttacagcccctgcttcataccagcacccttcacttccctccacagtcccttttatgactgcccgcatcttcacttcaaattacacctattccttccctgtcagtgcaggccgcatgtttgtccgcctctacttctatccgattgcttatggaaactatgctgtctctgatgccttcttcagtgtcacaacaagaaacctttccctcttaaatgacttcaacgcttctcaaacagctcaggcgatcaatgttgcctaccttgtccgtgaattctcgttgaatgtttcttcaggcagcctagacctcacatttgctccttcaaaacattggaatggttcttatgcatttgtgaatggcatagagattgtgcccacgcccgacattttcacgacagctgatacaagatttgtcaacggtggtactccagctccgttccaaatcaacactgacagaggcttccagacgatgcaccggctcaatgtcggtggccaagccattccccccaaagatgacttgagcttttatcgctcatgggccaatgattcaccttacatatttggtggttctggagtagctttctccagagataataatttgaccatcaaatacacatccacggttccaaattacactgcgccaattggcgtttatggtacggcacggtcgatggggacaaatgcacaggtcaacttgaactacaaccttacatggattttaccagtcgatgcggggttcttctacctcctaaggtttcatttctgtgagatccagtatcctataaccaaagtgaatcagaggtccttcttcatctacatcaacaaccagacagcacagaggcaaatggatgtcatcgcctggagcggaggaatcggcagaacagcatacacagactatgttatcatcactactggttctggtcaggtggacatgtgggttgcactttaccctgatctttcaagtaaaccagagtattatgatgcaatactgaatggtcttgaagtcttcaagctacaggactatggaaagaacaatcttgctgggctcaatcctccacttccacagaagcctgatgtgaacccgaacgggccgtccagggaagggaattcaagaggtactgtcttggctgccatatgtggagctattgggggttttgcagtgctgcttatatgttttggcgtgtgcatcgcctgcagacgaaacaagaagatatcaaaggattctgataaatctgatgatggctgctggactcctcttgctgattacagcagatcacgatctggcaactcggggaatacggccaccaccgggagccatgcatcactgccatctaatctttgtcgccacttctcatttgctgaagttcaggctgccaccaacaattttgatcaagcctttctccttggcaaaggtggatttgggaatgtgtatcttggagagatagatagcggcaccaagctggcaatcaagcgttgcaacccaatgtctgagcagggtgttcacgagttccaaactgaaattgagatgctgtccaagctccggcaccggcaccttgtgtccctgattggctactgcgaggataagaatgagatgattctggtgtatgactacatggcccatggaaccctgcgggagcatctttacaagaccaagaacccaccactctcatggaagcagcgccttgagatctgcatcggtgctgcccgggggctacactacctgcacacgggcgtaaagcaaaccatcatccaccgcgacgtcaagaccaccaacatcttattggatgacaagtgggttgctaaggtttctgactttgggctgtcgaagacaggtccgaatgtggacaacacccatgtgagcacggttgtgaagggcagcttcggatacctggatcctgagtacttccgtaggcagcagctctctgagaaatctgatgtctactccttcggagttgtgctgtttgaggtcctgtgtgcgcggcctgccttgagcccctcgcttccaaaagagcaagtgaaccttgccgattgggcattgcactgccagaagaaaggcatactcggtcagatcatcgacccactcctccaagggaaaatttctccccaatgctttgtgaaatttgcagagactgcggagaaatgtgtggctgatcacagcattgacaggccttctatgagtgatgtcctgtggaaccttgagtttgtactccagctgcaggagagtgccgaggacaatagcagcctcaccggggggatgtcgtcatcagatgtatcatcgcctctcgtcccgaccagactgcagtcagacgaaccatcgactgagactactaccactaccacggcgagcacaatgagcatcacacaacggagcatcgcgagtgcggagtcggctgggctgaccccaagcaccattttctcacagctcatgaatccagatggcaggtgaaagaaactgaactgcaagctagcgttgcagctcctctgtagtagatctatggtgtatctttttttgaaggaaatctatggtgtatctaattagagtgcttgcttatactagtacatatgtaaatggacacgttatgataattttggctactgagtcatctataccagacatcaatatcgctgtaactgtataggtttctgccttgtactgaagtggggagttatgattcttattacctcctggtccgtcaatctgaaatcgtgtgagaatccatgcaagttatc

SEQ ID NO: 2310 - DNA, 3295 bp, Oryza sativa
atcatccacccctcaactccactacggacccgagctcgatttcccaccatcgttttggccaccgaaacacgcgcagcaactagaaactgccgcggggcgcgcggagtccatctctccctctccgacgccgcgaggtcgacgaggtgaatctacaggattacagctatctggatgtgctttcttcagtaaacaagagtacaatcctccaaactctacattttccttgcctcaaatcccacccagagaaaaggcattatgcaagtgttcccaactcttatagcaaattgatgtgaacgaatcctcaaacttttgatcctgatacaccaaccaccacttcaatgatgcacccaagcctactagctaccatccaatggctcacactgtcagccctcctatcgattgccatggcggctgataacaattccacggcctctgctccaatctttctgaattgtggagcctctggtgtgcaacctgatagctacaatcggagctgggatggggatgctagctccaagtttgcgccatcggtgaaaggcaatgtagccagggcttcataccaagacccttcgctcccatcacccgtgccttacatgactgctcgattcttcacttcaaattacacctattccttccctgtcagcccaggccgcatgttcgtgcgcctacacttctatccaactaattataatgggaaccttgattctgcaaatgcctactttggtgtcacaaccaacaatctgatccttttagacaacttcaacgcatcacaaactgctctggcaacaagctctgcctacttctttcgagaattctcggttaatgtcacttcaagcagcctaaaactcacctttgccccgtccacacgaaacgggtcttatgcatttgtgaatgggattgagattgtgcccacgcctgacatcttcacaacaccgacacctacatctgccaatggcggggacaatgtgcaatatggcatagatcctgtgatgggtctccaaacgatgtaccggctcaatgttgggggacagcccatctctccgcaaggtgattctggattctatcgttcttgggataatgattctccttacatatatggtgctgcctatggggtgaccttctccaaagatggtaatgtcaccatcaaatatccaaatactgagccaaattacactgcaccagttgcagtctacgcaacagcaaggtcaatggggccaactgcacagatcaacctgaactacaatcttacatggatcttaccggttgatgcggggttcacctacctcttgaggttccatttctgtgagatccagtatccaataaccaaggtgaatcagagatcatttttcatttacatcaacaaccagacggcgcagaatcaaatggacgtcattgtttggagtggaggaattggcagaacaacatataccaactatgttgtcacaacggttggttctggccagacggacctgtgggtcgcgcttcaccctgatctttcaagcaaaccagagtattttgatgcaatactaaatggccttgaggtcttcaagctacaggaccttggaagaaataaccttgctgggctcaaccctccacttccaccaaagcctggtgtgaatcccaatgggggatctagtagaggtaaatcaaagagtgttgccccagcagccataggtggagcagtgggtggccttgccgtgttgttgattgcttgtgttggattgtgcatcatctgtagacgaaagaagaaggtagcaaaggatactggcaaatctgatgaaggacgctggactcctctcactgatttcaccaagtcacagtcagccacctcaggaaagacaaccaacacagggagccactcgatgctgccagccaatctttgccggcacttttcgtttgcagaaatccaggctgccaccaacaatttcgacaaatccttcctcctcggcaaaggtggatttggcaacgtttaccttggagagatagacagtggcactagagttgcaatcaagcgtgggaacccgctgtctgagcagggtgtccatgagttccagaatgagattgagatgctgtccaagctccgacaccgtcaccttgtgtctctaatcgggtactgcgaggataggaatgagatgattttggtatatgactacatggctcatgggacacttcgagaacacttgtacaacaccaagaacccaccattgtcgtggaagcagaggctggagatctgcatcggcgccgcccgtgggctgtattacctgcacacgggtgcaaagcaaaccatcatccaccgcgatgtcaagaccaccaacattttgctggatgacaagtgggttgccaaggtttccgacttcgggctgtccaaggccggtccaaacgtggacaacacccatgtgagcacagtggtgaagggcagcttcggataccttgatcctgagtacttccgacggcagcagcttaccgagaaatctgatgtctactccttcggagttgtgctgttcgaggtcctgtgcgcccgcaacgccctgagcccatcacttccgaaggagcaagtgagccttgcagactgggctctgcgttgccagaagaaaggtgttcttggcgagatcattgacccactcctcaaagggaagatcgctccccagtgcttcttgaagttcgccgagaccgcggagaaatgtgtggccgatcgcagcgtcgacaggccgtccatgggtgatgtgctctggaacctcgagtttgcgctccagctgcaggagagcacggaggacagtagcagcctgaccgaggggacgtcagcgagcacgtcgccgctggttgtggccaggctgcattcagatgagccgtcgaccgacgtgactactaccactacaacgacaacttctttgagcatcactgaccgtagcattgcgagcgtggagtctgatgggctgaccccaagcaacatcttctcccagctcatgacaccagatggaagatgaaaatcaaattgcaagctctaatattgctccctagatttgtggtgtgcctcaacagaattcttgtcaggaatagctaattgtatagttatcttacttgctctactagccttgctatgcatcattttgggctaaatatatgtatgttttagttctttagcagatctatgtttctttcaaaatcgcagtaattgtataggtacctctaaattgaagggggttgagattcttacctcctaatgcagttgtaatcttgtaataaaagagcatggaagatatcacccacttatccctttctgagttttgactacata

SEQ ID NO: 2311 - DNA, 3456 bp, Sorghum bicolor
gtagcaatcaaagacccacccgcagaaagctagccagccaaagtgccaaccccccaaacccccattatatctaccactagcactgcgaagtgcgagcgaaactaatcgctcaattcttcgtcgcctccttcattttgccagttgccaccaaatacgccgcggccgctgcctcaccccgctagtccggccgccctcccctcctcgcaagaagcgttcctcctgcctgcatcttggctaggatctgtatatgcctttttcggtgaacaagaactgaaagactactgtcccgaccacccagcaatttgccagattctttcttgcccaaaaccccaaagagaaaaggcccaatgttctgctaagctagagatgttcctagagccagccatcttatcttatagctaaactgctgtaaaaagagccttgtgagacaccaacaatcaaatggcacacccaaccttgtcagctaccctcagatgcctcacactgctatgcatcttggcacttgccgtggcggctgacaacaataccattggctctggccagatacgcttggattgtggagcaacaagcccaacaggcccagatgctgatggccggagctgggacagcgacaccaattccaagtttgcgcctgcactgaaaggaattgcagcaactgcttcataccaggactcttcactaccatccgctacgccttacatgactgctcgcatcttcacctcaaattacacctattcctttcctgttagtcctggctgcatgttcgtgcgcctctacttctatcctaccaattacgttagcaaccatgctgctgcagatgcttactttggtgtcacagccggcaatctgacccttttatatgacttcaatgcctcccaaactgctgcggcagttactccagttagtgtcgccttctttgttcgtgaatactacataaacgttactgaaggcagcctaaacctcactttctccccatccacacaccacaatggctcttatgcattcatcaacgggatcgaaattgtgcccacacctgacctcttcacaacaccaaaaccaacactagtcaatggaggaaacatggatcttgctggaacggggttccaaacaatgtaccggcttaatgtaggaggccaggccatcccaccacaaggagatgttgacttctaccgttcatggggagacgacagtttttacatatatgcttctgattatggtgtgacttttgggaaagacaacaatcttacaatcacgtatacacccagtgtaccaaactacactgcaccatttaatgtctatgcaactgctcgctctatggggccaaatgcccagatcaacctgaaccacaatcttacatggattttacctgttgatgctgggttctactacctcctaaggttccatttctgtgagatccagtatccgataacaaaggtgaatcagaggtcattcttcatctacatcaacaatcagacagcacaacagcaaatggatgtcatcgcgtttagcggaggaattggcaacacagtgtacagagattatgttaccatcacagctggttctggtcagacggatttatgggttgccctccacccagatctttcgacgagacctgagtacttcgatgcaatattgaatggtctggaggtcttcaagctgcagaattatggaaacaatagtcttaatgggctcaaccctccccttccatctgttgaaactaataatgggaaatctagtggcagaaacaaaagttctgtgccggcaatcgttggtggagctgttggtggttttgctgcgctgctcattgcctttattggtgtgtgcatcatctgcagaagaaaggaggtagcaaaggaatctgggaaacccgatgatggccagtggactcctctcactgattacagcaagtcacggtcaaacacctcagggaagacaacaactacagggagccgtacatcaacattgccatctaatctttgccgccacttctcatttggtgaaatccaggcagccaccaataattttgatcaaacctcgctcctcggcaaaggtggttttggaaatgtgtaccttggagagatagatagtggcacaatggtggcaatcaagcgtggtaacccaacgtctgagcagggtgtgcacgagttccagactgagattgagatgttgtcgaagctccgacaccgtcaccttgtgtcgctgattgggtattgcgatgatatgaatgagatgattctagtgtatgattacatggccaatgggactctgagggagcacttgtacaacaccaagaagccagcactctcctggaagaagcggcttgagatatgtatcggtgccgctcggggactgcattacctgcacacaggtgcaaagcataccatcatacacagagatgtcaagaccaccaacattttgttggatgacaaattggttgctaaggtttctgactttgggctgtcaaagactagtccaaatgtcgataacacccatgtgagcacggttgtgaagggaagctttggataccttgaccctgagtacttccgacggcagcagctcactgagaaatctgatgtctactcatttggagtcgtgctgtttgaggtcctctgtgcacgccctgccctgagcccctcgcttccaaaggagcaagtgagcctcgccgactgggcactgcactcccagaagaaaggcattcttgggcagatcatcgacccatatctgcaagggaaaatctctccccaatgtttcatgaagttcgcggagaccgcagagaagtgtgtggctgatcacagcatcgatagaccatctatggccgatgtcctctggaaccttgaatttgcactccagctgcaggagagtgcggaggacagtagcagcgtcaccgacgggacatcttcaaacacgtctccacttaccatcctcaggcttcactcggatgaaccaacgacagacaccaccaccaccacatcaacgagtatgagcatgacaggacggagcctcgcaagtgtggattcagatgggctgaccccaagcagtgtcttctcgcagctcatgcatccaggtggcagatgaaaaccgaaaatagaactgcagcctgcagttaatctcttctgatctgctatatgtttctagtttcatggtatatatatatatgacctactagtatagttatcctatatacatatatattcagcatatagttgcttcatcttaataaaaagtagttcatcctatatgtatgtattgtgccagagcctgcagaaatcactgtaatggcaaggtacttccctttaaattatctgcttaaacatgtacctgaggtatgtttctcacttcaaggccgatttgtaatattcacatatatatgaaagtaaggtgtcaccctttgatttccttgattgtaatctccttaactagtaaatgaattgggagacacagaaggttcaaaactga

SEQ ID NO: 2312 - DNA, 1680 bp, Saccharum officinarum
cttttgaacctagtaatgggaaacctagtgttagaaacaaagattctgtgccggtgccagcaatcattggtggagctgttggtggttttgctgcgctactcattgcctttattggtgtgtgcatcatctgcagaagaaagaaggtagcaaaggaatctgggaaacccgatgatggccagtggactcctctcactgattacagcaagtcacggtcaaacacctcagggaagacaacaactacagggagccgtacgtcaacattgccatctaatctttgccgccacttctctttgggtgaaatccagccagccaccaataattttgatcaaacctcgctcctcggcaaaggtggttttggaaatgtgtaccttggagagatagatagtggcacaatggtggcaatcaagcgtggtaacccgacgtctgagcagggtgtccacgagttccagactgagattgagatgttgtcaaagctccgacaccgtcaccttgtgtcgctgattgggtattgtgatgatatgaatgagatgattctagtgtatgattacatggccaatgggactcttagggagcacttgtacaacaccaagaagccagcactgtcctggaagaagcggcttgagatatgcatcggtgcggctcggggactgcattacctgcacactggtgcgaagcataccatcatacacagagatgtcaagaccaccaacattttgctggatgacaaattggttgctaaggtttcagactttgggctgtcaaagactggtccgaacgtcgataacactcatgtgagcacggttgtgaagggaagctttggatacctcgaccccgagtacttccgacggcagcagctcactgagaaatctgatgtctactcatttggagtcgtgatgtttgaggtcctctgtgcacgccctgctctgagcccctcgcttccaaaggagcaagtgagccttgccgactgggcgctgcactgccagaagaaaggcatccttggccagatcatcgacccacatctgcaagtgaaaatctctccccaatgtttcatgaagttcgtggagactgcagagaagtgcgtggctgatcacagcatcgacagaccatctatggccgatgtcctctggaaccttgaatttgcactccagctgcaggagagcgcggaggacagtagcagcgtcactgacgggacatcttcaaacacatcgccacttatcatccccaggcttcactcggatgaaccactgacggacacaaccactaccacatcatcatcgactatgagcatggcaggacggagcctcgcaagtgtggattcagatggtctgaccccaagcgttgtgttctcgcagctgatgcatccaggtggcagatgaaaaccgaaaatagaactgcagttaatctcttctgatttgctttatgtttccagtttcttggtatatatatgacctactagtatagttatcctctatacatatccagcatatagctccttcatcttaaaaggaattagttcaccctatatgtatgtattgtgccagagcctgcagaaatcactgcaatggctaggtacttccctttaaattatcgtaaacatgtacctgaggtatgttctcacttcaaggccgatttgtaatattcacatatatatatgaaagtaaggtgtcactctttgatttc

SEQ ID NO: 2313 - DNA, 1774 bp, Saccharum officinarum
  misc_feature (894)..(894): n is a, c, g, or t
cttttgaacctagtaatgggaaacctagtgttagaaacaaagattctgtgccggtgccagcaatcattggtggagctgttggtggttttgctgcgctactcattgcctttattggtgtgtgcatcatctgcagaagaaagaaggtagcaaaggaatctgggaaacccgatgatggccagtggactcctctcactgattacagcaagtcacggtcaaacacctcagggaagacaacaactacagggagccgtacgtcaacattgccatctaatctttgccgccacttctctttgggtgaaatccagccagccaccaataattttgatcaaacctcgctcctcggcaaaggtggttttggaaatgtgtaccttggagagatagatagtggcacaatggtggcaatcaagcgtggtaacccgacgtctgagcagggtgtccacgagttccagactgagattgagatgttgtcaaagctccgacaccgtcaccttgtgtcgctgattgggtattgtgatgatatgaatgagatgattctagtgtatgattacatggccaatgggactcttagggagcacttgtacaacaccaagaagccagcactgtcctggaagaagcggcttgagatatgcatcggtgcggctcggggactgcattacctgcacactggtgcgaagcataccatcatacacagagatgtcaagaccaccaacattttgctggatgacaaattggttgctaatgtttcagactttgggctgtcaaagactggtccgaacgtcgataacactcatgtgagcacggttgtgaagggaagctttggatacctcgaccccgagtacttccgacggcagcagctcactgagaaatctgatgtctactcatttggagtcgtgntgtttgaggtcctctgtgcacgccctgctctgagcccctcgcttccaaaggagcaagtgagccttgccgactgggcgctgcactgccagaagaaaggcatccttggccagatcatcgacccacatctgcaagtgaaaatctctccccaatgtttcatgaagttcgtggagactgcagagaagtgcgtggctgatcacagcatcgacagaccatctatggccgatgtcctctggaaccttgaatttgcactccagctgcaggagagcgcggaggacagtagcagcgtcactgacgggacatctttcaaacacatcgccacttatcatccccaggcttcactcggatgaaccactgacggacacaaccactaccacatcatcatcgactatgagcatggcaggacggagcctcgcaagtgtggattcagatggtctgaccccaagcgttgtgttctcgcagctgatgcatccaggtggcagatgaaaaccgaaaatagaactgcagttaatctcttctgatttgctttatgtttccagtttcttggtatatatatgacctactagtatagttatcctctatacatatccagcatatagctccttcatcttaaaaggaattagttcaccctatatgtatgtattgtgccagagcctgcagaaatcactgcaatggctaggtacttccctttaaattatcgtaaacatgtacctgaggtatgttctcacttcaaggccgatttgtaatattcacatatatatatgaaagtaaggtgtcactctttgatttccttgaaaaaaaaaaaagggcggccgatctaaaggggccggccgatctacaggatccaggctaactaacccttccttccaaggtataacttttc

SEQ ID NO: 2314 - DNA, 1888 bp, Pennisetum glaucum
tcaatcagaggtcatctcatctacatcaacaaccagacagcacagcagcaaatggatgtcatcgtgtggagtggaggattcggcagaacagcatacacagactacgttatcatcacacctggttccggtcagatggacttatgggttgcccttcaccctgatctttcatcgagacctgagtactttgacgcaatattgaatggtcttgagatcttcaagatacagaattttggaaataacagtcttaatggactcaaccgtcccattctatctgataaacatgatgggaagcctgctaaaagaaaatcaaaggttgctgcaccagcagccattgttggagctgttggtggctttgttgtactggttgcctctattggtgtgtgcatcatctgcagaagaaataagagggtagcaaaggaatctgtgaaatctgatgatggtcactggactcctctcactgattacagcaagtcgcaatcaaacacctcagggaagataaccaacacagggagccgcgcatcgatgttgccatctaatctttgtcgtcatttctcatttagtgaaatccaggctgcaaccaataattttgatcaaacctcactccttggcaaaggtgggtttgggaatgtgtaccttggagagatagatagtggtacaaaggtggcaataaagcgtggtaacccaatgtcagagcaaggtgttcatgagttccaaactgagattgagatgctgtcaaagcttcgtcaccgccaccttgtgtcattgattgggtattgtgaggatatgaatgagatgattttagtgtatgactacatggccaatggaactttaagggagcatttgtacaacagcaagaaggcacccctctcatggaagagtcggcttgagatctgcatcggtgcagctcggggtctgcattaccttcatacaggtgcaaaacataccatcatacaccgagatgtcaagaccaccaatattttgttggatgacaagttgattgctaaggtttctgactttggcctgtcgaagactggtccgaatgttgataacacccatgtgagcacagttgtgaagggaagctttggatatctcgacccagagtacttccggcggcagcagctcactgagaaatctgatgtctactcgtttggagttgtcctctttgaggtcctctgcgcacggcctgccctgagcccctcacttccgaaggagcaagtgagccttgcagattgggcacttcactgccagaagaagggtagtcttggccagatcattgacccaaatctccaagggaaaatttctccacaatgcttcatgaaatttgctgagaccgcagagaagtgtgtggctgatcacagcattgataggccatatatggctgatgtcctctggaaccttgaatttgcactccagctacaggagagtgcagaggacaatagcggcctcactgacgggacatcatcgaacacatcaccacttatcctgcccagtcatcactcgggtgaaccatggacagacacaaccactaccacatcaacaacaatgagcatgacagggcggagccttgcaagcatggagtcggacgcgctcaccccaagcagtgtcttctcacagctcatgaatccaggtggcaggtgaaagccaaatgtaagcttcaattgcagttaatatcttcagatttgctatgcttttgcagcttcctggtctacgtaactaattagtatatttatcatatatagacatgtccagctcatattatatagaaccggtacatattcttgtcaagccgaaatcactgtaattgtatagctattgccattgccaaggtaccgttttacattatctttgaaaagcttttaagagttatgaatctcacttcaggatcaaa

SEQ ID NO: 2315 - DNA, 1983 bp, Pennisetum glaucum
ctacctcctaaggttccacttctgtgagatccagtatccaataactaaggtcaatcagaggtcattcttcatctacatcaacaaccagacagcacagcagcaaatggatgtcatcgtgtggagtggaggaatcggcagaacagcatacacagactacgttatcatcacacctggttccggtcagatggacttatgggttgcccttcaccctgatctttcatcgagacctgagtactttgacgcaatattgaatggtcttgagatcttcaagatacagaattttggaaataacagtcttaatggactcaaccgtcccattctatctgataaacatgatgggaagcctgctaaaagaaaatcaaaggttgctgcaccagcagccattgttggagctgttggtggctttgttgtactggttgcctctattggtgtgtgcatcatctgcagaagaaataagagggtagcaaaggaatctgtgaaatctgatgatggtcactggactcctctcactgattacagcaagtcgcaatcaaacacctcaggaaagataaccaacacagggagccgcacatcgatgttgccatctaatctttgtcgtcatttctcatttagtgaaatccaggctgcaaccaataattttgatcaaacctcactccttggcaaaggtgggtttgggaatgtgtaccttggagagatagatagtggtacaaaggtggcaataaagcgtggtaacccaatgtcagagcaaggtgttcatgagttccaaactgagattgagatgctgtcaaagcttcgtcaccgccaccttgtgtcattgattgggtattgtgaggatatgaatgagatgattttagtgtatgactacatggccaatggaactttaagggagcatttgtacaacagcaagaaggcacccctctcatggaagagtcggcttgagatctgcatcggtgcagctcggggtctgcattaccttcatacaggtgcaaaacataccatcatacaccgagatgtcaagaccaccaatattttgttggatgacaagttgattgctaaggtttctgactttggcctgtcgaagactggtccgaatgttgataacacccatgtgagcacagttgtgaagggaagctttggatatctcgacccagagtacttccggcggcagcagctcactgagaaatctgatgtctactcgtttggagttgtcctctttgaggtcctctgcgcacggcctgccctgagcccctcacttccgaaggagcaagtgagccttgcagattgggcacttcactgccagaagaagggtagtcttggccagatcattgacccaaatctccaagggaaaatttctccacaatgcttcatgaaatttgctgagaccgcagagaagtgtgtggctgatcacagcattgataggccatatatggctgatgtcctctggaaccttgaatttgcactccagctacaggagagtgcagaggacaatagcggcctcactgacgggacatcatcgaacacatcaccacttatcctgcccagtcatcactcgggtgaaccatggacagacacaaccactaccacatcaacaacaatgagcatgacagggcggagccttgcaagcatggagtcggacgcgctcaccccaagcagtgtcttctcacagctcatgaatccaggtggcaggtgaaagccaaatgtaagcttcaattgcagttaatatcttcagatttgctatgcttttgcagcttcctggtctacgtaactaattagtatatttatcatatatagacatgtccagctcatattatatagaaccggtacatattcttgtcaagccgaaatcactgtaattgtatagctattgccattgccaaggtaccgttttacattatctttgaaaagcttttagagttatgaatctcacttcaggatcaatttgtaaaatgtacatgtgcaagcaaggtaccgctatttagttcc

SEQ ID NO: 2316 - DNA, 2295 bp, Panicum virgatum
gccatgtcccccgcggccaccgcgtgcgccacgccggcggcggcgcgcccgcccttcaacaccgtcccggcccgccgagcgacgccctccgccgcgcgtccgccctccgccgcccccgcacgccgcgccgccgggtgctgcttctgcaccgcggcctcctcggcgtcgtcgccctccacctgggactggacccgatggagccgccacttcgacgaggtcgagcaggccgagagctacgcgtccctcctacagttccagctggaggaggctgtggagaacgaggacttcgccgaggccgccaagctcaagcgggccatcctcgaggccaccggcagcgacgccgttgcccacgtcatggccgagctgaagaatgctatacaggaacagcgttatcaggacgcctcaaggttgtcaaggcttgctggaaccagcttggtaggttggtgggtgggatatgctaaggacactgatgactccattgggagaattgtgcgaataagcactggtgtcgggagatacgtggcaaagagctacagcccaaggcaattggtgactgcatcttctgggactccattattcgaaatttttcttgtcagagaaaatgatgagacatatacaatgaaggtggtacacttgcgaccaacaaaaggaacttcaagtgcatcatccatctcagcgatagctactgaaaggtccagctaaagtggagaatgaaagttcatcagaaagtagtgctatgtctgatagcgttacagaggaagcaaatacagatactacggtaaaaggaagtgaggatgttgaggagaaagaacaagatgttggtagcaacaaggatagtagtgttgaaggattaaaaagtgttttgaattttttcaagtctcggattccagaattcaaagttcaagtaataaatgtagatgtgtctgaggaaactgaattggctgcaaattcatcggaagaattagcgcaagatgatgtgaagagcacatcagaaaactcgttggaagagactaccgctgaggaactcgagcaggaggaagatgtttcagaagaagatatggatgaagaaagtaaaagtacggaggtgaagcttttcatcagtggagtggttcacaacaaagaagatgctggagcaaaatcatatgttcgagttccagctgaaataaataacatggaaaaggactcctttgaactttacatacctggaaaaggttctgatcaagatctggctgaaacaaaggctgcaaaacagaaagttgccgatatggcagccaaattagcatcggagcttatgccatctgatgttgcaaaggcattatggggcacaaccaagagctcttcaaagataaataaagaagttcaggagcttttaaggcttacattaagcaaggcccgagtcaagctgaccgagaataccatttttaatcggatgattacggatactaacagcacagatccatttagtggtctctatgtgggagcatttagtccatatgggccagaaattgtgcagctccgtcggaagttcggccattggaacagtaccgatgatgttgagtttttcgagtacgttgaagcagtaaagttgactggtgatttgagtgtccctgctggccagataacattccgtgctaagattgggaagggaaagcgtcttgagaatcgtggcgcatacccagaggaatttggtgtgattgccagttataaaggtcagggtagaatagcacaacctggattcaaaaatcctcgatgggtggatggtgagctattggtgcttaatggcaagagtacaatcccacaccttggaggtgccgagcttggtttcctgtacagcgtacccgagcagagttttctagttctctttgaccggcttaatcttcctgagtaacgagactgttgaaatctgctgattctcaatgcaaattggatcaacagttgaacacagagggcgcccttagtttcaaagcggttgaacaggtcacctgcggctttttctccgtgggcctccgagcttccctgacatgcatacttcctcttcgccgcacctacttggcaggagctaatctgcccgactctattcagagagtgaggaaagctggccccgttggtctaaaactaacggaagagtcttgatatgatatagcaccatgcttttttagtaccatgttagtatttttgtatgagcgtgacagttttgtgagttttttccccctccgttgctttcattgaggaaggatactaaaataaacaaacccattctgctaataagataataaaacggcctattttatgata

SEQ ID NO: 2317 - DNA, 2396 bp, Sorghum bicolor
acccccgcggccaccgcgtgcgccacgccggcggcggcgcgcccgcccctcaacacggtcccgggccgccgctcgccgcactcggccgcgcgcccgccatcggccacccccgcccgccgcgccgccggctgctgcttctgcgccgccgcctcctcatcctcggcatcgtcggcgccctccacatggggactggacccgatggagccgccacttcgacgaggtcgaacaggccgagagctacgcgtccctcctccagttccagctggaggaggctgtgtagaacgaggatttcgtggaggccgtcaaactcaagagggacattatagaggacaccggaaatgacgccgtagcccacgtgatggccgagctcaagagttctatagaggaccagcggtaccaggacgcctcgaagttgacaaggcttgctgggaccagcttggtaggttggtgggtgggatatgcgaaggacactgatgattccattgggagaatcgtaagaataagccctggtgtcgggagatatgtggccaagagctacagcccaaggcaattggtcactgcatcttcagggactccattatttgaaatttttcttgtcagagaagatgacgagacatatacaatgaaggtggtacacttgcgaccaacaaaaggaacttcaggtgcatcatccatatcatcaacaataacagaaagcccagtgaaggtggagaatgaaagttcatcagaaagtagtgctatatctgatagtattacagaggaagcaaatacagatactccagtaaaaggaaatgaggatgctgaagagaaagagcaagatattggtagcagcaaggatagtagtgttgaaggattgaaaagtgttttgaatttttttaaatctcgaattccggaattcaaagttcaggtgataaatgttgatgtgtctgaggaaactgaattggctgcaaactcgtccgaagaattagtgcaagatgatgtgaagagtactccagaaagctcattggaagagccaaccactgaggaacttgagcaggaagaagatgttccagaagaagatatggatgaagaaagtaaaagtacagaagtgaagctttttattagtggagtggttcacaataaagaagatgctggagcaaaatcatatgttcgagttccagctgaaataaataacatgggaaaagactcttttgagctgtacattcctggaaaaggttctgatcgtgatctgattgaaacaaaggctgcaaaacagaaagttgcagatatggctgctaagttagcctcagagcttatgccgtctgatgttgccaaggcattgtggggtacaaccaagagttcttcaaagataaataaagaagttcaggagcttttaaggcttacgttaagcaaggcccgagtcaagctgaccgagaataccatttttaatcggatcattatggacactaacagcacggatccatttaatggtctctatgtgggagcatttagtccatatggaccagaaattgtgcagctccgtcggaagttcggccactggaatagtactgatgacgttgagtttttcgagtatgtcgaagcagtaaagttgactggtgatctgagtgtccctgctggccagataacgttccgtgcgaagattgggaagggcaagcgacttgagaatcggggcgcgtatcctgaggaattcggtgtggttgctagttataaaggtcagggtagaatagctcagcctggattcaaaaatcctcgatgggtggatggtgagctgttggtgcttagtggcaagagtacaatcccacaccttggaggcgcagagctcggtttcctgtacagcgtacctgagcagagttttctggttctcttcgatcggcttaaccttcccgagtgatgagactactagacggagcagattcctcacatgtagatgcctgccaggccggccccagttccaagtgaccgaacaggtctgcgggcccttttttcgtcgtcctctaggcttcctgagatgcctgccaatcttttctccgctcctactcggctggagctgatctgcttgactcttttcagagtgtgagggaaagctgacctcgttgctggtctaaattaacggatgagccttgatatgttatagcatggtatgctccctaatgacgcagttatagcggtattgggtatgagcatgatagttttgtgagtttttccccccttcatcgttgattacagtaaagctaggatggaaaccaaattaaacaaaatcgttctggtgtgtcgtgatgttacagatataataataaaaccaggcaaataaagtctcatgatttatgatgacccatcaatcaatcggtacgatttccactcttgtaatatggttgagatactttactgctgtccta

SEQ ID NO: 2318 - DNA, 2477 bp, Zea mays
cttcccaatcaaaccgaggccgtcatccttatctgaatcgcgtgctttccagccctctgcccgctgtgccccacccccacgcccggcgacccgcaggccgcacccacccacccacccgcacccagcgccatgtccaccgcggccaccgcgtgcgccacgcgggcggcggcgcgtccgcccctcaacacggctccggcacgccgcgcgccgccttctgccgtgcgcccgccatcggccacccccgcccgccgcgccgccggctgttgcttctgcgccgccgcctcctcggcgtcgtcgccctccacctgggattggacccgatggagccgccacttcgacgaggtcgaccaggcggagagctacgcatccctcctccagttccagctagaggaggcggtggagaacgaggatttcgcggaggccgccaaactcaagagggacatcatagaggccaccggaaacgacgctgtagcccacgtcatggccgagctcaagaatgctatagaggaacagcggtaccaggacgcgtcaaggttgacaaggcttgctgggaccagcttggtaggttggtgggtgggatatgctaaggacactgatgattccatcgggagaattgtacgaataagccctggtgtcgggagatatgtggcgaagagctacaacccaaggcaattggtcactgcatcttcaggaactccattatttgaaattttccttgtcaaagaagatgatgagacatatacaatgaaggtggtacacatgcgaccaacaaaaggaacttcaggtgcaccatccatatcatcaacaataacagaaagcccagcaaaggtagagaatgaaaattcatcagaaagtagtgctatatctgacagtgttacagaggaggcaaatacagatactacggtaagaggaaatgaggatgctgaagagaaagcacaagatgttggtagcagcaaggatagtagtgtcgaaggattaaaaagtgttttgaatttttttaagtctcggattcctgaattcaaagttcaggtgataaatgttgatgtggctgaggaaactgaattagctgcaaattcgtctgaagaattagtgcaagatgatgtgaaaagtactccagaaagctcattggaagagccagccactgaggaactcgagcaggaggaagatgttccggaagaaaatacggatgaagaaagtaaaagcacggaagtgaagctttttattagtggagtggttcacaataaagaagatgctggagcaaaatcatatgttcgagttccagctgaaataaataacatggaaaaggactcctttgaactgtacattcctggagaaggttctgatcgtgatttggctgaaacaaaggctgcaaaacagaaagttgcagatatggctgctaaattagcctcagagcttatgccgtctgatgttgccaaggcattatggggtacagccaagagttcttcaaagataaataaagaagttcaggagcttttaaggcttacgttaagcaaggcccgagtcaagctgaccgaaaataccatttttaaacgaatcattatggacactaacagcacagatccatttaatggtctctatgtgggagcatttagtccatatggaccagaaattgtgcagcttcgtcggaagttcggccactggaacagtactgatgacgttgagtttttcgagtatgtcgaagcagtaaagttgactggtgatctgagtgttcctgctggccagataacgttccgtgctaagattgggaagggcaagcgacttgagaatcgaggagcatatccagaggaatttggtgtgattgccagttacaaaggtcagggtagaatagctcagcctggattcaaaaatcctcgatgggtggatggtgagctgttggtactcaatggcaagagtacaattccacaccttggaggcgcagagctcggtttcctgtatagtgtacctgagcagagttttctggttctcttcgatcggcttaatcttcccgagtgatgagactcctaaagggagcagactcctcacatgtagattgcatgaacgcgcagaggccggccacagctccaagtgaccgaaacaggtctggggggccgttttcccatcgtcttctgccctctgggcttcctgccaatcctttctccgcacctacttggcaggagctcatgtgcttaactcgtttcagagtgtgagggaaagtcgacaccattgctggtctaaactaacggaggagtcttaatactaataatatatatgttatagcatggtagtttgctctccaatgccacagttgtagctgtattgggtatgggcatgacagttttgcgagttttacccgtcatcgttgatttcagtaattaccgaattgaataaaaatcgttctggtgtatcgtgatgttacaattataataatataaaacaaggcaaataaagtctcatgatttatgatcgtttttctcttg

SEQ ID NO: 2319 - DNA, 2476 bp, Zea mays
cttcccaatcaaaccgaggccgtcatccttatctgaatcgcgtgctttccagccctctgcccgctgtgccccacccccacgcccggcgacccgcaggccgcacccacccacccacccgcacccagcgccatgtccaccgcggccaccgcgtgcgccacgcgggcggcggcgcgtccgcccctcaacacggctccggcacgccgcgcgccgccttctgccgtgcgcccgccatcggccacccccgcccgccgcgccgccggctgttgcttctgcgccgccgcctcctcggcgtcgtcgccctccacctgggattggacccgatggagccgccacttcgacgaggtcgaccaggcggagagctacgcatccctcctccagttccagctagaggaggcggtggagaacgaggatttcgcggaggccgccaaactcaagagggacatcatagaggccaccggaaacgacgctgtagcccacgtcatggccgagctcaagaatgctatagaggaacagcggtaccaggacgcgtcaaggttgacaaggcttgctgggaccagcttggtaggttggtgggtgggatatgctaaggacactgatgattccatcgggagaattgtacgaataagccctggtgtcgggagatatgtggcgaagagctacaacccaaggcaattggtcactgcatcttcaggaactccattatttgaaattttccttgtcaaagaagatgatgagacatatacaatgaaggtggtacacatgcgaccaacaaaaggaacttcaggtgcaccatccatatcatcaacaataacagaaagcccagcaaaggtagagaatgaaaattcatcagaaagtagtgctatatctgacagtgttacagaggaggcaaatacagatactacggtaagaggaaatgaggatgctgaagagaaagcacaagatgttggtagcagcaaggatagtagtgtcgaaggattaaaaagtgttttgaatttttttaagtctcggattcctgaattcaaagttcaggtgataaatgttgatgtggctgaggaaactgaattagctgcaaattcgtctgaagaattagtgcaagatgatgtgaaaagtactccagaaagctcattggaagagccagccactgaggaactcgagcaggaggaagatgttccggaagaaaatacggatgaagaaagtaaaagcacggaagtgaagctttttattagtggagtggttcacaataaagaagatgctggagcaaaatcatatgttcgagttccagctgaaataaataacatggaaaaggactcctttgaactgtacattcctggagaaggttctgatcgtgatttggctgaaacaaaggctgcaaaacagaaagttgcagatatggctgctaaattagcctcagagcttatgccgtctgatgttgccaaggcattatggggtacagccaagagttcttcaaagataaataaagaagttcaggagcttttaaggcttacgttaagcaaggcccgagtcaagctgaccgaaaataccatttttaaacgaatcattatggacactaacagcacagatccatttaatggtctctatgtgggagcatttagtccatatggaccagaaattgtgcagcttcgtcggaagttcggccactggaacagtactgatgacgttgagtttttcgagtatgtcgaagcagtaaagttgactggtgatctgagtgttcctgctggccagataacgttccgtgctaagattgggaagggcaagcgacttgagaatcgaggagcatatccagaggaatttggtgtgattgccagttacaaaggtcagggtagaatagctcagcctggattcaaaaatcctcgatgggtggatggtgagctgttggtactcaatggcaagagtacaattccacaccttggaggcgcagagctcggtttcctgtacagtgtacctgagcagagttttctggttctcttcgatcggcttaatcttcccgagtgatgagactcctaaagggagcagactcctcacatgtagattgcatgaacgcgcagaggccggccacagctccaagtgaccgaaacaggtctgggggccgttttcccatcgtcttctgccctctgggcttcctgccaatcctttctccgcacctacttggcaggagctcatgtgcttaactcgtttcagagtgtgagggaaagtcgacaccgttgctggtctaaactaacggaggagtcttaatactaataatatatatgttatagcatggtagtttgctctccaatgccacagttgtagctgtattgggtatgggcatgacagttttgcgagttttacccgtcatcgttgatttcagtaattaccgaattgaataaaaatcgttctggtgtatcgtgatgttacaattataataatataaaacaaggcaaataaagtctcatgatttatgatcgtttttctcttg

SEQ ID NO: 2320 - DNA, 2271 bp, Zea mays
cgctcggcactttccaatcaggccgccgtcctccttatctgaatcgcgtgccttccaggcttccagccctctgcccgctgtgccccacgcccggccccccgatccgacccacccagcgccatgtcccccgcgtgcgccacgccggcggcggcgcgcccgctcaacacggttccgacacgccgctcgccgccctctgccgcgcgcccgccatcggccatccccgcccgccgctccgccggctgctgcttctgcgcctcctcctcatcctcggcatcgtcgccctccacctgggactggacccgatggagccgccacttcgacgaggtcgaccaggccgagagctacgcatccctcctccagttccagctggaggaggcggtggagaacgaggatttcgcggaggccgccaagctcaagagggatatcatagcggccacaggaaacgacgccgtagcccacgtcatggccgaactcaagagtgctatagaggagcagcggtaccaggacgcctcgaggttgacaaggcttgctgggaccagcttggtaggttggtgggtgggatatgctaagggcattgatgattccattgggagaattgtacgaataagccctggtgttggcagatatgtggccaaaagctacagcccgaggcaattggtcactgcatcttcagggaccccattgtttgaaattttccttgtcagagaagatgacaagacatatacaatgaaggtagtacacttgcgaccaacaaaaggaactttaggtgcatcatccatatcatcagcaataacagaaagcccagcaacggtagagacaccagaaagtagtgctatatctgatagtattacagaggaggcaaatatagatactccagtaaaaggaaatggggatgctgaagagaaagagcaagatgttggtagcagcaaggatactagtgttgatggatttaaaagtcttttgaatttttttaagtctcgaattcctgaattcaaagttcaggtgataaatgttgatgtgtctgaggaaactgaattggctgcaaattcgtccgaagaatcagtgcaagacgatgtgaagagtactccagaaggctcattggaagagccaaccactgaggaacttgagcaggaggaggatgttccagaagaagatatggatgaagaaagtaaaagtacgaaagtgaagctttttatcagtggtgtggttcacaataaagaagatgctggaacaaaatcatacgttcgtgttccagctgaaataaataacatggaaaaagactcctttgacctgtacattcctggaaatggttctggtcatgatctgcctgaaacgaaggctgcaaaacagaaagttgcagatatggctgctaaattagcctcagagcttatgccgtctgatgttgccaaggcattatggggtacaaccaagagttcttcaaagataaataaagaagttcaggagcttttaaggcttaccttaagcaaggcccgagtcaagctgaccgatgataccttttttaaccggatcattatggacactaacagcatggatccatttaatggtctctatgtgggagcatttagtccatatggaccagaaattgtgcagctccgtcggaagttcggccactggaatagttccgatgacgttgagtttttcgagtatgtcgaagcagtaaagttgactggtgatctgagtgtccctgctggccagataacattccgtgcgaagattgggaagggcaagcgacttgagaatcggggcgcgtatccagaggaattcggtgtgattgccagttataaaggtcagggtagaatagctcagcctggattcaaaaatcctcgatgggtggatggtgagctgttggtgctcaatggcaagagtacaatcccacaccttggaggcgcagagctcggtttcctgtacagtgtacctgagcagagttttctggttctcttcgatcggcttaaccttcccgagtgttgagactcctaaaaggagcagatttctcacatgtagattgcatgaacgcacagaggctggccccagttccaagtgttcgaacaagtctgtggcctgcgggcccttttttccgtcgtcctctgggctattttgctacctgagattagggatgaaagtggtaatccgaactgttagaacaaatttaatattttaaaatagatatgtataaaatttgatgttgatcttttcttatgttatcaagcacattagtacaaatatgaataaaatattatataagttgtttta

SEQ ID NO: 2321 - DNA, 3032 bp, Triticum aestivum
ccatcagtttcatcgggagaacaatcccggcaacgccgccgcggcgttcatggcccgtctcgcgcccaagccaggattcttcgcgatgcccgttggaccgaggaagacgcgcccatccttgtgccaggggacgtcatcagcatcaagctcggagacatcatacctgcagatgcacgcctcttagagggagaccctctcaagattgatcagtctgccctcacttggagaatcattgccggccaccaaaggccccggtgatggcgtctactccggttcgaccgtcaagcaaggtgagatcgaagccgtcgtgatcgccaccggtgtcacaccttcttgggaaaggctgcgcaccttgttgactccactaaccaagtgggccattttcagaaggttctgacggccattgggaacttctgcatttgttccatgggtgtgggaatgttcatcgagatcatggtaatgtatcctatccagcacagggcgtaccgccctggaatcgacaacctcttggtccttctcattggaggcattcccatagccatgccgacagtcttatccgtgactatggctatggggtcacatcgcttgtctcaacagggagctatcacaaagagaatgaccgcaatcgaggagatggcgggcatggatgtccttggcagtgacaaaactgggactttgactctcaataagcttactgtggacaagaaccttgttgaggttttcgaaagaggcatcactcaggaccaagtgattctcatggctgctagggcgtctcgaacagaaaaccaagatgctattgatacagcaattgtggggatgctagctgatccgaaagaggcacgtgctggtattcaagaagttcattttctgccattcaatcctactgacaagagaacggcgctgacatacattgacgctgatggcaaaatgcaccgtgttagtaagggtgcacccgagcagattcttcacctcgctcacaacacatcggaaatagagcggagggtccatgctgtgattgacaaatttgcagagcgtggacttcgatcgctggctgtagcgtatcaggaagtaccagatgggaggaaagaaagccctggtggcccatggcactttgctggtctgatgccactttttgatcctcctagacatgacagtgctgaaacaatccggagggcacttaaccttggtgttaatgtcaagatgatcacaggtgatcagctcgccattggaaagtcaacagggcgtcgcctgggaatgggtacaaacatgtatccttcatctgctctgttggggcagaaaaattcagacgagtccatttctgctttaccagttgacgatctcattgagaaagctgatggttttgctggcgtcttccctgagcacaagtatgagattgtgaaacgcctgcaagcacgaaagcacatctgtgggatgacgggtgatggagtaaatgatgctccagctctaaagaaagcagatattggtattgctgttgctgatgcgactgatgcagccaggagtgcttcagatattgtcctcacagaaccaggcctcagcgtgatcatcagtgctgtgcttaccagtcgtgcaattttccagcgtatgaagaactacactatctatgctgtctccatcacaattcgtattgtgcttggatttatgctacttgccctcatctggaaattcgactttccaccgttcatggtccttatcatagcgattctaaatgatggtaccatcatgactatatcaaaggatcgggtaaaaccatctccactacctgacagctggaagctggctgagattttcacaactggagttatccttggtggatacttggcaataatgacggtcatcttcttctgggctgcgtacaagacaaactttttcccgagattgtttcatgtcgaaagcctggagaagacagctcaggacgatttccaaaagctcgcggctgccatttacctccaagtcagcaccatcagccaagctctcatctttgtcaccagatcacgcagctggtcatttgccgagcgtcctgggtttctactggtctttgcattcttggttgcgcagctgattgctacactgatcgcggtgtatgctgactggcggttcactcagatcaaaggcatcgggtggggctgggctggcgtcgtgtggctctacaatatcatcacatacctcccgctcgatatcatcaagttcctcatccgatacactctgagcggcaaagcatgggatctcgtcatcgaccaaaggattgccttcacaaggaagaaagacttcggcaaggaggagagggagctcaagtgggcacacgctcagaggaccctccatgggctgcagccaccggatgccaagatgttctcggagaaggggggctacaatgagctgaatcacatggctgaagaggccaagaggagggccgagattgcaaggttgagggagcttcatactgtgaaactgtactggcatgtaggatgtatgggaatcggaaatgccaaccgaccctattgtcgagaggttaaatttagttgaagaagaaaacaatttgttgaaggaaaaaataaaaaaaattgaggaggagaagatgatattggagttgcatgttgcggatgtcgtcgatgatcacaagatcaagatggatgcaatgcgcttgaagattagaaagattagaaaatatgccattcataccgaggcttggtatcattatgccgttggatcagttgttaccttggttgcgattatgatcgcatttgttttcgcattgaaatgttttacatagtttcagtgtatggtttaattaatttagatgctctgcagagctttatgttgttagatgagaactatgtatgtactttggttttaatgtgatgatgaacttctattaatttggtcacttaattatctattcatgatgttctgtaatgatttttgacacaattaattatatataatgcacgcagatgaaccggtaatggatgtacggttcaagacacacctccgagtacattaagggcgtgcatgaa

SEQ ID NO: 2322 - DNA, 3591 bp, Zea mays
cttccttctttatccgcttggttcgcttttcttcttttcctttggcattccatcgcatctcaatcctgttaccgttgtggactcccactcccctgtctgtctgtcgcggtgtcgcctgacaccttcttcttcctcactcccccctcaacctcatccccatcccgccctcgcacttcccacccaccccaatccatccatccatccacccgtctgaaaaccaaacccacattcaccagcgagcaagcttcccctgccctcctccggccgcctcattctcgtttccatataaatctgtaactgcaaggacaacccaccacaggacacacgaggtgaaaggagatccgtgaggaggcgcctcccccatggctgagaaggagggcaacctcgaggccgtcctcaaggaggccgtcgacctggagaacatccccctcgaggaagtgttcgagaatctgagatgcagccgcgagggtctctccaccgagcaggcgcagcagcgcctcgaaatctttggcccaaacaagctcgaggagaaggaggagagcaaattcctcaagtttctgggtttcatgtggaacccactgtcctgggtcatggaggctgcagcaatcatggccattgctcttgccaatggaggggggaagccaccagattggcaggactttgtcggtatcataactctgcttgtcatcaactcaacaatcagttttatcgaggaaaacaatgctggtaatgctgcagcagccctcatggctcgcctcgcacctaaagccaaggttcttcgtgatggccgatggaccgaggaagacgcagccattcttgtaccaggagacattgttagtattaaactcggagatattatacctgcagatgcacgcctccttgagggggatcctttgaagatcgatcagtctgctctgaccggagagtcactgccggtcactaaaggtcccggtgatggtgtctattctggttcgacggtcaagcaaggtgaaatcgaagctgttgtgattgccacaggtgtccacactttcttcggaaaggctgctcaccttgttgactccacaaaccaagttggccatttccagaaggcaatattggacaccctgtctcctatgcatatactctggactgaattgtcaatatacttagttgtttacattatatcactttcttggtgcaggtcctgacggctatcgggaacttctgtatttgctcaattgctgtggggatgtttgttgagatcattgtcatgtatcctatccagcacagggcttaccgccctgggatcgacaacctcctcgtccttctcattggaggcatccccatagccatgccgaccgtcttatctgtaactatggctattgggtcccatcgtttgtctcaacagggggctatcacaaaaagaatgactgcaatcgaggagatggctggcatggatgttctttgcagcgataaaacaggaaccttgaccctgaataagcttactgtggataggaaccttgttgaggtttttgaaaggggcactactcaggaccaagtgattctcatggctgccagagcgtctcgcacagaaaaccaagatgctattgatactgctatagttgggatgctagctgatcctaaagaggcacgcgctggaatccaagaagttcacttcctgccattcaatcctactgacaaaagaacagcactgacatacattgatggtgatgggaaaatgtatcgtgttagtaagggtgcacctgagcagattctccacttggctcacaataagtcagatatagagaggagagtacatgctatgattgataaatttgcagagcgtggacttagatcacttgctgtagcatatcaggaagtgcctgaggggaggaaagaaagtcctggtggtccatggcacttcgttggtctcatgccactttttgaccctccaagacatgacagtgctgaaacaattagaagggcactcaaccttggtgttaatgttaagatgatcacaggggatcagttggcaatcggaaaggaaacaggacgtcgtctaggaatgggtacaaatatgtacccctcttctgctttattaggacagaacaaggatgagtctattgctgctttaccagttgatgatctcattgagaaagccgatggttttgctggtgtattccctgaacataagtatgagatcgtgaaacgtctacaagcacggaagcatatctgtggaatgactggggatggagtaaatgatgctccagccctgaagaaagcggatatcggtattgctgttgccgatgcaactgatgcagccaggagtgcttcagatattgtcctcacagaacctggacttagtgtgatcattagtgctgtgcttactagtcgtgcaattttccagcgtatgaagaattacacgatctatgctgtctctatcaccattcgtattgtgcttggatttatgctccttgccctcatttggaaatttgatttccccccattcatggtcctaatcattgcaattctaaatgatggtaccataatgactatatccaaggatcgtgtaaagccatccccattacctgacagctggaagttggctgaaattttcacaactggagttgtccttggtggatatcaggcaatgatgactgtcatcttcttttgggctgcatacaagacaaactttttcccaaaaatatttcatgtggaaagccttgagaagacagctcaagatgatttccaaaagcttgcatctgctgtttacctgcaagttagcaccatcagccaggccctcatcttcgtgacaaggtcccggagctggtcatttgtcgagcgcccagggtttctattggtctttgctttcttggttgcgcagctgattgccacactgattgctgtgtacgccgactgggcgttcacttcgatcaaaggcattgggtggggctgggctggcattgtgtggctgtacaacatcatcttctacttccctctcgatatcatcaagttcctcatcagatatgctcttagtgggaaagcgtgggatcttgtcattgagcagaggattgcgttcacaaggaaaaaggactttggtagggaggagagggagctgaagtgggcacatgcacagaggaccctccatgggctacaggcacctgatgccaagatgttcccagagaaggctgggtacaatgagctgaaccagatggctgaagaggcgaagaggagggccgagattgcaaggctgcgggagcttcacacactcaaggggcatgtggagtctgttgtgaagctgaagggactcgacatcgagaccatccagcagtcctacacagtgtaactttgcctgcccttcccagaggaagtttcttgttctttttacccaccggcgtgtgaatttgatggtggctggcttctctttgttttatttatttatttaaccgagctgcaagcaccgacaagtagctgaaatgagacagacagacccctcgctgtaatccctgatttcttctgtcctctcctcacatggtatgccaaccagtttatgaactttgctcggctatataaataagtgcttgaagaggggagcagggttttgggccactg

SEQ ID NO: 2323 - DNA, 2512 bp, Pennisetum glaucum
caacggtcaagcagggtgagattgaggctgttgtgatagcaactggtgtccacactttctttgggaaggctgcacatcttgtcgactccaccaatcaagttggccattttcagaaggtcttgacagccattgggaacttttgtatttgctcaattgctgtggggatgtttgttgagataattgtcatgtaccctatccagcacagggcgtatcgtcctggaattgacaatcttttggtgcttctcattggtggcattcccatagcaatgccaacagttttgtctgtgaccatggcaattgggtcccatcgcttggctcagcagggagctataacgaaaagaatgactgcaattgaagagatggctggtatggatgtactttgcagtgataaaactggaaccttgactctcaataaactcactgtggacaagaaccttatcgaggttttcgaaaagggtgtgactcaagaccaagtaattctgatggctgccagagcatcccgaatagaaaatcaagatgccattgatactgcaatagttgggatgctagctgatccaaaagaggcccgtgctggtattcaagagctccatttcctgccatttaatcctaccgacaaaagaactgccttgacatacattgatagtgatggaaagatgtaccgtgttagtaaaggtgcaccggagcagattctcaacctcgcacacaacaagtcagagatagaacgaagagttcatgctgtaattgacaagtttgctgagcgtggacttcgatcgcttggtgtagcatatcaggaagtaccagatggaaggaaagagagtcttggtgggccatggcatttcgttgctctaatgccactctttgatcctccaaggcatgacagtgccgaaacaatacaaagggcactgaaccttggtgttaatgtgaaaatgatcacaggtgaccagcttgcaattgggaaggaaacaggacgtcgcttaggaatgggtactaacatgtacccttcctcagctttgctgggacaggacaaggatgagtctattgctgctttacctgttgatgatttaattgagaaggccgatggttttgctggtgtattcccagagcacaaatatgagattgtaaaacgtctgcaagcacgaaaacacatttgtggaatgactggtgatggagtaaatgatgctccagctctaaagaaagctgatattggcatcgctgttgctgatgcaactgatgcagccagaagtgcttctgatattgtcctaacagaacctggcctgagtgtgatcattagcgctgttcttacaagccgagcaattttccagcgcatgaagaactatactatctatgccgtctcaattacaatacgtatcgtgcttggatttatgctgcttgccctcatatgggagtttgatttcccaccgtttatggtcctgattattgcaattctaaatgatggtaccataatgacaatatcaaaggatcgagtaaagccttctccactacctgatagctggaagttggctgagattttcactactggcattgtacttggtggatacttggcagtgatgactgttattttcttctgggctgcatacaagacaaactttttccctaggatctttcatgtcgagagccttgagaagacaactcaagacgattaccagaaacttgcctctgctgtttatctccaagttagcactatcagtcaggctctcatctttgtcacaaggtcccgcggctggtcattcgttgagcgcccaggctttctgttagtgtttgctttcctggttgcacagctgatagctacattgattgctgtatatgctaactgggcgttcacttcaatcaaaggcattggatggggctgggccggtgtcgtgtggctctacaatctcgtgttttacttcccactcgatatcctcaagttcctcatcagatacgctctgagcgggaaagcatgggatcttgtcattgagcaaagaattgcatttacaaggaagaaggactttggcaaggaagagagggcgctcaagtgggcgcatgcccagaggacgctccatgggctgcagccaccagatgccaagctgttccctgacagggtgaacgagctgaatcaaatggctgaagaggcgaaacgaagagctgagatctcaaggctgagggagcttcacaccctgaaggggcatgtggaatcggttgtgaagctcaagggcctggacatcgacaccatccagcagtcctacacagtgtgatgggagctcatatgccctgagagtttggagtacatatctgtttcccgcagaggaacagctagttctggtagtagttggtgtccgtcttgtacttaccacaactgtgccagcgacagtaaaaaaccccagtagttgagaacataacgggtggaactgatgctattatcagttgagctcccacgcatctgatgctgtgatgtgtattgtcgtatggggaggggagatcctcccgtgcaaatgccattctgctgtcctcg

SEQ ID NO: 2324 - DNA, 3746 bp, Sorghum bicolor
cggggcagggagatcagaggggtgcctgcctccatggctgacaaggaggggaccctggacgccgtcctcaaggaggccgtcgacttggagaacatcccacttgaggaagtttttgagaatctgagatgcagccgtggggggctcacttccgaccaggcgcagcaacgcctgcaactatttggccccaacaagctcgaagagaaggaggagagcaaatttctcaagtttctgggattcatgtggaacccactgtcatgggtcatggaggctgcagctatcatggccatcgcactggccaatggtggggggaagccaccagactggcaggatttcgttggtatcatcacactgctgcttatcaactcaactatcagtttcattgaggaaaataatgcagggaatgctgctgcggcacttatggctcgccttgcgccgaaagccaaggtgcttcgcgatggccgttgggccgaggaagaggcagctgtccttgtgcctggggacataatcagcattaaacttggagatatcgttcctgcagatgctcggctccttgatggagatcctttgaagattgatcagtctgcgctaactggagaatcattaccagtcaccaaaggtcctggtgatggtgtctactctggttcaactgtcaagcagggtgagatagaggctgttgtgatagcaactggtgtccacactttctttgggaaggctgcacatcttgtcgactccactaatcaagttggccatttccagaaggcaggattcaaaatttcacatacactcatgtcttgacagccattgggaacttttgtatttgctcaattgctgtggggatgtttgttgagataattgtcatgtaccctatccagcatagggcgtatcgtcctgggattgacaatcttttggtgctccttattggaggaattcccatagcaatgcctacagttttgtctgtgaccatggcaattgggtcccatcgcttggctcaacagggagctataacaaaaagaatgactgcaattgaagagatggctggtatggatgtactttgtagtgacaaaactggaactctgactctgaataaactcacagtggacaagaacctcattgaggtttttgaaagggaggtgactcaagaccaagtaattctgatggctgctagagcctcccgaattgaaaatcaagatgctattgatactgcaatagttggcatgctagctgatccaaaagaggcccgtgctggtattcaagaggttcatttccttccatttaatcctaccgacaaaagaactgccttgacatacattgatagtgatgggaagatgtaccgtgttagtaaaggtgcgccagagcagattctcaacctcgcctacaataagtcggagatagaacggagagttcatgctgtaattgacaagtttgctgagcgtggacttagatcgcttgctgtagcgtatcaggaagtgccagatggaaagaaagagagtcctggtgggccatggcattttgttgctcttatgccactctttgatcctccaaggcatgacagtgcagaaacaatacaaagggcactgaaccttggtgttaatgtaaaaatgatcacaggtgatcagctagcaattgggaaggaaacaggacgtcgcttaggcatgggtactaacatgtacccttcctctgctttgctgggacagaacaaggatgagtctattgctgctttacctgttgacgatttaattgagaaagctgatggttttgctggcgtattccctgagcacaaatatgagattgtaaaacgtctgcaagcacgaaaacacatttgtggaatgactggtgatggagtaaatgatgctcctgccctaaagaaagcagatattggtatagcagttgctgatgccactgatgcagccaggagtgcttctgatatcgtcctgactgaacctggcctgagtgtgataattagcgccgttcttactagccgggcgattttccagcgaatgaagaactacactatctatgctgtttcaattacaatacgtattgtgctaggatttatgctacttgctctcatatgggagttcgatttcccaccatttatggtccttattattgcaatactaaatgacggtaccataatgaccatatcaaaggatcgagtaaagccttcccctctacctgacagctggaagctggctgagattttcacaactggaattgtacttggtggatacttggcagtgatgactgtcatcttcttctgggctgcatataagacaaactttttccctaggatctttcacgttgaaagccttgagaagacagctcaagatgattaccagaaacttgcctctgctgtatatctccaagtcagcaccatcagtcaggctctcatcttcgtgacaaggtctcgcagctggtcatttgttgagcgcccgggctttctattagtgtttgctttcttggtcgcacagctgatagctacattgatagttgtatacgctaactggggattcacttcaatcaaaggcattgggtggggctgggctggtgtggtgtggctctacaatctcgttttttacttcccactcgatatcctcaagttcctcatccgatatgctatgagtgggaaagcatgggatcttgtcgttgagcaaagaattgcatttacaaggaagaagaattttggtaaggaagagagggcgctcaagtgggcacatgcgcagaggacgctccacgggctgcagccaccggatgccaagctgttccctgagagggtgcatgagctgaatcaaatggctgaggaggcgaaacggagggctgagattgcaaggctgcgggagcttcacacgctgaaggggcatgtggagtcggttgtgaagctcaagggcctggacatcgacaccatccagcagtcatacacagtctgatgactcttgcttaaatacaggcatactatatttcctgcagaggaacacctagttctagcaggtggtagtcgcctgcttgtactttccataccatagctgcaccatttacagatcaacatagtatagcacataatgagatctgatattgccagttcagctctatgttatggggtgtattgccttatgaggagcagggatatatctcccgtgcaatgcctcttcctgggcttcagagttctgaacatcattggaatttgcttcagagttttgaacaccattggaatttggaggtgtcagcatcttctggtccggccatcaaagggccggcaacttctggtccggctgcgctgtgctgtgcctgcgccgaagtccggtcggtcacctctgtacggccgccgtctcgctcgggatcgtttcagtcgggctgccctctgcatcgtcctgctctcaggcatctggggcgcctccgggctccagacgcccgcgagcgtccagcgtccagctgcaggccggagcagtgcgcatgggtgtccgtgccgcgcttcgctcccgcctgccgctccgtccgccgccacaaggtcgacaaaatgacatgtgaggagggatatattttgttaaacaatgttgacaaaaatttacacagtatggcaacaccaccactcaatgcgccgctacttccccttcctcgatttcaggcaccaaccagaacagcaaaaaaaaaaatctgttttctctgctattgcattaacaaagggtagagaatgtagtattttcgtcttatttggcaattagtgtctttctctatttacaccaacagaa

SEQ ID NO: 2325 - DNA, 3075 bp, Pennisetum glaucum
atttccaggaggtcttgacgtccattgggaacttctgtatttgctcaattgctgtggggatgtttgttgagatcattgtcatgtatcccgtccagcacagggcgtaccgccctgggatcgacaacctcctcgtccttctcattggaggcattcccatagccatgccaacagtcttatctgtaactatggctattgggtcacatcgtctgtctcaacagggagctatcacaaagaggatgactgcaatcgaggagatggctggcatggatgttctttgcagtgataaaactggaacattgaccctgaacaagcttactgtggacagaaccttgtgaggtgtttgaaagaggcattactcaggatcaagtgattctcatggctgctagagcatctcgtacagagaaccaagatgctattgatactgctatagttgggatgctagctgatcctaaagaggcacgtgctggcatccaagaagttcacttcctaccattcaatcctactgacaaacgaacagcattgacatacatagacagtgatggcaaaatgttacgtgttagtaagggtgcacctgagcagattctccatctggctcacaacaagtcagagatagagaggagggtccatgctgtgattgataagtttgctgagcgtggacttagatcgcttgctgtagcatatcaggaagtacctgaggggaggaaagaaagtcctggtggcccatggcactttgttggtctaatgccactttttgaccctccaagacatgacagcgctgaaacaattcgaagggcactcaaccttggtgttaatgtcaagatgatcacaggtgatcagctggcaattggaaaggaaacaggacgtcgcctaggaatgggtacaaatatgtatccttcttctgctttgttaggacagaacaaggatgagtctattgctgctttaccagttgatgatctcatcgagaaagctgatggttttgctggtgtattccctgaacacaagtatgagatcgtgaagcgtctgcaagcacggaagcatatctgtggcatgactggtgatggagtaaatgatgcaccagccctaaagaaagctgatattggtattgctgttgctgatgcaactgatgcagccaggagtgcttcagatattgtcctcacagaaccaggacttagtgtgatcattagtgcggtgcttacaagtcgcgcaattttccagcgtatgaagaattacacgatctatgctgtctcgatcaccatccgtatcgtgcttggatttatgctccttgccctcatttggaaatttgacttcccaccattcatggtcctgatcatagcaattcttaatgatggtaccataatgactatatcgaaggatcgtgtaaaaccatctccactacctgacagctggaagctggctgaaattttcacaaccggagttttccttggtggatatcaagcaatgatgactgtcatcttcttttgggctgcatacaagacaaactttttcccaagaatatttcatgttgaaagccttgagaagactgctcaagatgatttccaaaagcttgcctctgctgtgtacctgcaagtgagcaccgtcagccaagctctcatctttgtgacaaggtcccggagctggtcatttgttgagcgccctgggtttctactggtctttgctttcttggttgcgcagctgattgctacgctgattgctgtgtacgctaactgggcattcacttcgatcaaaggcatcgggtggggctgggctggcgttgtgtggctttacaacatcatcttctacttcccgctcgacatcatcaagttcctcatccgatatgctcttagcgggaaagcatgggatctggtcatcgagcaaaggattgcatttacaaggaagaaggactttggtaaggaggagagggagctgaaatgggcacatgcgcagaggaccctccacgggctgcaggcaccggatgccaagatgttcccagagaaggctgggtacaatgagctgaaccagatggccgaagaggcgaagaggagggccgagattgcaaggctgcgggagcttcacacactcaaggggcatgtggagtctgtggtcaagctcaaggggctcgacatcgagaccatccagcagtcctacacagtgtgatgttgccattttatctgcctgtccagaagaaatgattcttttttttttttttgaaaagagaagaaatcaagcatatcatagatagaagttcacaacatgcttcgtattagtaatacagatccacatactagtacatgataggaagttgggtggttgccttacaggacaatacacaccagggcattcatacaacagcagtatataagaactcttggttatcaccttcgaagtacacaagcagacagcaaagcactagttcaatcattatttatatatgtcgggctaagagtggcgatgatcatgaatccaatctcagttgaagcagaaggatcagttgtttttaacaacttgtggagctctatccattagaaccaatggttttggtgcagcgcagttccttttctgattctccttctctgggatatggaaagctgatgcagggaaggtcctggttatccctgcaatgctcttgcagataagcttcccagtggcgggttcatcaagggcaatctcctccactgggacccacaccatgagctccctggtctttatcccttttaccttcttgatcctgcctttctctgcatagccggtgatctctgtgccatacgagaccagccttcctagactctgaaagacatggtcaaccctcttcttttgcttgagccatacatatccagtttcctgcacataaccacactcgattaggtccttcaatggaagcagaccattggggaggcctgcttccttgagcaagagctgggcacactgctgacagatgtcatcaccatagtagacctcagctttggccctgagttcatcagctatgagagccattgtctatgggttctctcttttctctcacactccttttttccttctttgctctgaagcagtttcggtggctaagctttgtatccc

SEQ ID NO: 2326 - DNA, 3610 bp, Ricinus communis
acactctttgctcctactcacagcggttggttttctctcattgataaaactctctagtagatttggtgttggtgggtggtcttcaagttggcctctaaaattctagttcatgctaaaaatcaagtcttttcaactgggtttcacttgattctgcttactataccagaaagtttctgcctttttcttttgttcttctttaatgtttataccattttttatggtggttttgctgtgaagtgttgattttctatttgaagtttggtaagagagctctatgaaagaagaaaagatgggggagaaaggtgaagttttggaggctgtgttgaaggaaactgtggatttggaaaacatacccattgaggaagtgtttgagaatctgagatgtagcagggaaggtttaacaactgaagctgctgaggagaggctcaccatttttggccataacaagcttgaagagaaaaaggagagcaaattcttgaagtttttgggttttatgtggaatcctctgtcatgggtgatggaggctgctgctattatggctattgctcttgcaaatggaggagggaagcctccagattggcaagacttcgtgggtattattactttgcttttgatcaactccactatcagttttattgaggagaacaatgctggtaatgctgctgctgctctcatggctcgtcttgctccaaaagctaagattcttcgagatggaaggtggagtgagcaggatgctgctattttagttcctggtgacattattagtatcaaacttggagatatcattccagctgatgctcgtttactggaaggtgatccccttaaaattgaccagtctgcacttactggtgagtctcttcctgtgacaaaaggacctggagatggtgtgtattctggttcgacttgcaaacaaggagagattgaagcagtggttattgccactggtgtgcatacattcttcgggaaggctgctcatcttgtggataccacaaaccaagttggccatttccaaaaggcaagggaacagaaataaaatcagatatttattttcttaaatttgtgtgattctaatatcatttcctccttgctacttattatgcaggtcttgactgcaatagggaatttctgcatatgttcaattggtgtggggatgatcatagagattattgtcatgtaccccattcaagatcgggagtatcgtcctgggattgacaatcttctcgtccttctcattggaggaattccaattgcgatgccaacagtcctgtcagtgacaatggctattggttctcatcggttatctcagcagggtgccatcacaaagagaatgactgcaattgaagagatggcaggcatggacgtgctttgcagtgacaagactgggaccttgactttaaacaagcttactgttgacaaaaatatcatagaggtttttgccaaaggagtagatgcagatactgtaattctgatggcagctcgagcctctaggacagagaatcaagatgcaatagatactgctattgtcggaatgctggcagatccaaaagaggctcgtgctggaattcaagaagtccatttccttccttttaatcctactgataagcgcacggccttgacctatatcaacagtgatggtaaaatgcatagagtcagcaaaggtgcgccggagcagattctaaatcttgcacacaataagtcagacattgagcgaagagttcatgctgtgattgacaagtttgcagagaggggtttacggtcgcttgctgttgcataccaagatgttccagatggaaggaaagagagtcctggaggcccatggcagttcattggcctcttgcccctttttgatccacctaggcatgatagtgctgagacaatcaggagggctttgaatcttggtgtaaatgtgaaaatgatcacaggggatcaactggccattgggaaggaaactggacgtcgtttgggaatgggtaccaacatgtatccttcatctgcattgctgggacaagacaaggatgagtctattgctgccttaccgattgatgaactaattgaaaaagctgatggctttgctggtgttttccctgagcacaaatatgagattgtaaaacgcttgcaagctaggaaacatatctgtggtatgacaggtgatggagtcaatgatgctcctgctcttaagaaggctgacattgggattgctgttgctgatgcaactgatgctgctcgtagtgcttctgatattgttcttacggaacctggcctcagtgtcatcattagtgctgtcttgacaagtcgagcaatctttcaaagaatgaaaaattacacaatctatgcagtttccattacaattcgtattgtgcttggtttcatgctactggccctcatatggaagttcgactttccaccttttatggtgcttattattgcaattcttaatgatggtaccattatgacaatatctaaggatagagtgaagccatctcctctgccagacagctggaagttggcagagatttttacaactggaattattcttggtagttacttggcaatgatgactgtcatattcttttgggcagcatataagacaaacttcttcccaagggtattcggagtatcaaccctggagaaaacagctcatgatgatttcagaaagcttgcatcagcaatatatttgcaagtgagcactatcagtcaggccctaatatttgtgacacgatctcggagttggtcttttgttgaacgtcctgggatattacttgttgtggcttttgtgatcgctcaactggttgctactctaattgcagtctatgcaagttggagctttgcagcaattgaaggaattggttggggttgggctggtgttatttggctttacaacctcatcttttatttccctctcgatttcatcaagttctttatacgttatgctttgagtgggagggcttgggatcttgttattgagcaaaggattgctttcacaaggcaaaaggatttcgggaaagaacagcgcgagcttcaatgggcacatgcacaaagaacattgcatggattgcagccaccagacaccaagatgttcacagagcgaactcatttcacagaactcaataatatggctgaagaagctaaaaggagagctgaaattgcaagattgagagaacttcatacgctcaagggtcatgtagaatcagtggtgagattgaagggtctcgatatagacacgattcaacaagcatacacagtctgaagattggccgggtgtacaagaaccaataaaatgaccttcttttagttttactgcttctcatttatagagatctgtaagcagcattttctcttagagttacctcagaaaaagaaaagccgattattgctgcaatgcttttttgagtatcgtcatttaaagggtgctgtcttatcttatttgctttccagtctctgtttacctggcggtggaaagctcatcctttttttttttcgttttctttttctttttgcccattttctgtctatattagtaagcttatggctcgcgccgtctttattttctttgttgtattacatatgaacttaacaatagttcggtaattataccatggcacttgatcta

SEQ ID NO: 2327 - DNA, 2052 bp, Lotus japonicus
gacctgattacgaattcgtcaggatgacagccattgaagaaatggcaggcatggatgtgctttgcagtgataagactgggactctaacactaaataagcttactgttgacaaaaatcttgttgaggtttttgcaaaaggagtggatcctgatactgttgtcttgatggcggctcgagcttctagacttgagaatcaagatgcaatagatacagcaatagttgggatgctggctgatccaaaggaggcacgtgctggaatacaagaactacattttcttcctttcaatcctactgataagcggacagcattgacttatactgatcaagatggtaaaatgcatagagtaagcaaaggtgcaccagagcagatcctaaatcttgcacacaacaaggcagacattgaacgtcgagttcatgccgtgatagataagtttgcagagcgtggtttacgatctcttgctgtatcgtaccaagaagttccagatggaaggaaagaaagtgcaggaggcccatggcaattcattggccttttgcctctctttgacccacctaggcatgatagtgcagaaacaataaggagggcactaaaccttggagtaaatgtcaaaatgattacaggggatcagctagctataggaaaggaaacaggccgtcgattgggaatgggcaccaatatgtatccttcatctgctttacttgggcagaataaggatgaatccattgctgccttacccgttgatgaattaatagaaaaagcggatgggtttgctggcgtatttcctgagcacaagtatgagattgtgaaacgcttgcaagctaggaaacatatttgtgggatgactggtgatggagtgaatgatgctcctgccctcaagaaggcagacattggtatagctgttgctgacgctactgatgcagctcgtagtgcatctgatattgttttaacagaacctggccttagtgttattataagtgctgttttgaccagccgtgctatcttccagagaatgaaaaattatacgatttatgcagtctcaattacaattcgtattgtgcttggtttcatgttgctggctctcatatggaagtttgactttccaccttttatggtgctgattattgccatcctaaatgatggtactattatgacaatctcaaaagatagggtaaaaccatcacctcttccagatagctggaagctatcagagatatttactaccggtgttgtgcttggtagttacttggcaatgatgacagtcatattcttttgggctgcatacaaaacagatttcttcccgcgagtgtttggggtctcgtctcttgaaaaaacagctcatgatgatttccgaaaactggcctctgcaatctatctccaagtgagcaccattagtcaggctcttatatttgtaactcggtctcgaggctggtcatatgtggagcgtcctggtttcttgctggtggctgcttttattgttgctcaactgattgccactttgattgcggtgtatgcaagctggagttttgctgcaattgaaggaataggttggggttgggctggtgtaatatggttatataacataatcttctacatcccccttgatttcatcaagtttttaacccgctatgctttgagtggaagagcttgggatcttgttattgagcaaaggattgctttcacaagacaaaaggactttgggaaagaacaaagggagcttcaatgggcacatgcacaaagaacattgcatggactacaacctcctgactccaagttcactgagcgtactcatgtcaatgaactcaatcaaatggcagaagaagctaaaaggagagctgaaattgcaaggttgagagaacttcatacactgaaaggtcatgtagaatcagttgtgaggttgaaggggctcgacatagacacaattcagcaagcatacacagtctgaagatttggatagttataatactgtaaactgtaaagggttacattctaatgttgctgagagaaatataaatgtaaggattacactcttaactttaatagccttttactctgca

SEQ ID NO: 2328 - DNA, 2402 bp, Gossypium hirsutum
  misc_feature (104)..(104): n is a, c, g, or t
  misc_feature (1710)..(1710): n is a, c, g, or t
  misc_feature (1896)..(1896): n is a, c, g, or t
cttctgcatatgttctattgcagtggggacgttaatagagataattgtgatgtatccaattcaagaccggcattaccgtcctggaattgacatcttcttgtccntctcattggtgggatcccgattgccatgcctacagttttgtcagttaccatggctatcggttctcataggctatcccagcagggggcaatcacgaagagaatgactgcaattgaggaaatggcgggcatggatgttctttgcagtgataagactggaacactgacactgaacaaacttacagttgacaaaaatcttattgaggtgtttgccaaaggagtagatgcagacactgtagttctgatggcggcccgagcctctagaacagagaaccaagatgctatagattctgcaattgttggtatgctggctgatccaaaggaggcacgtgcaggcattcgggaagtacacttccttccattcaatcctactgataagagaacagctctaacctatattgacagtgatggtaaaatgcacagagttagtaaaggtgcacccgagcagatcttacatcttgcacacaataaggcggacattgagagaagagttcatgcggtcattgataagtttgccgaacggggtttacgatctcttgcagtggcataccaggaagttccagacggaagaaaggagagtcctggtggtccatggcagttcattggtctcatgcctctctttgatccccctcgtcatgatagtgctgagacaattaggagagctttgaaccttggagtaaatgtcaaaatgattacaggagatcaactggcaattggaaaggagactgggcgccgtttgggcatgggaaccaacatgtatccttcgtctgctttgttaggacaggacaaggatgaatctatagctgctttgccagttgatgaactaattgagaaagctgatggctttgctggtgttttccctgagcacaaatacgaaattgtgaaacgcttgcaagccaggaaacatatctgtggcatgactggtgatggagttaatgatgctcctgctcttaagaaagctgacatcgggatagctgtggctgatgcaactgatgcagcacgtagtgcttctgacattgtccttactgaacctggacttagtgtcatcatcagtgctgtcttgaccagtcgtgccattttccaaaggatgaaaaattacactatttatgcggtttccatcacgatccgtattgtgttgggattcatgctgttggccctcatctggaaattcgactttccaccattcatggtgcttattattgctatcctcaatgatggtaccattatgacgatatccaaagatagggtcaaaccatcacctctaccagacagctggaagctggcggaaattttcactactggaattgttcttggtagttacttggcagtaatgacggttatattcttttgggctgcatacaagaccaactttttcccgcgtgtatttggggtggcaactcttgagaaaacagctcatgatgacatcaaaaagcttgcctcagctgtatatttgcaagtgagcattataagtcaggccctaatatttgtaactcgatctagaagttggtcctttgttgagcgtccaggtttactactattggcggcctttgtcatagctcagttgattgctactcttattgctgtgtatgccaattggagctttgctgcnattgaagggatcggatggggttgggctggtgtgatctggctttataatattatcttctatatcccacttgatttcatcaagttcttcattcgctatgctttgagtggccgggcgtgggatcttgttattgagcaaaggattgcattcacaaggcaaaaggatttcggaaaagagcaacgtgagctncaatgggcgcatgcacagagaacattgcatggtttgcaggcacctgatactaagatgtttacggagcgaacccatttcacagagctgaaccaaatggctgaggaagccaaaaggagagcagaaattgctaggttgagagaactgcatacactgaaagggcatgtggaatcggtggtgagattgaagaacctggacatagacacaatccagcaagcgtacacggtgtaaggtgggggaatggtattccgaaggaatagtggaaaatgtaatgagagggagcgttttcctgagagtgaagctctaatatatgtatcttttattaccttaatcccgtccgccattttacaagggaaaggttattgtttatggcattttatgtttatattagtagtaaaaaacccatgtgttttgcttttgttgtattaaaaaaaaacaaaactgtgatagtagaaataagaacccaaattaactttttccttctataggggccccaaatttcaattcag

SEQ ID NO: 2329 - DNA, 3489 bp, Prunus persica
gaaaaataattttcagggctctttaagaatttgacattaaaaaagagagagtagaaaaggttgtgactgttactgactgccactcctatactctctttagcggttcatcttcttggttcctgcttgcgtgtttggtggccgacgagggtccttctcatttgggtttccctaccataattgctatcaaagtcgagtttttgcaactggagatatagcgaaaaaagtgaggccgtattagagaggaagagagatatggcggagaagcctgaagtattggacgctgtgttgaaggaaactgtggatttggaaaatatacccattgaagaggtctttgagaatctgagatgtagcaaagagggcctcagcagtgaggctgctgaggaaagactgaccatttttgggcacaacaagcttgaagaaaagcaggagagcaaatttttgaagtttttgggttttatgtggaaccctctctcgtgggttatggaagctgctgctataatggccattgctcttgcaaatggaggaggtaagcctcccgactggcaagattttgtgggtattattactctccttgtcatcaattccactattagtttcatcgaggaaaacaatgccggtaatgcagcagcagcactcatggctcgtcttgctccaaaagccaaggtccttcgagatggaaggtggaatgagcaagaggctggggttctagtacctggtgacataatcagtattaagcttggtgatattgttccagctgatgctcgtctacttgaaggggatcctctgaaaattgaccagtctgcacttacaggcgagtctcttccggtgacaaaaagcccaggggatggtgtgtactccggttcgacttgcaaacaaggagagattgaagcagtggtcattgccactggtgttcatacctttttcgggaaagctgctcaccttgttgatagcactaatcaagtgggccacttccaaaaggcaggggagcaatagtcttgactgcaattgggaatttctgcatatgttccattgctgtggggatggtaatagagattattgtcatgtacccgatacaagaccgagactatcgtcctggaattgacaacttgctcgtgcttctcattggtggaattccaattgcaatgcccacagttctgtcagtgacaatggctattgggtctcatagattatcacagcagggagctattacaaagagaatgacagcaattgaagagatggcaggaatggatgtcctttgcagtgacaagactggaactctaacattaaataagcttactgttgacaaaaatcttattgaggtctttgcaaagggaatggatccagatactgttgtgctgatggcagctcgagcctccagagtggagaatcaagatgcaatagatactgctatagttgggatgctcgctgatcctaaggaggcacgtgctggtgttcaagaattacacttccttcctttcaaccctactgataaacgaactgcattaacgtatcttgaccgtgatggtaaaatgcatagagtaagcaaaggtgcaccagagcagattctaaaccttgcccacaataagtcagacattgagcgtagagttcatgctgttattgataagtttgctgagcgaggtttacgatctcttgcagtagcataccaggaagttccagaaggaaggaaagagagtgctggaggcccatggcagtttgttggcctaatgccactctttgacccacctaggcacgacagtgcagagacaataaggagggctttagatcttggtgtaaatgtgaagatgattacaggggatcaactggccataggaaaggaaactggacgtcgcttggggatgggaaccaacatgtatccttcatctgctttgctaggacaggacaaggatgagtcgattgttgctttaccgattgacgagctgatagaaaaagctgatggctttgctggtgttttcccagagcacaaatacgagattgtgaaacgcttgcaagctaggaaacatatctgcggaatgactggtgatggagttaatgatgctcctgccctaaaaaaagctgatattggtatagctgttgctgatgcaacagatgcagctcgcagtgcttctgatattgtgctaactgaacctggccttagtgtcatcattagtgctgttttgaccagtcgggcaatcttccagaggatgaaaaattacacaatatatgctgtttccatcacaattcgtattgtgcttggtttcatgttgctcgccctcatatggaagtttgattttccacctttcatggtgcttattattgccatcctcaatgatggcactatcatgacgatatcaaaggatagggttaaaccatctcctctgccagatagctggaagctggccgagatttttacaactggagttgtgcttggtagttacttggcaattatgactgtgatattcttttgggcagcatacaaaacagacttcttcccaagagtatttggggtgtcaacccttgagaaaacagctaatgatgacttccggaagcttgcctctgctatatatctacaagtgagcattatcagtcaggctctcatatttgttactcggtctcgaagttggtcgtttgttgagcgtcctggattgttgcttgtggtggcttttgtgatagctcagctgattgccaccttgattgcagtctatgcaaattggagttttgctgccattgaagggattggatggggttgggctggggtgatctggctttataacctcgtcttctatttccctctggatatcataaaattcatgatacgctatgcgctgagcgggaaggcttgggatcttctcattgagcaaaggattgctttcacaaggcaaaaggatttcggaaaggaacagcgtgagcttcaatgggcacatgcacaaagaacattgcatgggctgcaaccacctgataccaagatgtttacagaacgcacacatttcacagaactcaatcagatggctgaagaagccaaaagaagagctgagattgcaaggttgagggagctccacacactgaaaggtcacgtagaatcggtggtgagattgaagggacttgacatcgacacaattcagcaagcatacacagtttaagggagacataatttatttaccttgctatactgtataagatgatgatgatgattccccctagtgtgctgagagtaaagacgtgtactcagcatgttgtgagtaaccttcagtagacagtcattttaaatttgctactggtgctttcagtttttggcatgtaaaatgagtgctgcaatcagctgttttctactttttcctcccccgtctgcccccttccctcttgtgtcaagtctcacatgactaggggacacgtaaacggaaataaactgctcctcaagtgatccaaaccattcatgaaatgttttcacttacattaaatgggtttataaagaaggctaaaatgcatttctgg

SEQ ID NO: 2330 - DNA, 2636 bp, Cajanus cajan
gacccggtgatggagtgtattctggttctacctgcaaacaaggagagatcgaagctgtggttattgccaccggtgttcataccttctttgggaaagctgctcaccttgtagacaccactaaccaagtgggacactttcaaaaggtcttgactgcaatttgggaacttttgcatatgttcaattgctgtggggatgattattgagattattgttatgtatccgatccaagatcgagaatatcgccctggaattgataaccttcttgtacttctcattggtggaattccaattgccatgccaactgtactctcagttactatggccattggttctcataggttatcgcagcagggggctatcacaaagaggatgacagctattgaagagatggcaggcatggatgtgctttgcagtgataagactgggaccttaacattaaataagcttactgttgacaaaaatcttattgaggtttttgcaaaaggagtggatgcagatactgttgttttgatggcagctcaagcttcaagacttgagaatcaagatgcaatagacactgccatagtagggatgttggctgatccaaaggaggctcgtcttggtatccaagaagtacattttcttcctttcaatcccactgataagaggacagcattgacttatattgatcgtgatggtaaaatgcatagagtaagcaaaggtgctccagaacagatccttaatctcgcgcacaataaatcagacattgaacgtagagttcatgcagttatagataagtttgcagagcggggtttacgatcccttgcagtagcattccaggatgttccagatggaaggaaagagagtccaggtggtccatggcagtttattggccttttgcctctgtttgacccacctcggcatgacagtgcagaaacaatacgcagggcactaaaccttggagtgaatgtcaaaatgattacagggatcagctagctataggaaaggaaactggccgtcgcttgggaatgggaacaaatatgtatccttcatctgcattacttgggcaggataaggatgaatccatttctgctttacccattgatgaactaattgaaaaagctgatggatttgctggtgtttttcctgaacacaagtatgagattgttaaacgcttgcaagctaggaaacatatttgtggaatgaccggtgatggagtgaatgatgcgcctgcactcaagaaggcagacattggtatagctgttgctgatgcaactgatgcggctcggagtgcatctgatattgttttaacagaacctggcctcagtgttattattagtgcagtcttgacaagccgagctatcttccagagaatgaaaaattatacaatttatgctgtctctattacaattcgtattgtacttggtttcatgttactggctctcatatggaagtttgattttccaccttttatggtgcttattatcgccattctgaatgatggtactatcatgacaatttcaaaagatcgagtaaaaccatcacctctgcctgatagctggaaactatctgagatatttactactggcattgtgctcggaagttatttggcaatgatgacggtcattttcttttgggcagcatacaaaactaatttcttcccgcgagtatttggagtttctactcttgagaaaactgctcatgatgattttcggaaactggcctctgcaatctatcttcaagtgagcactattagtcaggccctaatatttgtgactcggtcccggggttggtcttatgttgaacgtcctggtattttgctcgtgacagctttcgtgattgctcagctgattgccactttgattgcagtatatgccaactggagttttgctgcgattgaaggcataggttggggttgggctggtgtaatatggttgtataacataatattctacatcccacttgacatcatcaagtttttaattcgatatgctttgagtgggagggcttgggagcttgtcattgagcaaaggattgcattcacaaggcaaaaggactttggaaaggaacaaagggaacttcaatgggcccatgcacaaaggacattgcatggattacagccacctgacaccaagatgttcactgagcgcacacatttcaacgaactcaatcaaatggctgaagaagccaaacggagagccgaaattgcaaggctgcgagaactgcatacactaaagggtcatgtggaatcagttttgaagttgaagggaattgatgtagacacaattcagcaagcatacacggtctgaatatggttttatatatttgcatactgatactgtaaaggggatgttgccgaatgctgagaggagtagaaagtaatgatggttacactgtagtcagttcaatttcttctcaccattttgaccacttaaaagagtgctttgaaaggtctatctatgtatcttgtttttcactatagctgtcacttttttctatacagttttcataatgcaatttagagttcatcttctatgcttctgaacccaaattccactgtacttccctcaatcatatccctcaagagttcaaacttcaatttatgaatataagaaaagcacgttatactaaacaaaaaaaaaaaaaaagtaactact

SEQ ID NO: 2331 - DNA, 2519 bp, Artemisia annua
tgcatttgttctattgctgttggaatggtgattgaaattattgtgatgttcccaattcaagatagacaatataggcctggaatagataatcttcttgtgctattaattggtggaatccccattgctatgcctacagttctttccgtgacaatggctattggttctcatcgattagctcaacagggagcaattacaaaaagaatgacggctatagaagaaatggcgggaatggatgtgctttgtagtgacaaaaccggtactttgactttgaacaaattgacagtagacaagaatcttattgaagtatttgccaaaggagtagacgccgatactgttgttctgatggcagcacgagcatcaagaaccgaaaaccaggatgccattgatgctgcaatagtgggtatgctggctgatccgaaagaggcacgtgctgatattcaagagttgcactttctgccctttaatcctactgacaagcggactgcattgacctatttggacagccagggtaaaatgcatagagtcagcaaaggtgcccccgaacagatcttgaatcttgcacacaacaaatcagacatagaacgaagagttcatgctgttattgataagtttgcagacagagggttacgatcacttgctgtatcttaccaggaagttccagatggacggaaggagagtgctggaggaccgtggcaattcattgggctcatgccgctctttgatccaccacgtcatgatagtgctgagacgatacgaagggctttgaatcttggagttaatgttaaaatgattacaggggatcaattggcaattgggaaggaaaccggccgacgtcttggaatgggtaccaacatgtatccttcctctgctttgcttggtcaaaacaaagacgagtcaattgctgctttaccaatcgacgaactcatcgagaaagctgatggttttgccggtgttttccctgaacacaaatacgaaattgtaaagcgtttacaagcattgaaacacatttgtggaatgaccggggatggagtcaatgacgctcctgcccttaaaaaggccgatatcgggattgctgtggctgatgcaactgatgcagcccgtagcgcttctgatatagtcctcactgagcctggacttagtgtcatcatcagtgctgttttgaccagtcgagccatctttcagagaatgaaaaattacacaatttatgctgtttcaataaccattcgtattgtgctcggttttatgctgctggctttgatatggaggtttgatttcccaccatttatggtgcttataatcgccatcctgaacgatggaactataatgaccatatcgaaggatagagtgaagccatcacctcttcccgatagctggaaactggctgagatcttcactactggtgttgttcttggtagttacctagccatgatgaccgttatatttttctgggcggcttataaaacagatttctttccgcgtacatttggtgtgccaaccctcgagaaaacagctcatgacgattttagaaagctggcttcggctatatatcttcaagtcagcacaatcagccaagccttgatttttgtgacgaggtcccgaagctggtcgtttgtggagcgtcctggttggctgcttatcattgctttcgctattgcccaactgattgctacattaatagcggtctatgcaaattggagcttcgctgcagttgaaggaattgggtggggatgggctggtgtcatctggctctacaatatcgtcttttacttcccactcgatatcataaagttctttatccgatacgctcttagtggacgcgcatgggaccttgttattgagaggaggattgcgttcacgagacaaaaggatttcggtaaggaacaacgtgagcttcaatgggctcatgcgcaacgaacccttcatgggcttgaagttcctgacaccaaaatgtttaatgatcgcaataatgtcactgagcttaaccagatggctgaagaagccaaacgcagagccgaaattgcaaggttgagagaattgcacacgttgaagggtcatgttgaatcagtggtcagactcaagggacttgatatagaaactattcaacaagcgtacactgtttgagatggaggctatgttaccttttgataaagttgtttttcgtacggttattacttttatttgatttttttttcggtctttagctcgtgatcccatgtacttgtaaacggggaaaagagagaaccttttatgctgtaatttgttgtgcatatgaagaaaggcttttggctttagttttttcaggctatctatgccttcgacatctgttaatagtttattgtttcgtgtcgttcttacttgtgatgtctgaagcactgcattccttagttgtatccttgcgtactcgcaacatgggaaggatggaaaggcatgtatagatattgtggagctagattatatagttcttactgtatagtccaaaagtaaaataaacactagacaaagaagttagctcgcgatat

SEQ ID NO: 2332 - DNA, 3478 bp, Quercus alba
atggggattattgtctagggacaaaaatcgtcgaaacaagaaagtgctccattttatttgtaagacaaggaaacacctgtcccagatagtttcaagtattgtatattttgctctattaaaagagaaggaaattgcatcaaccagagtataaaaaatgaagttaatagaatgtgtgtacccgccaagtacatgatctactttgagctgtttatccgccccaaaggacaaaaatcgtggccgaaaaaagctgccactggaagatttaagagagagagtgtgtgtcagagaaagcagagagacagggtgcaaaacagagtataacataaggaaatgagacagagtgcactgtttttccattgatttccttgggtggttttgacgtttttcgcttaatatttattcccttttagtagtgctcctgaaaatcaagaggctttgagatggatgacaagactgaagttttggaggctgtggtaaaagaagctgtggacttggagaacgtaccaattgaagaggtttttctgaccttgagatgcaacaaagatggtctcacaacagtgtctgctcaggaaaggttggccatttttggctacaacaagcttgaagagaaaaggaaagtaagtttttgaagttcttaggatttatgtggaaccctctctcatgggttatggaagctgcagctattatggccattgcgcttgccaatggaggaggaaaaccacctgattggcaagattttgttgggattattgttctgctacttatcaattcaactataagttttatagaggagaacaatgctggaaacgctgctgctgctctaatggcccgacttgcacccaaagctaaggtccttagagaagggaggtgggttgaagaggatgcagctattcttgttcctggtgatataattagtgttaagcttggggacattattcctgcagattctcgccttcttgatggtgatcccttgaaaattgatcaggggagtcccttcctgtgacgaaaggccctggtgatagtgtttattcaggttccacgtgcaaacaaggtgagattgaggcagtggtcattgctactggtgttcataccttctttggcaaggctgctcaccttgtggattccacaaatcaagtgggacactttcaaaaggtcttgactgcaattgggaatttctgtatatgttcaattgccgtggggatgattgtagagatcattgttatgtacccaattcaacaccggaagtaccgcccaggaattgacaatctgctggtgcttcttattggaggaattcccattgccatgcccacagttttatctgtgacaatggcaattgggtcccatcgcttatctcagcagggagctatcactaaaagaatgacagcaattgaagaaatggcagggatggatgtgctttgcagtgacaaaactgggactctgacactgaacaagcttacagttgacaagaatctcatagagatctttgcaaggggagtggacgcagatactgttgttctgatggcagctcgagcatcccgagtggaaaatcaagatgcaatagacactgctatagtgggaatgttgagtgatccaaaggaggctcgagttggtattcaagaggttcacttccttccattcaacccaactgataagcgaacagctttaacatatatagacagtgagggtaaaatgcatcgggtcagcaaaggtgcaccagagcagattttgaatcttgcacacaataaatcagagatagaacgtagagtccatgctgtgattgataagtttgcagagcgaggattacgttctcttgcagtagcataccaggaagttcctgatgggaggaaggagagccaaggagggccatggcagtttattggtctcatgcccttatttgacccgcctagacatgatagtgcagagacaatacgaagagcattgaatcttggggtgaatgttaagatgatcacaggtgatcagctggcaatagcaaaggaaacaggacgccgtctgggaatgggaaccaacatgtatccttcatctgctttgttaggacagaacaaagacgagtcaatagctgctttgcctgttgatgatctgattgaaaaagctgacggatttgctggagttttccctgagcacaaatatgagatagtaaaacgtctgcaagctaggaagcatatatgtggaatgactggtgatggagttaatgatgctccggctcttaaaaaggctgacatcggcatagctgtcgctgatgcaactgatgcggctcgtagtgcttctgacattgttctgacagaacctggtcttagtgttatcattagtgctgtactgactagtcgggcaatattccagaggatgaaaaattacacgatatacgcagtttccattacaatacgtattgtgcttggttttatgttacttgctctcagtttgacttcccacccttcatggtgctgattattgctatccttaacgatggtaccattatgacaatatcgaaggatagggtgaagccatctcctcttccagatagctggaagctagctgagatctttacaactggaataattcttggtggttatttggctatgatgacagtcattttcttctgggcagcatacaagacagacttctttcctcgtacatttggggttcgaagccttaagcaagaggatgattttagaaggcttgcctcagcagtatatctgcaagtgagtactgtaagtcaggccctcatattcgtgacaagatcccggacttggtcttttgttgagcgtcctggcttgttacttgtagcagcttttattgttgctcagctgtttgccacactgattgctgtttacgcaaactggaaatttgctgcagttcaagggattggatggggctgggctggtgttatctggctctataacatcatcttttatatcccacttgattttatcaagttctttacccgatatgccttaagtgggagggcttgggatcttgttattgagcaaaggattgccttcacaaggaaaaaggatttcgggaaggaagaacgggagcttaaatgggcacatgcacaaaggacactccatgggcttcacccacccgagtccaagatgttcactgagcgtgcaagttactcagaacttaatcaaatggctgaagaggcaaaaagacgagctgagattgctagactaagagaaatgagtacattgaaaggacatgttgaatcagtggtgagattgaaggggcttgatatagatacaattcagcaatcatacactgtctgatagatcgtacacttccattcctcatggtgtaatgatggaagcaaaagagccatagtttgtcattctattgtataaatcatatccacctacatttatatatcattactagacagttgtttctaaacatgtgcgagtctgcttgattgtaaattgggctgctattcgtttctctttctttaacatttctttttttt

SEQ ID NO: 2333 - DNA, 2488 bp, Helianthus annuus
  misc_feature (852)..(852): n is a, c, g, or t
  misc_feature (915)..(915): n is a, c, g, or t
  misc_feature (1278)..(1278): n is a, c, g, or t
  misc_feature (1905)..(1905): n is a, c, g, or t
  misc_feature (2040)..(2040): n is a, c, g, or t
  misc_feature (2295)..(2295): n is a, c, g, or t
  misc_feature (2350)..(2350): n is a, c, g, or t
  misc_feature (2370)..(2370): n is a, c, g, or t
  misc_feature (2403)..(2403): n is a, c, g, or t
aaaggtcccggagacggtgtttattccggttcgacttgcaaacaaggtgaaatcgaagcggttgtgattgccactggggtccacacgttctttggtaaagctgctcatcttgttgatagcacaaatcaagtcggtcactttcaaaaagttttgactgcgatcgggaatttctgtatttgttctattgctgtgggtatggttatcgaaattatcgtaatgttcccgattcaagataggcaatataggcccggaatcgataatcttctcgtgcttttgatcggaggcatcccgatcgctatgcctaccgttctttctgtaacgatggctatcgggtctcatcgattggctcaacagggagcgattacgaaaagaatgacagcgatagaagaaatggcgggaatggatgtgctatgcagtgacaagaccgggacgttgactttgaacaagcttacagtagacaagaatcttattgaagtgttttccaaaggagtagatgccgataccgttgttctgatggcagcgcgtgcctccagaaccgaaaaccaggatgccatcgatgctgcaattgtcggtatgctggctgatccaaaagaggcgcgtgctgatgttcaagagttgcactttttgccgttcaatcctaccgataagcgtacggccttaacgtatctggacaatcagggtaaaatgcatagagtcagcaaaggtgcccccgagcagattttgaatcttgcgcacaacaaatcagacatcgaacgccgggttcatgctgtcattgataaatttgcagaccgtgggttaaggtcacttgctgtagcataccaggaagttccggagggacggaaagagagcgcnggagggccgtggcagttcattgggctaatgccgctttttgatccgccacgtcatgatagcgcngagacgattcgaagggctttgaatcttggagtaaacgttaaaatgattacaggggatcaactggcaatcgggaaagaaaccggaagacgtcttggaatgggaaccaacatgtatccttcttctgctttactcggtcaaaacaaagacgagtcaattgccgctttacccatcgacgaactcatagagaaagccgacggttttgccggtgtttttccggaacacaaatacgaaatagtaaaacgtttacaagctaggaaacacatatgtggcatgactggagatggagtaaatgacgctcctgcccttaaaaaagccgatatcggaattgcggtggctgatgcaaccgatgcagcccgtagtgcntccgacattgtccttactgagcccgggcttagtgtcatcatcagtgctgttttgaccagtcgggccatcttccaacggatgaaaaattacactatttatgcagtttcaatcaccattcgtattgtgctcggttttatgctgctggcgttgatatggaagtttgacttcccgcctttcatggtgcttatcatcgcaatccttaacgatggaaccataatgaccatatcaaaggatagagtgaagccatctcctcttcccgacagctggaaactggctgagatcttcaccaccggggtggttctcggtagttacctagccatgatgacagttatatttttctgggccgcttataaaacagacttctttccgcgtacatttggtgtaccgacgcttgaaaaaacagcgcacgatgacttccggaagctggcgtcagcgatatatctccaagtcagcacaatcagccaagctctcattttcgtaacgagatctagaagctggtcattcgtggaacgtcctggttggctgctcgttattgcttttgcgattgcccaattggttgcgacattaattgcggtttatgccaactggagctttgctgctgtagaaggaatcgggtggggatgggcnggagtcatctggctctacaatatcgtgttctatttcccgctcgatatcatcaagttctttatccgatacgcgcttagtgggcgggcctgggaccttgttattgagaggaggattgcgttcacgagacaaaagganttcgggaaggaacaacgtgagctccaatgggctcatgcgcaacgaacccttcacgggcttgaagttcctgacactaaaatgtttggcgaccgcaccaatgtcacggaacttaaccagatggctgaagaagccaaacggagggctgaaattgcaaggttgagagaattacacacgttgaagggtcatgttgaatcggtggttagactcaagggtcttgacattgagacgattcaacaagcgtacaccgtctgaganacagttggctggctgttggttaccgttggaacagtcgttttttgttttttatttntttttgttttgtcttggctngtgatcccatatacttgtgaattgggaaaaagngaacccgtaatatgttgtgcatatggcgttggcctcaatacttacgagtagatgtgataattttgacgcagttattttgaaaagc

SEQ ID NO: 2334 - DNA, 2374 bp, Triphysaria pusilla
atcaagtgggccatttccaaaaggtgttgacgtcaattgggaacttctgcatatgctcaattgctgtgggaatgattatagagattattgtgatgtacccaattcagcacagagattaccgtcccggaattgacaatctccttgctcattggagggattccgattgctatgccgactgttctttccgttacaatggccattggttctcatcgtttggcacaacagggagctattacaaagagaatgacggctatagaggaaatggctggcatggatgtgctttgcagtgataagaccgggactttgacactgaataagcttaccgttgacaagaatcttattgaggttttcactaaaggaatagatgcagatactgttgttttgatggctgctcgagcctctaggactgagaatcaagatgcaatagatgctgctatagttgggatgttggctgatcccaaggaggcacgagctggcattcgagaaatacacttccttccttttaaccctactgataagcgaactgcgttgacttacatagatggtgagggaaaatggcacagggtcagtaaaggtgcaccggagcagattatacaccttgcacacaataaatcggacatagagcgaagggctcatgctgtgattgacaagtttgctgaacgaggtttgaggtcgcttgccgtggcgtaccaggaagttccagaaggaacgaaagagagtccaggaggcccgtggcagtttattggtctaatgcccctctttgatcccccgagacacgacagtgcagaaactataagaagggctttaaatcttggagtgaatgtcaaaatgataactggtgatcaactcgcaataggaaaagaaaccggacgaaggttaggaatgggtactaacatgtatccttcatctgctttgttgggaaagaacaaggacgaatcaattgctgctctaccaattgacgagctcatagaaaaagccgacggatttgccggtgtctttccagagcacaagtacgaaattgtaaagcgcctacaagctctaaaacatatatgtggaatgacgggtgatggggtaaacgatgctccggctctgaagaaggctgatattggaattgccgttgccgatgccaccgatgcagctcgtagtgcttctgacattgttcttactgagcctggcctcagtgttattattagtgctgttttgactagtcgtgcaatttttcaaaggatgaaaaattatacgatttatgctgtttctattacgattcgtatagtgcttggcttcatgttgttagcactcatatgggaattcgactttccaccttttatggtgcttatcatagcaattctcaatgatggtacaattatgacgatatcgaaagatagagtaaaaccatctcctctgcccgacagctggaagcttgccgagattttcgcaactggagtcgttcttggcggttacttggctatgatgactgtcattttcttttgggctgcgtacaaaacagatttctttccgagtgtatttggggtgtcgactcttgagaaacggcccatgatgactttagaaagctcgcttcggcaatatatcttcaagtgagcactatcagtcaagctctaatatttgtcacaagatcccgaagctggtcatatgtcgagcgtcctggtttgttgcttgtggccgcctttatagttgcccaactggtagctactctcattgccgtttacgcaagttggagctttgcggctattgaagggattggttggggctgggccggtgtgatttggctttacaacatcattacctacatcccacttgatatcctcaaattcttgatccgttacgctctcagtggacgggcttgggatcttgtttttgagcgaaggattgcattcaccaggcaaaaggatttcggaaaagagcaacgtgagctcaaatgggcccatgcacaaaggacccttcatggccttgaagtacctgataccaaaatgttcggcgaaactaacaatttctcggaacttaatcagttggctgaggaagcaaaaaggagagccgagattgccaggttaagggagctgcatacactaaaaggtcatgttgaatcggtggtgaggctaaagggcctcgatatagaaacgattcagcaatcatacaccgtatgaggaggtttaatctatatgttcgacgtgtgcaattaaactcgagcttggagtcgaggtaatttgtctttgtttagttgttttgagtatatataatagatgtggcaagctctggatcgattataaacttgcatttgcggataaataacggtattttattgtcagtaagttgatatttttatgcctgtaatgcgtctcagtggcgcttgcgtgat

SEQ ID NO: 2335 - DNA, 3278 bp, Arabidopsis lyrata
gagtgtattagcttcccatactgccactaacctttagcggttttctcatcttctcttctcatctttctctcctctgaaacccaaaagacataaacgaagaagaagataaagatatcaacttgtgaaacaggaggtagcaggagaatatgggggacaaggaagaagtccttgaggctattttgaaagaaactgtggatctggagaatgtgcctattgaagaagtttttgagagtctgagatgtagcagagaaggtctcactacagaagctgctgatgaaaggcttgctctttttgggcataataagctcgaggagaagaaggaaagcaaattcctgaaatttcttggtttcatgtggaatcctctttcttgggttatggaagctgctgctatcatggctattgttcttgctaatggaggagggaagcctcctgattggcaagactttgttggtattattactctgcttgtgataaattccaccatcagtttcatagaggaaaacaatgccgggaacgcagctgctgctcttatggcacgtcttgcccccaaagcaaaggttcttcgagatggaaggtggggggagcaggatgctgcaattcttgttcctggtgacatagtcagcatcaagcttggggatattgttccagctgatgctcgccttctcgagggtgatccccttaagattgatcagtcttctcttactggtgaatctctcccagtaaccaaaggtccaggggatggtgtgtattccggctccacttgcaaacagggagagcttgaagcagttgtgatcgcaacgggagtccataccttctttggaaaggctgcgcatcttgtcgatacgaccaaccaagttggccactttcaacaggcatgatttcttacacgtgttaactgccattgggaatttctgcatctgctctattgcagtggggatgataattgagattgtcgttatgtatcccattcaacaccgagcatatcgtcctggaattgataaccttctggtgctcctcattggcggtatcccaattgctatgcctacagttctctctgtgaccatggccattggctcacataggttatctcagcagggagcaataaccaagaggatgacagcgattgaggaaatggctggcatggatgtgctttgcagcgacaaaaccggaactttaacattgaataaacttactgttgacaaaaatcttatcgaggttttcacgaaaggagtggatgcagatacagtagttctgatggcagctcaagcctctagactggaaaaccaagatgccattgatgctgctatagttgggatgcttgctgaccctaaagaggcacgagctggtgttcgagaggttcactttcttccattcaatcccactgataagaggacggctcttacatatattgacagtgatggtaaaatgcatagggtcagcaaaggtgcacctgagcaaatcctaaatcttgcgcacaataaagcagagattgagcggagggttcatgctgtaatagacaagttcgctgaacggggtttacgatctcttgccgtggcataccaggaagttccggaagggacgaaggaaagtgctggaggcccttggcaatttatgggtctgatgcctctttttgacccacctaggcatgacagtgccgagacaattagaagggctttaaatcttggggtgaatgtcaaaatgatcacaggggatcagttggcaataggaaaagagactggacgccgtttagggatgggaaccaacatgtacccttcatctgctttactcggacagcacaaggatgagtctataggtgccttacccatcgatgatctcatagaaaaggccgatggctttgctggcgtctttcctgagcataaatatgagatagttaagcgactacaagcgaggaagcatatttgtggaatgacaggtgatggagtaaatgatgcgcctgctcttaaaaaggctgacattggcattgccgttgctgatgcaactgatgcagcacgtagtgcttcagacattgttcttactgaacctggtcttagtgttatcatcagcgctgtcttgaccagtcgtgctatcttccagagaatgaaaaattatacaatctatgcggtttccatcactatccgtattgtccttggcttcatgctgctggctcttatatggaagtttgactttccacccttcatggttcttatcatcgctatcctgaatgatggaacaattatgacaatatcaaaagacagagtgaaaccttcccctcttccagatagctggaaactctcagagatttttgcaactggcgttgtgtttgggagctacatggcaatgatgacagttatatttttctgggctgcatataaaaccgacttcttcccgcgaacttttggagtttcaacccttgagaaaacagcacatgatgatttccggaagcttgcctcagcaatatacctgcaagtcagcatcataagtcaggcacttatctttgtgacccgatcacggagttggtcttatgtagaacgtcctgggatgtggcttgtgatagcctttatcctcgcacaattggtggctactctaattgcagtctatgcgaattggagctttgctgcaatagaagggatcgggtggggatgggccggggtcatctggctttacaatatcgtattctatattcctcttgatatcatcaagttcttgattcgttatgcccttagcggaagagcctgggatcttgttatcgaacaaagggttgcattcacgaggcagaaggatttcgggaaagaacaaagggagctacaatgggcgcacgcacagagaactctgcacggcctgcaagcaccagatgctaagatgttcccagagcgaacccatttcaatgagctttcccaaatggctgaagaagctaagagaagagccgaaatcgccaggttgcgggagcttcacacactcaagggtcatgttgaatctgttgtgagactaaagggactcgacattgaaaccattcaacaagcttacaccgtctgagagaagcatagagagagcccaagaaccgtctcaaaatcgttcaatatccctgtttgaaacttcgatacaaattatgcatataaagtatcagtttcttagtagtctttttggttggtttttatttcttcttctgagttttaagatatgttctgttattatgatgaaaagtatgacagaaaatagaaacagagtcctcaaaatgcaagacaaatttttattttgcaatacatctgatgttataaatc

SEQ ID NO: 2336 - DNA, 2320 bp, Capsicum annuum
cggtcgctgctcattggttctcctcgtctcgctcaacagggtgcaattacgaaaagaatgacagcaattgaggagatggctggcatggatgtgctttgtagtgacaagacgggaaccttgacactaaacaagcttactgttgacaaaaaccttgttgaggtttttgccaaaggtgttgatgcagacactgttgttctgatggcagctcgagcttctcgaacagagaaccaggatgccattgatactgctattgttgggatgctgtctgatccaaaggaggcacgtgctggcattcgtgaaatacactttcttcctttcaatccaactgacaagcgaacagcacttacttatcttgatggtgaaggaaaaatgcacagggtcagcaaaggggcaccagagcagatcctaaatcttgcacacaacaagtcagacatagaacgtagagttcatgcggtaattgataaatttgctgagaggggcctgcgttcacttggtgtagcataccaggaagttccagagggaaggaaggagagccctggaggaccatggcaattcattggtcttctgcctttgtttgatccaccaagacatgatagtgctgagactataaggagggctttgaatcttggagtgaatgttaaaatgatcacaggggatcaacttgctataggaaaaaaacagggcgtcgcctgggaatgggaaccaacatgtatccttcatctgctctgttggggcagactaaggatgaatcaattgcttctttaccaattgatgaattgatagaaaaggctgatggttttgctggagttttccctgagcacaaatatgagatagtaaagcgcttgcaagctaggaagcatatttgtggaatgactggtgatggagtcaatgatgctcctgctttaaagaaagccgatattgggatagctgttgatgatgccactgatgctgctcgtagtgcttctgatattgttcttactgaacctggtctcagtgtcatcattagtgctgttttgactagtcgagcaatcttccaaaggatgaaaaactacacgatatacgcagtttccatcacaatccgtattgtgcttggttttatgcttctggcccttatctggaagtttgactttccacctttcatggtgcttatcattgcaatcctcaatgacggtaccattatgacaatatcaaaggatagggtcaaaccatctcctctgcctgatagttggaagctggctgagattttcactactggggtggttcttggtggttacttggcaatgatgacggtcattttcttttgggcagcatatgagacagatttcttcccgcgtgtatttggggtatcaacacttcagaagacagcaactgacgacttcaggaaacttgcatcagcaatttaccttcaagtgagcactatcagtcaggccttgatatttgtcacaagatctagaagttggtcgtttgttgagcgtcctggtttgttgcttgtgattgcttttctgattgctcaactggttgccaccttgattgctgtttatgcaagttggagctttgctgcaatcgaaggaattggctggggttgggcaggagttatctggctctacaatttagtattctacttcccgcttgatatcatcaaattcttgatcagatatgctctcagtggaagggcctgggatcttgttcttgagcaaaggatcgctttcaccaggaagaaggatttcggaaaagaacaacgtgagcttcaatgggcacacgcacagaggacccttcatgggctgcaagttcctgacaccaaattgtttagtgaagctaccaatttcaatgagcttaatcagttggctgaggaagcaaagagaagagctgaaatcgctaggcaacgtgagctgcacacacttaaaggtcacgtggaatcagtcgtgaagttgaagggtcttgacatagagacaattcagcaatcatacactgtttgatgggagagtgagcatgtttgactagcgttacttaaccggtgagttggtgatagaatgaagacataatgagtgtgagttacctctggagcaacaagttcatagtagtaaagtcttcagcgcttaaaagtgccttatatattctatacatttttttccttcgaatttttgttttttcttttcttgctttcaagacttgactccattatatatgtgacaattgaccaagaatgaatatttcagctataacagcattcatcgtctatattctcaagagtgtttatttcatggttcaacagcatttgatttttgtactgcctcttgattatagaagttgaattttattg

SEQ ID NO: 2337 - DNA, 2653 bp, Gnetum gnemon
cgcctggtgaaggagtgtattctggatccacatgcaagcagggcgaacttgaatgtgttgttattgctactggggtgcatactttctttggcaaagcagctcatcttgtagacactacgaatcaaattggacattttcagaaggttttaactgcaattgggaaactttgtatatgttccattgctgtaggcatgataattgaaattattgtgatgtatccaattcaagatcgaaaatatcgccctggtatagacaacctccttgttcttctcattggtggaattccaatagccatgccaactgttctttctgtaacgatggctatcggttcccatcgtctatctcagcagggtgccatcacaaaaagaatgacagcaattgaagaaatggctggaatggatgtattatgtagcgacaaaactgggactttgacactcaataagcttacagtggacaaaaatctcatcgaggtattttccaaaagatttgacaaagacgcaattgtcttgatggctgcaagagcatctcgaacggaaaatcaagattccattgatgcagctattgtggggatgcttgctgatccaaaggaggctcgtgcaggcattcaagaaattcattttctccctttcaaccctactgacaaaaggacagcccttacctatacagatgctgaaggtaaaatgtatcgcgctagcaaaggtgctccagagcagattctcaacctcgcccataataagccagagattgagcgccgtgttcactcagtcattgacaaatttgctgaacgtggacttcggtcccttgccgttgcttatcaggaagttccagaatgccgtaaagaaagtgctggaggaccttggcacttccttggtctgatgcctctttttgatccacctcgtcatgatagtgctgaaacaatacggcgagcactaaatcttggtgtgaatgttaagatgattacaggtgatcagttggcaattggtaaggagactggccgacggctgggtatgggtacaaacatgtacccatcatcatctttgttaggccaggataaggatgaatctattgcagccttgccaattgatgatttgattgaaaaggctgatggttttgctggagttttcccagagcacaaatatgagattgttaaaagattgcaagcaagaaagcatatatgtggaatgactggtgatggagttaatgatgcacctgcactgaaaaaagcagatatagggattgcggttgcagatgcaaccgatgccgcaagaggtgcttcagatatagtgctcacagagccaggtcttagtgttataataagtgcagtattgacaagtcgggcaatctttcaacgaatgaaaaattacactatatatgccgtatcaatcacaattcgtattgtgctaggtttcatgcttttggctctgctatggaagtttgacttcccaccgttcatggtgctgataatcgccatcttaaatgatggtaccataatgactatatctaaggacagagtcaagccttctcctttgccagatagctggaaacttgcagagatttttgctactggaattataattggtagttacctggcattaatgactgttatattcttttgggctgcatacaaaacagattttttcccgagaacatttggtgttgagagtcttcaacataaagatcaagatgactttcggaaattgagtgctgcagtgtatcttcaagtcagtactattagtcaggctctcatatttgtcacccggtcacgaagttggtcgtttgttgaacggcctggtcttctacttgtgtttgcatttgttgttgcacaattgattgctacactgattgcagtatacgccaattggggttttgcagccatagagggcatgggttggggctgggctggtgttgtgtggttatacaatatcatcttttactttcccctcgacataataaagttctttatccgttatgcccttagtgggaaggcttgggaccttgtgattgaatcaaggactgcgttcacgaggcagaaggattttggtaaagaagcccgagaacttaaatgggcacatgctcagagaacacttcatggtttgcacccacctgacacaaaaatgttcagtgaaagaacatacgtttctgatctgaatcaaatggccgaggaagctaagagacgtgctgagattgcgaggctgagagagttgcatacattgaaaggacatgttgagtctgttgtgcggctgaagggcctggacattgacacaattcaacaggcatacactgtctagtatattcctctgcttttcacggatgtggtattttgcatgaggtgttctgcattgacaaaatttgtagctgctgaacgccaagcattttcctgaacggaatataaagttgaataatgaatgcacctaccttttttccttgctatttaacataagaaatgtaccctgctttttgctttgtcaaaactcttgtgacagctccagacagtgcaactcgcaaatgctgtgatattagcatgcttatagatcttctaatgccgtagactggaagaattgatgaattgttctcttcgtatcttcaaaggttcaactgctcttgttggtatgtaccatggaacttgctgggctagttattacagatcaaactc

SEQ ID NO: 2338 - DNA, 2247 bp, Panicum virgatum
ggcaattggggcacatcgcttggctcaacagggagcaattaccaagagaatgacagcaattgaggaaatggctggcatggatgttctatgcagcgacaagactgggacattaaccttaaacaaattgactgtcgacaaaagtctcattgagatattccaaaaaggtgttgaccaggatacagtaattctgatggctgccagagcttctcgtacagaaaatcaggatgccatagatgccacaatagttggtatgctggctgatccaaaggaggctcgtgctggtgttcaagagattcactttctgccatttaatccaactgacaaaagaactgctttaacctaccttgatagagagggaagaatgcatcgtgttagcaagggagcaccagagcagatcctgcatcttgcgcacaacaagtcagatattgaaagaagggtcagagctgtgattgacaaatttgctgagcgtggtctgcgagcacttggtgtggcttaccaggaagtgccagatggtaggaaagagagtcctggaggaccatggcagttcatcgggctcttgccactttttgacccccctcgtcatgatagtgcagaaacgatcagaagggcactcgatcttggtgtcaatgtaaagatgattacaggtgatcagcttgctatcgggaaggagacagcacgccggttgggaatgggtaccaatatgtacccttcatctgctttactcggacaggataaggatgagtcaattgctactttgccagttgatgaattgatcgagaaggctgatggctttgctggagtctttccagaacacaagtatgagattgtgaaacgcttgcaagcaagaaaacacatttgtggtatgactggggatggtgtaaatgacgccccagctttgaagaaagctgatattggtattgcagtagcagactccaccgacgcagcacggagtgcttcggacatcgtcctcactgaaccaggccttagtgtgattattagtgctgtgctgacgagtagggcaattttccaaagaatgaagaattatacgatatatgctgtgtcaattaccatccgtattgtgcttggttttatgcttcttgcgctgatatggaagtttgacttcccaccatttatggtcctcatcattgctatcctcaatgatggtaccattatgactatctcgaaggacagagtaaaaccatctccacagcctgatagttggaagttagctgagatctttgcaactggagtagttcttggtggatacttggcgatgatgacagtcattttcttctgggctgcatacaagactaacttcttcccgcgagtgtttggtgtcgaaagccttgagaaaactgcacaggatgattttcagaagcttgcctctgctgtgtaccttcaagttagcacgatcagccaagctctcatctttgtgacaaggtctcgcagctggtcatttgtggagcgtcctgggttcttgctagtttttgctttcttggtggcacagctgattgctactgtgattgctgtatatgccaactgggcgtttgctgcgatcaagggcattggatggggctgggccggtgtcatctggctttacaacatcgtcttctactttccgctggatatcatcaagttcctcacccgttacgctctgagcgggagagcatgggacctagtccttgagcagagggttgcgttcacgaggaagaaggattttgggagggcagatagggagctcaagtgggcgcacgctcagaggacgctccacgggcttcaggcaccggaggcaaccatcttcgagaacaagacgaccttcaatgaactcaaccagctcgcggaagaggcacgcaggagggccgagatggcgaggttgcgagaagtgaacaccctgaaggggaggatggagtcggtggcgaagcagaagggcttggacatcgagacgatccagcagtcctacaccgtgtgatggattgattaattatttacaggcggcggcttcttactatatgtactaggcagcaataaggaaaacccatggttgggcctcgatgatgatgatgatgatgatgattacatgtttctgacgtcggtggggtgctttatcgccatagtctcacctcaccccctacatgctgcttgctgtccattaaccacccccggcagaccatttaccggcattgagatgacgagatatactctgtagtccatagtagatgatgatataatacatcttttttgcttgtg

SEQ ID NO: 2339 - DNA, 3421 bp, Avena sativa
gccgtcccccaagccgagcccctgctctgctccggtgactggagtccggactccgggctcaaaccctctcttcctcccctcagcagagagagagagagagagagagagagagagagggaggaatccatcagcgagcgcgaagggtggagccatggacgagaaggagtccaatctggacgccgtgctcaaggagtcggttgatctcgagaacataccgttggaggaggtgttcgagaacctgagatgcagccgcgagggcctctcctcctcccaggccgagcagcgcctcgacatcttcggccccaacaggctcgaggagaagaaggagagcaagttcctcaagttcctggggttctgtggaacccactgtcatgggtcatggaggccgccgccatcatggccatcgccctagccaatggaggggtaagttcttaatgctcgagagcaatatggtatcggagatgcattctgggtattactgtgtatggagagaatttcttgatgtgtttgtagggcaagccaccggattggcaggactttgtgggaatcatcaccctgctcatcatcaactccacaatcagcttcattgaggagaacaatgcgggcaacgccgccgctgctctcatggcccggcttgcacccaaggcaaaggttcttaggaacggtaagtggaacgaggaggagtcagccatccttgttccaggagacatcatcagtgtaaagcttggggatatcatcccagccgatgcccgtctccttgagggtgatccgctgaagattgaccagtcttccctcactggggagtccctgcctgtgaccaaaggccctggcgatggggtttactctggctcgacttgcaaacagggtgaactcgaagctgttgtcattgccactggtgtgcacacgttctttggcaaggccgcacatctcgttgattcaacaaaccaagttggtcatttccagaaggttctgactgctattgggaacttctgcatctgttcaattgctgtgggaatggttattgagattgttgtcatgtacccgatccaacatagggcttaccgacctggaattgacaaccttttggtgcttctcattggaggaattcccattgccatgcccactgtgctttctgtgactatggctatagggtcacatcgcctggctcaacagggagcaattacaaagaggatgacagcaattgaggaaatggctggcatggatgttctctgcagtgacaagacagggacactgaccttgaacaagctgaccgtggacaagaatctaatagaggttgtccaaaggggtattgatcaggataccgtgatactaatggccgccagagcttcacgtacagaaaatcaagatgccatagatgccacgatggttggtatgctcgctgatccgaaggaggctcgtgctggtattcaagagcttcattttctgccattcaatccaactgacaaaagaactgctttaacctaccttgatggagaggggaaaatgcatcgtgttagcaagggagcaccagaacagattctagaccttgcacacaataaatcagagattgaaagaagagtccggcttgtgattgacaaatttgctgagcgtggtctgcgatcactcggtgtggcataccaggaagtaccagatggtagtaaagaaagtcctggaggaccatggcagtttattggactcttgccactttttgacccccctcgacatgatagtgcagaaacaattaggagggcactccatcttggtgtcaatgttaaaatgattacaggtgatcaacttgcaattgggaaggaaacagcacgccgtctaggaatgggtactaatatgtatccttcatctgctttactgggacagcacaaggatgattcaattgttgctttgccagttgatgaattgattgagaaagctgatggctttgctggtgtctttccagagcacaaatatgagattgtgaaacgcttgcaagcaagaaaacatatctgtggtatgactggagatggtgtaaatgatgctccagctttaaaaaaggctgatattggcattgcagtggatgactcgactgatgcagctcgtagtgcttcagacattgtcttaactgagccaggccttagtgtgattattagcgctgtgttaacaagtcgagcaattttccagcggatgaagaattacacaatatatgcagtgtcaattacaattcgtattgtgcttggttttatgcttcttgcgctgatatggcagtttgacttcccaccttttatggtcttgatcattgcgatcctcaatgatggtaccataatgactatctcaaaggacagagtaaaaccatctccacaacctgatagctggaagttatctgagatttttgcaactggggtcgtccttggtagttatttagccatgatgacagtcatcttcttctgggcagcctacaaaactgacttcttcccgcgtgtgtttcatgtcgaaagccttgagaaaactgcccaggatgatttccagaagcttgccgctgctgtctacctgcaagttagcacaatcagccaagccttgatctttgtaacacggtctcgcagctggtcatttatggagcgtcctggatttttgctggtctttgctttcttggtggctcagctgattgctactcttattgctgtgtacgccgactggggatttgccgcgatcaaaggcattggatggggctgggctggtgttatctggctttacaacatcgtgttttacttgccactagatgtcatcaagttcctcattcgttacgcgatgagcgggagagcctgggaccttgtccttgaccaaaggatcgccttcacgaggaagaaggatttcgggcgggaagaacgtgagctgaagtgggcaactgctcagaggacgctgcatggacttcagccagcagagttgaccactttccatggcatgaacagctacagcgaactcaatcagctcgcagacgaggcccgcaggagagctgaaatcgcgaggctgagggagctgaacaccctgaaggggcggatggagtcggtggtgaggcagaagggtttggaccttgagaccatccagcagtcgtacaccgtgtgattggttatatatactaggaggctttggaggtcacatatgctagggaacaaataatgattctgatctgagcgttgtttccggtgtcgtcggtgcccctcttatgccccccagcagattgactgcgttgatatagtagtagtaatagtggtggtggtgctagtacagtacaatctactgtatgagtttagtacgtatgattatatactagtagtacattttgggtttgttatctctggtgtgggtcacctggtgctgattctgaatcctgtgtctgaactggtaacggcaacatggccatcacatggacccg

SEQ ID NO: 2340 - DNA, 2600 bp, Taxus baccata
attaaacttggagatattgttcctgcagattgtagacttctcgaaggagaccctttgaagattgatcagtctgctctaactggagaatcattgccagtgaccaagaatcctggtgatggggtttactcaggttcaacttgcaagcaaggtgaactcgaagctgtggttatagctacaggagtccacaccttttttggtaaagcagcccatctcgtagactcaacaaataatgtgggacattttcaaaaggttttgacagcaattggaaacttttgcatctgttctattggtgtgggcatgataattgaaattatagtacaatatccaattcagcatcgcccatatagacctggaattgataatctattggtgcttctaattggtgggattccaatagcaatgccaactgttctttctgtgactatggccattggttcacatcgcctttctcaacagggtgctattacgaaaaggatgactgccattgaagaaatggctggaatggatgtgttgtgcagtgacaagactggaacattaacacttaacaagcttaccgttgacaagaatctgattgaggtatttgcaaaaggaattgacaaggatatggtggtcttgatggctgccagagcatccagaacagagaatcaagatgccattgatgcagctattgttgggattcttgctgatcctaaggaggcaagagcaggcattcaagaagttcactttcttcctttcaatccaaccgacaaacgaacagcgctgacttacattgatggtcaaggtagaatgcatagagttagcaaaggtgcacccgagcagatcctcaacctggcacataacaaatcagagattgagcgcagagttcataccataattgacaagtttgctgaacgtgggctccgatctcttgcagttgcatatcaggaggtgtccgatggcaggaaggaaagtccaggaggaccctggcaatttgttggtcttatgcccctctttgatcctccacgccatgatagtgcagacacaataagaagggctctcaacctgggtgttagtgttaaaatgattacaggagatcagctagctataggcaaggaaacagggcgtcgattgggcatgggtacaaacatgtacccatcttcatctctgttaggccagtcgaaagatgcatcaattgaagctttaccagtggatgatttgatagaaaaggctgatggttttgctggtgtcttccctgaacacaagtatgagatagttagacgactacaagcaagaaagcacatatgtggaatgactggggatggtgtgaatgatgcaccagcacttaaaaaggcagatattggaattgctgtggcagatgctacagatgcagctcggagtgcttctgacattgttctcacagagccaggattaagtgttatcattagtgctgtgttaacaagtcgtgcaatctttcaacgaatgaagaattatactatatatgctgtgtccataacaatacgtattgtgcttgggttcatgcttctggcattgatatggcagtttgactttccaccattcatggtactgataattgccatattaaatgatggcaccataatgaccatttccaaagacagggtgaaaccatcacctctgccagacagctggaagctttcagagatttttgccacaggcattatcattggcagttacctagcaatgatgaccgtcatattcttttgggcagccttcaagacagatttctttccgagaacatttggtgtttctaatcttcatattcctagtgaagaaaatactcgaaaattgagtgctgtagtgtatcttcaagtgagcactataagtcaggctcttatatttgtgacccgatctcgaagttggtcttttgtagagcggcctggcctgttgcttgtaggtgcattcatggttgctcagctgattgcaacattaattgcagtttatgcaaactgggaattcgctgcaattaagggcatgggttgggttgggccgggatagtgtggctttacaacataatcttctacttccctcttgatctcatcaagtttgcaattcgatatgccatcagtggaagggcttgggatttgcttattgagcaaagaattgccttcaccacccagaaggactttggaaaagaagcgagggagatcaaatgggcccatgctcagaggactttgcatggattgcagcctccagacactaagatgttcggtgatagaaacagcttcagagacctcaatcaaatggccgaagaggcaaaaagacgtgctgagattgcaaggctgagagagctacatactctgaaagggcatgttgaatctgttgtaaagctcaagggattggatattgaaacaattcagcaagcttacactgtttgaaggatggctgttctaccttattctgctatactgtataataattttagcaacattcacgtacactccaacagaacagatattttacaagtttctctcacatggagagcttgttaggaaatagggaaacaatgtgtgctcttaagagctttattttcccttgaggtaacatcatcaatggttgtatgtgaaatctcatttgccattaac

SEQ ID NO: 2341 - DNA, 1760 bp, Pennisetum glaucum
tcacaacaagtcagagatagagaggagggtccatgctgtgattgataagtttgctgagcgtggacttagatcgcttgctgtagcatatcaggaagtacctgaggggaggaaagaaagtcctggtggcccatggcactttgttggtctaatgccactttttgaccctccaagacatgacagcgctgaaacaattcgaagggcactcaaccttggtgttaatgtcaagatgatcacaggtgatcagctggcaattggaaaggaaacaggacgtcgcctaggaatgggtacaaatatgtatccttcttctgctttgttaggacagaacaaggatgagtctattgctgctttaccagttgatgatctcatcgagaaagctgatggttttgctggtgtattccctgaacacaagtatgagatcgtgaagcgtctgcaagcacggaagcatatctgtggcatgactggtgatggagtaaatgatgcaccagccctaaagaaagctgatattggtattgctgttgctgatgcaactgatgcagccaggagtgcttcagatattgtcctcacagaaccaggacttagtgtgatcattagtgcggtgcttacaagtcgcgcaattttccagcgtatgaagaattacacgatctatgctgtctcgatcaccatccgtatcgtgcttggatttatgctccttgccctcatttggaaatttgacttcccaccattcatggtcctgatcatagcaattcttaatgatggtaccataatgactatatcgaaggatcgtgtaaaaccatctccactacctgacagctggaagctggctgaaattttcacaaccggagttttccttggtggatatcaagcaatgatgactgtcatcttcttttgggctgcatacaagacaaactttttcccaagaatatttcatgttgaaagccttgagaagactgctcaagatgatttccaaaagcttgcctctgctgtgtacctgcaagtgagcaccgtcagccaagctctcatctttgtgacaaggtcccggagctggtcatttgttgagcgccctgggtttctactggtctttgctttcttggttgcgcagctgattgctacgctgattgctgtgtacgctaactgggcattcacttcgatcaaaggcatcgggtggggctgggctggcgttgtgtggctttacaacatcatcttctacttcccgctcgacatcatcaagttcctcatccgatatgctcttagcgggaaagcatgggatctggtcatcgagcaaaggattgcatttacaaggaagaaggactttggtaaggaggagagggagctgaaatgggcacatgcgcagaggaccctccacgggctgcaggcaccggatgccaagatgttcccagagaaggctgggtacaatgagctgaaccagatggccgaagaggcgaagaggagggccgagattgcaaggctgcgggagcttcacacactcaaggggcatgtggagtctgtggtcaagctcaaggggctcgacatcgagaccatccagcagtcctacacagtgtgatgttgccattttatctgcctgtccagaagaaatgattcttttttttttgctttccgtttggccaccggaagtgtgaatttgacggtggctgggctctgttttgttgtatttagctgaactgcaataacatcacgccaagaactcttgatctctgtaatactatgcctttgtcctcgcatggtaacttttggtcgccaaa

SEQ ID NO: 2342 - DNA, 1933 bp, Triticum aestivum
ccacgcgtccgattggatagcgatggaaagatgtaccgagttagcaaaggtgcaccagagcagattcttaacctggcctacaacaagtcagagatcgcacaaaaagtccacactgtcatcgacaagttcgcggaacgtggacttcggtcacttggtgtagcatatcaggacgtgccagacggaaggaaagagagcccaggtagcccgtggcattttgttgctctcttgccactctttgatccaccgaggcacgacagcgcagaaacaattcaaagggcacttaaccttggtgtgaatgtgaagatgatcacaggcgaccagctagcgattgggaaggaaacagggcgtcgtctaggaatgggtacaaacatgtacccttcatctgctttgctggggcagaacaaggatgagtctattgctgatttaccagtcgatgatctaattgagaaagccgatggttttgctggcgtattcccagaacacaaatatgagattgtgaaacgcctacaagcacggaagcacatttgtggaatgactggcgatggcgtaaacgatgcaccagccctaaagaaagctgatattggtatagcggttgccgatgcgacagatgcagcgaggagtgcttctgatatcgtactcaccgaacctggtctaagtgtgatcattagtgccgtccttaccagtcgagcgattttccagcggatgaagaactacactatctatgcggtttcaattacgatacgtattgtgcttggatttatgctacttgccctcatatgggagtttgatttcccgccatttatggtcctgatcatagcaattttgaatgatggtaccataatgacaatatcgaaggatcgagtaaagccttctccactacctgacagctggaagttggctgaaatttttacaactggggtggttcttggcggatacttggcaatgatgactgtcattttcttctgggctgcatacaagactaactttttccctagggtcttccatgtaaaaagccttgagaagaccactcaagatgacttcaaaatgcttgcctctgctgtataccttcaagtcagcaccatcagccaagctctcattttcgttacaaggtctcgaagctggtcgttcatcgagcgccccggctttctcctggtctttgctttcttggtcgcacagctgatagctacactgatcgctgtatacgccgactggggattcacttcgatcaaaggcatcggatggggctgggctggcatcgtgtggctctacaacatcgtcttctacttcccgcttgacatcatcaagttcttcatccgatacgctctgagcggcaaagcatgggatcttgtcattgaccaaagaatcgcgtttacaaggaagaagcactttggtaaggaagagagggagctcaagtgggcccatgcacagaggacgctccatgggctgcagccaccgaatgccaagctgttccctgagaaggcgggctacaacgagctctgtcagatggccgaggaggcgaaacggagggccgagattgcaaggctcagggagctccacactctcaaggggcatgtggagtcagttgtgaagctgaagggcctcgacatcgacaccattcagcagtcttacactgtgtgataggttcaagtatccttaatgttactgtagaagagagagtatatccttgctgcataggaataacagacttttgataggttgcttttgccccctcttatatagttgactgctgatacatcgtgggaataaaacggttactacatctcagttgctctccagtcgctggttcgttgtgcttcatgtaaaggaatacagttatcctatctcttgcctctgcaactgggggttttaaccactgtttaagaaatctttccggttcaccgattaatcttccgatttatcactaaaaaaaaaa

SEQ ID NO: 2343 - DNA, 2013 bp, Lactuca sativa
ggccttatggccgcttgacggggataaaacagggactttaacactgaacaaacttactgttgacaaaaatttaatagagatatttgctaaaggagtggatgctgacatggtggtattaatggctgcaagagcatctagagttgaaaatcaagatgcaatagacgctgctatagtaggaatgttagctgacccaaaagaagcaagagctggaattaaagaaattcatttcctaccattcaacccaactgataaacgaacagcgttgacttatcttgatgatgaaaataaaatgcatcgtgtcagtaaaggtgctcctgaacagatcctgaatcttgcacataataaatcaaacattgaaaaaagagttcatactgtgatcgataaatttgctgagcgtggtttgcgatcccttgcagttgcatatcaggaagttccagagggaaagaaggaaagcccaggaggtccatgggaattcatcggcctcatgcctctctttgatccaccacgacatgacagtgcagatacaattaggagagccttgaatcttggagtaagcgttaaaatgatcacaggtgatcaattagcaataggaaaagaaacaggaagacgtcttggaatgggaacaaacatgtatccttcctctgcattacttggacaaaacagagacgaatccattgtcgcgttgcctgttgatgaattgattgagaaagcagatggttttgctggcgttttccctgagcataaatatgagattgtgaaacgtctacaagcgagaaaacatatatgtggaatgacgggtgatggagtgaatgatgcgcctgcgcttaaaaaagcagacattggaatagcggttgcggatgcaactgacgcggctcgtagcgcgtctgatattgtgttgactgaacctggtcttagtgttattatcagtgcggttttaactagtcgtgctatttttcaaaggatgaaaaattacactatttatgcggtttccattacgatacgtattgtgcttggtttcatgctgcttgcccttatatggaagttcgattttccaccctttatggtgcttatcattgctattctcaatgatggtacaattatgacaatctccaaagatagagtaaaaccctctccgttacctgacagttggaagttatcagagatttttgctactggaatcattcttggtagctacttagctatgatgacagtcatcttcttctgggctgcatacgaaaccaatttctttccgcgagtgtttggagtgtcaagccttcaaaaaggagcacgtgacgatttcagaaagctagcttcagctatatacctacaagtcagtacaatcagtcaggctctcatattcgttactcgatctagaagttggtcattctatgaacgacccggagctcttcttatgggggctttcttaattgctcaactcattgcaacattaattgccgtttatgcaaactggagtttcgctgcaatcgaaggaatcggatggggttgggcaggagttatttggctttacaacatcgtcttctacatccctctcgatttcattaaattcttcacaagatacgctttaagtggaagagcttgggatctagtcatcgatcaaaggttgctttcacaagaaaaagaaacttcgggaaagaagatcgtgagcttaaattggctcaagcccaaagaactctacatggactcgacccacccgaaacccaatatgttgaacgaaacaaccataatgagcttaatcaaatggctgaagatgcaattcgtagagctgagatgacaaggttgagagaattgcttacgttgaagggtcatgtggaatcggttgtaaaattaaagaacatcgatatcgataccatccaacaatcctatactgtttgagaagtacatcgtactaaatacttcatgtttgaaatctaaatctatgtatgtagtgtacatgtttgcgaatagtagtaatttgtcgttttaagttacgagtaatggaattattgatttata

SEQ ID NO: 2344 - DNA, 2238 bp, Panicum virgatum
accctgaacaagcttactgtttatcactgcaaagaacatccatgccagccatctcctcaatgcagtcatctctttgtgatagctccctgttgagacaaacggtgagacccatagccatagttacagataagactgtcggcatggctatggggatgcctccaatgagaagatggctggcatggatgttctttgcagtgataaaactggaacattgaccctgaacaagcttactgtggacaagaaccttgttgaagtttttgaaagaggcattactcaggatcaagtgattctcatggctgctagagcatcccgtacagaaaaccaagatgctattgatactgctatagttgggatgctagctgatcctaaagaggcacgtgctggtatccaagaagttcacttcctgccattcaatcctactgacaaaagaacagcattgacatacatcgacagtgatggcaaaatgttccgtgttagtaagggtgcacctgagcagattctccatctggctcacaacaagtcagagatagagaggagggttcatgctgtgattgataaatttgcagagcgtggacttagatcacttgctgtcgcatatcaggaagtacctgaggggaggaaagaaagtcctggtggcccatggcactttgttggtctcatgccactttttgaccctccaagacatgacagtgctgaaacaattcgaagggcactcaaccttggagttaatgtcaagatgatcacaggtgatcagctggcaattggaaaggaaacaggccgtcgccttggaatgggtacaaatatgtatccttcttctgctttgttaggacaaaacaaggatgagtctattgctgctctaccagttgatgatctcatcgagaaagctgatggttttgctggtgtattccctgaacacaagtatgagattgtgaaacgtctgcaagcacggaagcatatctgtggaatgactggtgatggagtaaatgacgctccagccctaaagaaagctgatattggtattgctgttgctgacgcaactgatgcagccaggagtgcttcagatattgtcctcacggaacctggacttagtgttatcattagtgctgtgctcaccagtcgcgcaattttccagcgtatgaagaattacacgatctatgctgtgtcgataaccatccgtatcgtgcttggatttatgctccttgccctcatttggaaatttgatttcccaccattcatggtcctaatcatagcaattctaaatgatggtaccataatgactatatcaaaggatcgtgtaaaaccatccccactacctgacagctggaagctggctgaaattttcacaactggagttgtcctcggtggatatcaggcaatgatgactgttatcttcttttgggctgcatacaagacagactttttcccaagaatatttcatgttgaaagccttgagaagactgctcaagatgatttccagaagcttgcctctgctgtttacctgcaagtcagcaccatcagccaagctctcatcttcgtgacgaggtcccggagctggtcatttgttgagcgaccagggtttctactggtctttgcattcttggttgcgcagctgattgctacgctgattgctgtgtacgctgactgggcattcacttcaatcaaaggcattgggtggggctgggctggtattgtgtggctttacaacatcatcttctacttcccgctcgatatcatcaagttcctcatccgatatgctctgagtgggaaagcatgggatctggtcattgagcaaaggattgcattcacaaggaagaaggactttggcaaggaggagagggagctgaagtgggcacatgcacagaggaccctccatgggctgcaggcaccggatgccaagatgttcccagagaaggctgggtacaatgagctgaaccagatggctgaagaggcgaagaggagggctgagattgcaagactgcgggagcttcacacactcaagggacatgtggagtctgttgtgaagctgaaggggctcgacattgagaccatccagcagtcctacacggtttgatatcgcctgtccccagaagaagttttttttaaaaaaaatctttctttctctttttggccaccgaagtgtgaattttacggtggctggactctctttgttttatttaactgaactggagtcacatccccagacaagtacttgaaatgagacggaatcgcttgatctct

SEQ ID NO: 2345 - DNA, 1882 bp, Vitis vinifera
gaggttcacttccttccatttaacccaactgataagcgaacagctcttacatatattgatggccaaggaaaaatgcatcgggtcagcaaaggtgcaccagagcagattctgaatctcgcgcacaacaagtcagaaatagaacgcagagttcatgctgtgatcgataagtttgcagatagggggttgcgatctcttgcagtggcataccaggaagttcctgatggaaggaaagagagcttgggaggtttatggcaatttgttggcctcatgcctctcttcgacccacctagacatgacagtgcagatacaataaggagggctttgaatcttggggttaatgtgaaaatgatcacaggtgatcaattggccatagcaaaggaaacaggccgccgtctgggaatgggaaccaatatgtatccttcatctgctttgctaggacagaacaaggacgagtccattgctgcgttaccagttgatgagctgatcgaaaaggctgatggttttgctggtgttttccctgagcacaagtatgagattgtaaagcgtttgcaagctaggaaacatgtgtgtgggatgaccggcgatggagttaatgatgctcctgcacttaaaaaggctgacattggcatagctgttgctgatgcaactgatgcagcacgaagtgcttctgacattgtcctgacagaacctggccttagcgttatcattagtgctgtactaactagtcgtgcaattttccagaggatgaaaaattacacgatttatgcagtttccattacgattcgtatagtgcttggttttatgttgctggccctcatatggcggtttgattttccacccttcatggtgctgatcattgctattcttaatgatggtactattatgacaatatcaaaggatagggtgagaccatctcctctgccagacagctggaagctggctgagatttttgcaactggagttgttcttggtagttacttggcaatgatgacagtcattttcttttgggcagcatacgagactgacttctttcctcgtgtgtttaatgtttcaagccttcagataaaagatagggatgacataagaaaacttgcctcagctgtgtatctacaagtgagtatcattagtcaggcccttatatttgtgacacgagccaggagttggtctttcgttgagcgtcctggccttctacttgtagtggcttttgttattgcacagctgattgctacgctgattgctgtctatgcaaattggagctttgctgctattgaaggaataggatggggttgggccggtgtgatttggctttacaaccttgtctgctacatcccactagattttataaagtttattatccgctatgccctgagtgggaaagcttgggatcttgttatcgagcaaaggattgcattcacaaggaaaaaggattttggaaaggaagcacgtgagcttaaatgggcacttgcacagaggaccctccatgggctgcacccacctgagaccaagatgttcactgaccacaatatcacagagcttaatcagatggctgaagaggcaaaacggcgagctgagattgcaaggctgagagaactgcatacactcaagggccatgtcgaatccgtggtgaggctgaagggccttgatataaacacaattcagcaagcatatacagtttgatgaaggagatcagcggtgcctataattttgctagggcttgtgtaaaaatctgtaacttatcatcctaatgtactgtgacccatctctattagtttgtcctccgtcacttttaagacaagtacttccatttagatgtgccatgctttcattatcagcacctttcttttccctctttttttaatataaaattggtggccttatttcc

SEQ ID NO: 2346 - DNA, 1933 bp, Triticum aestivum
  misc_feature (370)..(371): n is a, c, g, or t
  misc_feature (373)..(373): n is a, c, g, or t
  misc_feature (738)..(738): n is a, c, g, or t
  misc_feature (1110)..(1110): n is a, c, g, or t
  misc_feature (1129)..(1129): n is a, c, g, or t
  misc_feature (1888)..(1888): n is a, c, g, or t
ccacgcgtccgattggatagcgatggaaagatgtaccgagttagcaaaggtgcaccagagcagattcttaacctggcctacaacaagtcagagatcgcacaaaaagtccacactgtcatcgacaagttcgcggaacgtggacttcggtcacttggtgtagcatatcaggacgtgccagacggaaggaaagagagcccaggtagcccgtggcattttgttgctctcttgccactctttgatccaccgaggcacgacagcgcagaaacaattcaaagggcacttaaccttggtgtgaatgtgaagatgatcacaggcgaccagctagcgattgggaaggaaacagggcgtcgtctaggaatgggtacaaacnngnacccttcatctgctttgctggggcagaacaaggatgagtctattgctgatttaccagtcgatgatctaattgagaaagccgatggttttgctggcgtattcccagaacacaaatatgagattgtgaaacgcctacaagcacggaagcacatttgtggaatgactggcgatggcgtaaacgatgcaccagccctaaagaaagctgatattggtatagcggttgccgatgcgacagatgcagcgaggagtgcttctgatatcgtactcaccgaacctggtctaagtgtgatcattagtgccgtccttaccagtcgagcgattttccagcggatgaagaactacactatctatgcggtttcaattacnatacgtattgtgcttggatttatgctacttgccctcatatgggagtttgatttcccgccatttatggtcctgatcatagcaattttgaatgatggtaccataatgacaatatcgaaggatcgagtaaagccttctccactacctgacagctggaagttggctgaaatttttacaactggggtggttcttggcggatacttggcaatgatgactgtcattttcttctgggctgcatacaagactaactttttccctagggtctttcatgtaaaaagtcttgagaagaccgctcaagatgacttcaaaatgcttgcctctgctgtataccttcaagtcagcaccatcagccaagctctcattttcgttacaagntctcgaagctggtcgttantcgagcgccccggctttctcctggtctttgctttcttggtcgcacagctgatagctacactgatcgctgtatacgccgactggggattcacttcgatcaaaggcatcggatggggctgggctggcatcgtgtggctctacaacatcgtcttctacttcccgcttgacatcatcaagttcttcatccgatacgctctgagcggcaaagcatgggatcttgtcattgaccaaagaatcgcgtttacaaggaagaagcactttggtaaggaagagagggagctcaagtgggcccatgcacagaggacgctccatgggctgcagccaccgaatgccaagctgttccctgagaaggcgggctacaacgagctctgtcagatggccgaggaggcgaaacggagggccgagattgcaaggctcagggagctccacactctcaaggggcatgtggagtcagttgtgaagctgaagggcctcgacatcgacaccattcagcagtcttacactgtgtgataggttcaagtatccttaatgttactgtagaagagagagtatatccttgctgcataggaataacagacttttgataggttgcttttgccccctcttatatagttgactgctgatacatcgtgggaataaaacggttactacatctcagttgctctccagtcgctggttcgttgtgcttcatgtaaaggaatacagttatcctatctcttgcctctgcaactgggggttttaaccactgtttaagaaatcnttccggttcaccgattaatcttccgatttatcactaaaaaaaaaa

SEQ ID NO: 2347 - DNA, 2012 bp, Lactuca sativa
  misc_feature (616)..(616): n is a, c, g, or t
  misc_feature (1571)..(1571): n is a, c, g, or t
  misc_feature (1590)..(1590): n is a, c, g, or t
  misc_feature (1596)..(1596): n is a, c, g, or t
ggccttatggccgcttgacggggataaaacagggactttaacactgaacaaacttactgttgacaaaaatttaatagagatatttgctaaaggagtggatgctgacatggtggtattaatggctgcaagagcatctagagttgaaaatcaagatgcaatagacgctgctatagtaggaatgttagctgacccaaaagaagcaagagctggaattaaagaaattcatttcctaccattcaacccaactgataaacgaacagcgttgacttatcttgatgatgaaaataaaatgcatcgtgtcagtaaaggtgctcctgaacagatcctgaatcttgcacataataaatcaaacattgaaaaaagagttcatactgtgatcgataaatttgctgagcgtggtttgcgatcccttgcagttgcatatcaggaagttccagagggaaagaaggaaagcccaggaggtccatgggaattcatcggcctcatgcctctctttgatccaccacgacatgacagtgcagatacaattaggagagccttgaatcttggagtaagcgttaaaatgatcacaggtgatcaattagcaataggaaaagaaacaggaagacgtcttggnatgggaacaaacatgtatccttcctctgcattacttggacaaaacagagacgaatccattgtcgcgttgcctgttgatgaattgattgagaaagcagatggttttgctggcgttttccctgagcataaatatgagattgtgaaacgtctacaagcgagaaaacatatatgtggaatgacgggtgatggagtgaatgatgcgcctgcgcttaaaaaagcagacattggaatagcggttgcggatgcaactgacgcggctcgtagcgcgtctgatattgtgttgactgaacctggtcttagtgttattatcagtgcggttttaactagtcgtgctatttttcaaaggatgaaaaattacactatttatgcggtttccattacgatacgtattgtgcttggtttcatgctgcttgcccttatatggaagttcgattttccaccctttatggtgcttatcattgctattctcaatgatggtacaattatgacaatctccaaagatagagtaaaaccctctccgttacctgacagttggaagttatcagagatttttgctactggaatcattcttggtagctacttagctatgatgacagtcatcttcttctgggctgcatacgaaaccaatttctttccgcgagtgtttggagtgtcaagccttcaaaaaggagcacgtgacgatttcagaaagctagcttcagctatatacctacaagtcagtacaatcagtcaggctctcatattcgttactcgatctagaagttggtcattctatgaacgacccggagctcttcttatgggggctttcttaattgctcaactcattgcaacattaattgccgtttatgcaaactggagtttcgctgcaatcgaaggaatcggatggggttgggcaggagttatttggctttacacatcgtcttctacatccctctcgatttcattaaattcttcanaagatacgctttaagtggnagagcntgggatctagtcatcgatcaaaggttgctttcacaagaaaaagaaacttcgggaaagaagatcgtgagcttaaattggctcaagcccaaagaactctacatggactcgacccacccgaaacccaatatgttgaacgaaacaaccataatgagcttaatcaaatggctgaagatgcaattcgtagagctgagatgacaaggttgagagaattgcttacgttgaagggtcatgtggaatcggttgtaaaattaaagaacatcgatatcgataccatccaacaatcctatactgtttgagaagtacatcgtactaaatacttcatgtttgaaatctaaatctatgtatgtagtgtacatgtttgcgaatagtagtaatttgtcgttttaagttacgagtaatggaattattgatttata

SEQ ID NO: 2348 - DNA, 2730 bp, Helianthus annuus
  misc_feature (731)..(731): n is a, c, g, or t
  misc_feature (1959)..(1959): n is a, c, g, or t
  misc_feature (2571)..(2571): n is a, c, g, or t
  misc_feature (2577)..(2577): n is a, c, g, or t
  misc_feature (2618)..(2618): n is a, c, g, or t
  misc_feature (2636)..(2636): n is a, c, g, or t
  misc_feature (2659)..(2659): n is a, c, g, or t
  misc_feature (2678)..(2679): n is a, c, g, or t
tttgaggagaaaatgctggtaatgcagcagcagctctcatggcacacctcgcacccaaagcgaaggttcttcgcgatggaaaatggaatgaggaagaagcagcaattcttgttccaggtgatataatcagtattaaactaggagatatcatcccagcagatgctcgacttcttgagggtgatccattaaagataggccagtctgctctaacaggtgaatcccttcctgtaacaaaactccctggggatggagtttattcaggctctacatgcaaacagggggaaattgaagcagtggttattgcgacaggtgtgcataccttctttggaaaggctgcacatcttgtagattctacaaaccaagtaggccattttcagaaggttctgacagcgattgggaacttctgtatatgttcaattgcaatcggaatggtagtagaaatcatcgtgatgtacccaattcaaaaccgtgaatatcgtcctggaattgacaacttgctagtgcttctcattggtggaattcctattgcaatgccaacagttttatcggtcacaatggcaattggttctcatcgtttatctcagcagggagctatcacaaaaagaatgacagcaatagaagaaatggcaggcatggatgttctttgcagtgataaaactgggactttgaccctgaacaagctttcggttgacaaaaatcttatagagatatttgctaaaggagtggatgcngatatggtggtgttgatggctgcaagagcctctagggtggaaaaccaagacgcaatagatgctgccatagtagggatgttggctgaccctaaggaggcacggggaggtattcaagaggtccatttccttccattcaaccctaccgataagaggacagcattaacttacattgatggtgaaaacaaaatgcatcgtgtcagtaagggtgctcctgaacagattttgaatcttgcacataataaatcagaaattgagcgtagagtacatcttgtgatagataagtttgctgagcgtggtttacgatcccttgcagtagcctaccaggaagtccctgcgggaaagaaggaaagcccaggaggtccatgggagtttatcggtcttatgcctctctttgacccacccagacatgacagtgcagagacaattagaagggctttgaatctgggagtaagcgtcaaaatgatcacaggtgatcagctagcaataggaaaggaaacaggacggcgtctaggaatggggaccaacatgtacccttcatctgcattactgggacagaacaaagacgaatcaattgccgccttacccattgacgagttgattgaaaaagctgatggatttgctggtgtctttcctgagcataaatatgaaattgtgaaacgtttacaagcaagaaagcatatatgtggtatgactggtgatggagtgaatgatgcacctgcacttaagaaagcggacattggaattgcggttgcagatgcaactgatgctgcacgtagtgcgtctgatatagtgctgactcaacctggtcttagtgttattatcagtgcagtactaactagccgagcaatctttcagaggatgaaaaattacactatatacgcagtttccattactatccgtatagtgcttggtttcatgctactagccctcatatggaagtttgactttccacccttcatggtcctgatcattgcaattcttaacgacggtaccattatgacaatttccaaggatagagtgaaaccgtctcctcaaccggacagctggaaattggcagagattttcgctacagggatcattctcggtagctacttggctatgatgactgtaattttcttctgggctgcgtatgagaccgattttttcccgcgtgtttttggagtttctagccttcagaaaactggtcaagttacattggacgatgttaaaaaaaagctagcctcagcantatacctacaagtgagcaccatcagtcaagctctaatatttgttacacgttctaggagctggtccgtttatgaacgtccaggagctctacttttcggtgccttcttgattgctcaattgattgcaacgttgattgcagtttatgcagactggaatttttctgctatcgaagggatcggatggggttgggcaggtgtaatatggctctacaacattgtattctacatcccactcgatttcataaagttgttcatcagatatgctataagtggtagagcatgggatcttgtcattgaccaacgcgttgctttcaccaggaaaagaaactttgggaaggaagaccgtgagcttaaatgggctcaagcacaacggacactgcacgggctggacccgcctgaaattcatagcgtggaccgcaacaaccacaatgaacttaatcagatggctgaagatgcaaaacgccgagctgagatgacaaggttgcgagagttgcttacgctgaaaggtcacgtggaatcagttgtaaaactgaagaacatcgacatagataccatccaacaatcctacactgtgtgagaatgtttttactttcattccaaggtatatgtagtgngcagtncatatatgcaagtgcccaaaagatcgtttgttattatattnctgaatcttttgtcatangtaagagaatcagtatattgtanagtagtacctcttttgccnngtcttcaaaaaatctcacagtttttatattttaaaaagtttacaaaaaaaa

SEQ ID NO: 2349 - DNA, 2950 bp, Helianthus annuus
ataaacccaaagaagggctaacatcaaaggatgctgaaaagagattagagatatttgggcacaataagcttgaagagaaggaggaaagcaaaattttgaagttcttagggtttatgtggaacccactatcatgggtcatggaagttgcagcaattatggccattgcacttgccaatggaggaggtaaaccacctgactggcaggattttgttgggactgtcacactgcttgtcataaattcaacaataagctttatagaggagaacaatgctggtaacgcagcagcagctctcatggcacaccttgcacctaaagcgaaggtgcttcgcgatggaaaatggaacgaggaagaagcagcaattcttgttccaggtgatataatcagtattaagctcggggatatcatcccagcagatgctcgacttcttgagggtgatccgttaaagatagaccagtctgctcttacaggtgaatcccttccctgtacaaagctccctggggatggagtttattcaggctctacatgcaaacagggggaaatttgagcagtggttatgcgacagtgtgcatacctctttggaaaggctgcacatcttgtagattctacaaaccaagtaggccattttcagaaggttcttacagcgattgggaacttctgtatatgttcaattgcaatcggaatggtagtagaaatcatcgtgatgtacccaattcaaaaccgtaaatatcgtcctggaattgacaatttgctagtgcttctcattggtggaattcctattgcaatgccaacagttttatcggtcacaatggcaattggttctcatcgtttatctcagcagggagctatcacaaaaagaatgacagcaatagaagaaatggcaggcatggatgttctttgcagtgataaaacttggactttgaccctgaacaagctttcggttgacaaaaatcttatagagatatttgctaaaggagtggatgccgatatggtggtgttgatggctgcaagagcctctagggtggaaaaccaagacgcaatagatgctgccatagtagggatgttggctgaccctaaggaggcacggggaggtattcaagaggtccatttccttccattcaaccctaccgataagaggacagcattaacttacattgatggtgaaaacaaaatgcatcgtgtcagtaagggtgctcctgaacagattttgaatcttgcacataataaatcagaaattgagcgtagagtacatcttgtgatagataagtttgccgagcgtggtttacgatcccttgcagtagcctaccaggaagtccctgcgggaaagaaggaaagcccaggaggtccatgggagcttatcggtcttatgcctctctttgacccacccagacatgacagtgcagagacaattagaagggctttgaatctgggagtaagcgtcaaaatgatcacaggcgatcagctagcaataggaaaggaaacaggacggcgtctaggaatggggaccaacatgtacccttcatctgcattactgggacagaacaaagacgagtcaattgccgccttacccattgacgagttgattgaaaaagctgatggatttgctggtgtctttcctgagcataaatatgaaattgtgaaacgtttacaagcaagaaagcatatatgtggtatgactggtgatggagtgaatgatgcacctgcacttaagaaagcggacattggaattgcggttgcagatgcaactgatgctgcacgtagtgcgtctgatatagtgctgactcaacctggtcttagtgttattatcagtgcagtactaactagccgagcaatctttcagaggatgaaaaattacactatatacgcagtttccattactatccgtatagtgcttggtttcatgctactagccctcatatggaagtttgactttccacccttcatggtcctgatcattgcaattcttaacgacggtaccattatgacaatttccaaggatagagtgaaaccgtctcctcaaccggacagctggaaattggcagagattttcgctacagggatcattctcggtagctacttggctatgatgactgtaattttcttctgggctgcgtatgagaccgattttttcccgcgtgtttttggagtttctagccttcagaaaactggtcaagttacattggacgatgttaaaaaaaagctagcctcagcagtatacctacaagtgagcaccatcagtcaagctttaatatttgttacacgttctaggagctggtccgtttatgaacgtccaggagctctacttttcggtgccttcttgattgctcaattgattgcaacgttgattgcagtttatgcagactggaatttttctgcaatcgaagggatcggatggggttgggcaggtgtaatatggctctacaacattgtattctacatcccactcgatttcataaagttgttcatcagatatgctataagtggtagagcatgggatcttgtcattgaccaacgcgttgctttcaccaggaaaagaaactttgggaaggaagaccgtgagcttaaatgggctcaagcacaacggacactacatgggctggacccgcctgaaattcatagcgttgaccgcaacaaccacaatgaacttaatcagatggctgaagatgcaaaacgccgagctgagatgacaaggttgcgagagttgcttacgctgaaaggtcacgtggaatcagttgtaaaactgaagaacatcgacatagataccatccaacaatcctacactgtgtgagaatgtttttactttcattccaaggtatatgtagtgtgcagtgcatatatgcaagtgcccaaaagatcgtttgttattatattactgaatcttttgtcatatgtaagagaatcagtatattgtagagtagtacctcttttgcccagtcttcaaaaaatctcaca

SEQ ID NO: 2350 - DNA, 2008 bp, Saccharum officinarum
aaaagaactgctttaacctatcttgatggtgagggaagaatgcatcgtgttagcaagggagcaccagagcagatccttcatcttgcacacaacaagtcgaatattgaaaaaagggtcagagctgtgattgacaaatttgctgaacgtggtttgcgagcacttggtgtagcttaccaggaagtgccagatggtaggaaagagagtcctggaggaccatggcaattcattgggctcttgccacttttcgacccccctcgccatgatagtgcagaaactatcagaagggcactccatcttggtgtcaatgtcaagatgattacaggtgatcagcttgctattgggaaggaaacagcgcgtcgtttgggaatgggtactaatatgtacccttcatctgctttactcggacagaataaggatgagtcaattgcttctttaccaattgatgaattgatcgagaaggctgatggctttgctggagtctttccagaacacaagtatgagatcgtgaaacgcttgcaagcaagaaaacatatatgtggtatgactggggatggtgtaaatgatgccccagctttgaaaaaggctgatattggtattgcagtagcagactccactgacgcagctcgtagtgcctctgacattgtcctaactgaaccaggacttagtgtgattattagtgctgtgctgacgagtcgggcaattttccaaaggatgaagaattacacaatctatgctgtatcaattaccatccgtattgtgcttggttttatgcttcttgctctgatatggaagtttgacttcccaccatttatggtcctgatcattgccatcctcaatgacggtaccattatgactatctcaaaggacagagtaaaaccatctccacaacctgatagttggaagttagctgagatttttgcaactggaatagttctgggtggttatttggccatgatgactgtcattttcttctgggctgcgtacaagactgacttctttccgcgactgttccatgttgaaagccttgagaaaactgcccaggatgattttcagaagcttgcctctgcggtgtaccttcaagttagcacaatcagtcaggcccttatctttgtgacacggtctcgcagctggtcatttgtggagcgtcctgggttcttgctggtctttgctttcttggtggcgcagctgattgctactctgattgcggtatatgccaactgggcatttgctgcgatcaagggcattggatggggctgggctggcgttatctggctctacaacctcgtcttctacttcccgctggatatcatcaagttcctcatccgttacgcgctgagtgggagggcatggaatctcgtccttgagcagaggattgcattcacaagcaagaagaatttcggcacggaagaaagggagctcaagtgggcgcacgctcagaggactctccacgggctccagccaccagaggcatccatcttcgagaacaagacgaccttcaacgaactcaaccagctcgcggaagaggcccgcaggagagcggagatggcgaggttgcgcgaagtgagcaccctgaaggggaagatggagtcggtggtgaagcagaagggtttggacatcgagaccatccagcagtcctacaccgtgtgactgacggattatggaggcatgattatagaggcgggttcttcttactctatatgtacttagggagcaataaggattaaggaacccccatatatgattggttcgcgaggatgatgatggtattgtttatgatgtcggtgtggtgctctgccgccaactcgccatagccgccctcactcacccctatatgctgtgcattaaccgcccccggcaggcattgagattgagatgagagatactctgtagcccttagtagatgatgatgatggtgatatagtacatttttgcttattattatcctttgctccctgattctgctggttttgttattcctgattcctaaaaaaaaaaacccacgcgtccg

SEQ ID NO: 2351 - DNA, 2008 bp, Saccharum officinarum
  misc_feature (1065)..(1065): n is a, c, g, or t
aaaagaactgctttaacctatcttgatggtgagggaagaatgcatcgtgttagcaagggagcaccagagcagatccttcatcttgcacacaacaagtcgaatattgaaaaaagggtcagagctgtgattgacaaatttgctgaacgtggtttgcgagcacttggtgtagcttaccaggaagtgccagatggtaggaaagagagtcctggaggaccatggcaattcattgggctcttgccacttttcgacccccctcgccatgatagtgcagaaactatcagaagggcactccatcttggtgtcaatgtcaagatgattacaggtgatcagcttgctattgggaaggaaacagcgcgtcgtttgggaatgggtactaatatgtacccttcatctgctttactcggacagaataaggatgagtcaattgcttctttaccaattgatgaattgatcgagaaggctgatggctttgctggagtctttccagaacacaagtatgagatcgtgaaacgcttgcaagcaagaaaacatatatgtggtatgactggggatggtgtaaatgatgccccagctttgaaaaaggctgatattggtattgcagtagcagactccactgacgcagctcgtagtgcctctgacattgtcctaactgaaccaggacttagtgtgattattagtgctgtgctgacgagtcgggcaattttccaaaggatgaagaattacacaatctatgctgtatcaattaccatccgtattgtgcttggttttatgcttcttgctctgatatggaagtttgacttcccaccatttatggtcctgatcattgccatcctcaatgacggtaccattatgactatctcaaaggacagagtaaaaccatctccacaacctgatagttggaagttagctgagatttttgcaactggaatagttctgggtggttatttggccatgatgactgtcattttcttctgggctgcgtacaagactgacttctttccgcgactgttccatgttgaaagccttgagaaaactgcccaggatgattttcagaagcttgcctcngcggtgtaccttcaagttagcacaatcagtcaggcccttatctttgtgacacggtctcgcagctggtcatttgtggagcgtcctgggttcttgctggtctttgctttcttggtggcgcagctgattgctactctgattgcggtatatgccaactgggcatttgctgcgatcaagggcattggatggggctgggctggcgttatctggctctacaacctcgtcttctacttcccgctggatatcatcaagttcctcatccgttacgcgctgagtgggagggcatggaatctcgtccttgagcagaggattgcattcacaagcaagaagaatttcggcacggaagaaagggagctcaagtgggcgcacgctcagaggactctccacgggctccagccaccagaggcatccatcttcgagaacaagacgaccttcaacgaactcaaccagctcgcggaagaggcccgcaggagagcggagatggcgaggttgcgcgaagtgagcaccctgaaggggaagatggagtcggtggtgaagcagaagggtttggacatcgagaccatccagcagtcctacaccgtgtgactgacggattatggaggcatgattatagaggcgggttcttcttactctatatgtacttagggagcaataaggattaaggaacccccatatatgattggttcgcgaggatgatgatggtattgtttatgatgtcggtgtggtgctctgccgccaactcgccatagccgccctcactcacccctatatgctgtgcattaaccgcccccggcaggcattgagattgagatgagagatactctgtagcccttagtagatgatgatgatggtgatatagtacatttttgcttattattatcctttgctccctgattctgctggttttgttattcctgattcctaaaaaaaaaaacccacgcgtccg

SEQ ID NO: 2352 - DNA, 2174 bp, Theobroma cacao
  misc_feature (518)..(519): n is a, c, g, or t
  misc_feature (1480)..(1480): n is a, c, g, or t
  misc_feature (1535)..(1535): n is a, c, g, or t
  misc_feature (1620)..(1620): n is a, c, g, or t
  misc_feature (1634)..(1634): n is a, c, g, or t
cggggcagacactgtagttctgatggcagcccgagcctctagaacagagaaccaggatgcaatagattctgcaatagttgggatgctggctgatccaaaggaggcacgtgctggcattcgagaagtacacttccttcctttcaatccaacagataagagaacagctttaacctatatcgataatgatggtaaaatgcacagagtcagtaaaggtgcccctgaacagatcttaaaccttgcacataataagtcagatattgagcgaagagttcatgtggtcattgataagttcgcagagcgaggtttacgatctcttgcggtggcataccaggaagttccggaaggaaggaaggagagttctggtggcccatggcagttcattggtctcatgcctctctttgatccccctcggcatgatagtgcagaaacaattaggagggctttgaaccttggagtaaatgtcaaaatgattacaggagatcaactggcaataggaaaggagactgggcgccgtttgnncatgggaaccaacatgtatccatcatctgctttattgggtcaggacaaggatgaatctatagctgccttaccagttgatgaactaattgagaaagctgatggctttgctggtgttttcccagaacacaaatatgaaatagtaaaacgcttgcaagccaggaaacacatctgtggcatgactggtgatggagttaatgatgctcctgctcttaagaaagctgacattgggatagctgtggctgatgcaactgatgcagcacgtagtgcttctgacattgtccttactgaacctggacttagtgtcatcatcagcgctgtcttgaccagtcgtgccattttccagaggatgaaaaattacactatttatgcagtttccattacaatccgtattgtgttgggattcatgctgctagccctcatctgggaatttgactttccgccattcatggtgcttattattgcgatcctcaatgatggtaccattatgacaatatccaaggacagggtcaaaccatcacctctaccagacagctggaagctggcggaaatttttacaaccggaattgttcttggtagttacttggcagtgatgacagttatattcttttgggcagcatacaaaacagacttttttccgcgtatatttggggtgccgactcttgagaaaacagctcatgatgacttaagaaagcttgcctctgcagtgtatttgcaagtgagcattataagtcaggccctaatatttgtaacacgatcccgaagttggtcttatgttgagcgtccaggtttgctattagtggtggcgtttgtggtagctcagttgattgctacgctaattgctgtctatgcaaattggagctttgctgcaattgaagggattggatggggttgggctggtgtgatctggctctataacataatcttctacatcccacttgatttcatcaagttcttcattcgntatgctttgagtggcagggcctgggatcttgttattgagcagaggattgcattcncaaggcaaaaggattttggaaaagaacaacgtgagcttcaatgggcacatgcacagagaacattgcatggtttgcaggcacctgntaccaagatgttcnctgaacgaacccatttcacagagctcaatcagatggccgaggaagccaaaaggagggctgaaattgctaggttgagagaactccacacactgaaaggtcatgtcgaatcagtggtgagattgaagaaccttgacatagacacaattcagcaagcttacacagtctaggggaatcaatccaaagacatactcatatacgtaacagtagcatttacctgcggtgagaagacaaaatcagcatgtttttggttgcccatcattgagattaaaagatcctatttcgagcagataaaagagtgctgcagttagctttatctatgtattttttactgattcctctttcgttaccaaattatgccggcaataaggaacgcttattgtttatggcattttatgtttatattggtaagccttatggtttttcatctttggttttattgtattaaaaagaaactcgggtagtgggaagttattggggaataagaactcacaaactcttggtatttaatcgaccaaaatgaaatgttggacacatatttga

SEQ ID NO: 2353 - DNA, 2684 bp, Zea mays
atggagttgaatgagaaatctgaaaagaatacgcaagaggtagatgagaagttccaaaacacaaacttgtatctcaagaacttagagatggagcttcggggtaccatagggcaaagtgaagaagaaacagaagagttgagcaagatcacgctagagaataaggatattcagcttgatatcaatataagagtgtttgatggagccgaccctatggagctgcatgtttatgattttaaaggacctggtgtaaccttatcaatgtacaatagcgatgagtttattaggccttttgctaagtcctccatggatatggctctttcaaaaaagtcgtctcttcatctcagcaccaagaatacaatcatcaagaagtatgacgacaggcatggatcatctatgtttctacaagctcgcggtcacatttattaggccttttgctaagttcatggatatggctctttcaaaaaagtcgtctcttcatctcagcaccaagaatacaatcatcaagaagtatgacgacatgcatggatcatctatgtttctacaagctcgcgcgaagcgatggcgatggtgggttttgatgttcaggacagaatcaatggccgcaccttatgtgattgtgatagcatagttgcttgcgaggtaattacaaagttgcaggctgccgcctggaggcagtgggaggccctgttacaatggaatgctaagagacaaatagttaaagaactgctttaacctaccttgatggagaggggagaatgcatcgtgttagcaagggagcaccagagcagatccttcatcttgcccacaacaagtcagatattgaaagaagggtcagagctgtgattgacaaatttgctgagcgtggtctgtgagcacttggtgtggcttaccaggaagtgccagatggtaggaaagagagtcctggaggaccatggcagttcattgggctcttgcctccttttgaccccccgcgccatgatagtgcagaaactatcagaagggcactcaatcttggtgtcaatgtcaagatgattacaggtgatcaacttgctattgggaaagaaactgcacgtcgtttgggaatgggtactaatatgtacccttcctctgctttactcagacagaataaggatgagtcaattgcttccttgccaattgatgaattgatcgagaaggctgatggctttgctggtgtctttccagaacacaagtatgagatcgtgaaaggcttgcaagcaagaaaacatatatgtggcatgactggggatggtgtaaatgatgccccagctttgaagaaggctgatattggtattgcagtagcagactctactgatgcaactcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaaccagacagttggaagttagctgagatttttgcaactggagtagttcttggtggttatttggccatgatgactgtcattttcttctgggctgcatacaagactgactttttcccgcggctgttccacgtcgaaagcctcgagaagaccgcccaggatgactttcagaagttcgcctctgccgtgtaccttcaagtcagcacggtcagtcaggcccttatcttcgtgacacggtcgcgcagctggtcgtttgtggagcgtcctgggttcttgctggtcttcgctttcttggtggctaagctgattgccactctgatcgctgtatatgccaactgggcgttcactgcgatcaagggcattggatggggctgggccggtgtcatctggctctataacatcgtcttctacttcccgctggacatcatcaagttcctcatccgctatgcgctgagtgggagggcatggaacctcgtccttgagcagaggattgcgttcacgagcaagaagaatttcggcacggaagaaagggagcgcaagtgggcgcatgcgcagaggactctccatgggctccagccgccagaagcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatctagaccatccagcagtcctacactgtgtgactgactgactgacgacgacggggtttatagaggtttcttcttatactatacaatctgtactaggtagcaataaggatcaaggaaggaacccctatatattggctgcggttcgcaggaaatgaatgatggtaatatttatgatgtcggtgtggtgcttctgtcgccaactctcgaccatactaccctcaactcacccccggcaccaccggcaggcattgatattcagagatgaggtatagtagtctgtagcctctagtagatgctgatgaattgatgatatagtacatttttgcttgctttcttgcttgtttgttgttttcc

SEQ ID NO: 2354 - DNA, 2471 bp, Zea mays
gaagaaacagaagagttgagcaagatcacgctagagaataaggatattcagcttgatatcaatataagagtgtttgatggagccgaccctatggagctgcatgtttatgattttaaaggacctggtgtaaccttatcaatgtacaatagcgatgagtttattaggccttttgctaagtcctccatggatatggctctttcaaaaaagtcgtctcttcatctcagcaccaagaatacaatcatcaagaagtatgacgacaggcatggatcatctatgtttctacaagctcgcggtcacaattggaccatggtgctccattttgcttactgtgatatgtgcagcgaagcgatggcgatggtggttttgatgttcaggacagaatcaatggccgcaccttatgtgattgtaatagcatagttgcttgcgaggtaattacaaagttgcaggctgccgcctggaggcagtaggaggccctgttacaatggaatgctaagagacaaatagttaaagaactgctttaacctaccttgatggagaggggagaatgcatcgtgttagcaagggagcaccagagcagatccttcatcttgcccacaacaagtcagatattgaaagaagggtcagagctgtgattgacaaatttgctgagcgtggtctgtgagcacttggtgtggcttaccaggaagtgccagatggtaggaaagagagtcctggaggaccatggcagttcattgggctcttgcctccttttgaccccccgcgccatgatagtgcagaaactatcagaagggcactcaatcttggtgtcaatgtcaagatgattacaggtgatcaacttgctattgggaaagaaactgcacgtcgtttgggaatgggtactaatatgtacccttcctctgctttactcagacagaataaggatgagtcaattgcttccttgccaattgatgaattgatcgagaaggctgatggctttgctggtgtctttccagaacacaagtatgagatcgtgaaaggcttgcaagcaagaaaacatatatgtggcatgactggggatggtgtaaatgatgccccagctttgaagaaggctgatattggtattgcagtagcagactctactgatgcaactcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaaccagacagttggaagttagctgagatttttgcaactggagtagttcttggtggttatttggccatgatgactgtcattttcttctgggctgcatacaagactgactttttcccgcggctgttccacgtcgaaagcctcgagaagaccgcccaggatgactttcagaagttcgcctctgccgtgtaccttcaagtcagcacggtcagtcaggcccttatcttcgtgacacggtcgcgcagctggtcgtttgtggagcgtcctgggttcttgctggtcttcgctttcttggtggctaagctgattgccactctgatcgctgtatatgccaactgggcgttcactgcgatcaagggcattggatggggctgggccggtgtcatctggctctataacatcgtcttctacttcccgctggacatcatcaagttcctcatccgctatgcgctgagtgggagggcatggaacctcgtccttgagcagaggattgcgttcacgagcaagaagaatttcggcacggaagaaagggagcgcaagtgggcgcatgcgcagaggactctccatgggctccagccgccagaagcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatctagaccatccagcagtcctacactgtgtgactgactgactgacgacgacggggtttatagaggtttcttcttatactatacaatctgtactaggtagcaataaggatcaaggaaggaacccctatatattggctgcggttcgcaggaaatgaatgatggtaatatttatgatgtcggtgtggtgcttctgtcgccaactctcgaccatactaccctcaactcacccccggcaccaccggcaggcattgatattcagagatgaggtatagtagtctgtagcctctagtagatgctgatgaattgatgatatagtacatttttgcttgctttcttgcttgtttgttgtttt

SEQ ID NO: 2355 - DNA, 2129 bp, Pennisetum glaucum
catggcaattgggtcccatcgcttggctcagcagggagctataacgaaaagaatgactgcaattgaagagatggctggtatggatgtacttcagtgataaaactggaaccttgactctcaataaactcagtgtggacaagaaccttatcgaggttttcgagaagggtgtgactcaagaccaagtaattctgatggctgccagagcatcccgaatagaaaatcaagatgccattgatactgcaatagttgggatgctagctgatccaaaagaggcccgtgctggtattcaagaggtccatttcctgccatttaatcctacagacaaaagaaccgccttgacatacattgatagtgatggaaagatgtaccgtgttagtaaaggtgcaccggagcagattctcaacctcgcacacaacaagtcagagatagaacgaagagttcatgctgtaattgacaagtttgctgagcgtggacttcgatcgcttggtgtagcatatcaggaagtaccagatggaaggaaagagagtcttggtgggccatggcatttcgttgctctaatgccactctttgatcctccaaggcatgacagtgccgaaacaatacaaagggcactgaaccttggtgttaatgtgaaaatgatcacaggtgaccagcttgcaattgggaaggaaacaggacgtcgcttaggaatgggtactaacatgtacccttcctcagctttgctgggacaggacaaggatgagtctattgctgctttacctgttgatgatttaattgagaaggccgatggttttgctggtgtattcccagagcacaaatatgagattgtaaaacgtctgcaagcacgaaaacacatttgtggaatgactggtgatggagtaaatgatgctccagctctaaagaaagctgatattggcatcgctgttgctgatgcaactgatgcagccagaagtgcttctgatattgtcctaacagaacctggcctgagtgtgatcattagcgctgttcttacaagccgagcaattttccagcgcatgaagaactatactatctatgccgtctcaattacaatacgtatcgtgcttggatttatgctgcttgccctcatatgggagtttgatttcccaccgtttatggtcctgattattgcaattctaaatgatggtaccataatgacaatatcaaaggatcgagtaaagccttctccactacctgatagctggaagttggctgagattttcactactggcattgtacttggtggatacttggcagtgatgactgttattttcttctgggccgcatacaagacaaactttttccctaggatctttcatgtcgagagccttgagaagacaactcaagacgattaccagaaacttgcctctgctgtttatctccaagttagcactatcagtcaggctctcatctttgtcacaaggtcccgcggctggtcattcgttgagcgcccaggctttctgttagtgtttgctttcctggttgcacagctgatagctacattgattgctgtatatgctaactgggcgttcacttcaatcaaaggcattggatggggctgggccggtgtcgtgtggctctacaatctcgtgttttacttcccactcgatatcctcaagttcctcatcagatacgctctgagcgggaaagcatgggatcttgtcattgagcaaagaattgcatttacaaggaagaaggactttggcaaggaagagagggcgctcaagtgggcgcatgcccagaggacgctccatgggctgcagccaccagatgccaagctgttccctgacagggtgaacgagctgaatcaaatggctgaagaggcgaaacgtagagctgagatcgcaaggctgagggagcttcacaccctgaaggggcatgtggagtcggttgtgaagctcaagggcctggacatcgacaccatccagcagtcctacaccgtgtgatgggagctcatacgccatgagagtttggagtacatatctgtttccagcagaggaacagctagttctggtagtagttggtgtcgtattgtacttaccacaactgtgccagcgacagtaaaaaacccagtagttgagaacataacggtgaactgatgctattatcag

SEQ ID NO: 2356 - DNA, 1992 bp, Triphysaria pusilla
cgagtaatcggcccctctacattggtaataaccatacacttatactaatgttatgcgtagctgcgtaactctccgctgaccaacgacacgagcgggcctgagatttctcaacatccatttcttaccattcaatccaactgataagcgcacggcattgacgtatgtcgatagtgaaggtaaaatgcatcgagccagcaagggcgctcctgaacagatattggaccttgcacacaacagatccgagattgagcacagagttcatgctgtcatcgataagttcgctgagcgtgggttacgatcacttgcagttgcataccaggaagttccggatggaaggaaagagagttctggaggtccgtggaactttttagggctcatgccactttttgatcctccaaggcacgacagtgcagagactatcagaagggctctgaacctaggcgtaaatgtgaaaatgataactggtgatcagctagcaatcggaaaggaaacaggacgccgtttgggcatgggaacaaacatgtatccttcatctgctttgttaggaaaggacaaagatgagtccattattgctttgcctattgatgagttgatcgaacaggctgatggctttgctggtgttttccctgagcacaagtatgaaattgtcaagcgtttgcaagctcggaaacatatatgtggaatgactggtgatggagttaatgatgcccctgctctcaaaaaggctgatattggaatagctgttgctgacgcaactgatgctgctcgaagtgcatcggacatagtactgactgaaccgggcctcagtgtaatcatcagtgctgtgctaaccagtcgtgcaatttttcagagaatgaaaaactacacaatatatgctgtatccatcacaatccggatcgtgcttggctttatgttgcttgcgctcatatggaagtttgatttcccgccctttatggttctaatcattgccatacttaatgacgggacgatcatgacaatatcaaaggatagggtgaaaccatctcctttacctgacagctggaaactagccgagattttcgcaacaggagttgtactcggatcctacttagccatgatgaccgtcattttcttctgggcagcatatgaaacagacttcttccctagaacattcggagttaagtctcttcagagaatagtaaaccaaccccccaatttccgaatgctcgcctcagcaatatacttgcaagtcagtatagttagccaagctctcatattcgtgacgagatcccgaagttggtccttccttgagcgcccgggtcttcttctcttcggggctttcttaattgctcaactaattgctacactgatagcagtgtatgccaactggagttttgcttttattgaagggataggctggggttgggccggtgttatatggttgtataatctcgtattctatttcccactcgatcccatcaaattcttcatcagatacgcgctgagtggaaaggcctgggatcttgtcattgagcaaaggattgcgtttacaaggaaaaaggattttgggaaagaagaccgggaacttaagtgggtccaggcccaaaggaccctccatgggcttcatccacccgaggcacaatatggcgaacgtagtagtaaccataacgatctcaatcagttagccgaagaggcaaggcgacgagcagagatggcaaggctgagagagttgcatacactgaaaggacatgtcgagtcagttatcaagatgaaaaatctcgacatagacacaattcaacagtcgtacacagtctgagcgaatatttgcgtgtgtgtttgatgtataaagttgcaaaatctcgaaagaacatatatatgtactttttttgctaggtattatgagacaatgaaagatagatactatcatggtactctttgttcttggttttctattgtctttttgatgctcattgttagtgtatttgtttctattgtcaataaataatactagat

SEQ ID NO: 2357 - DNA, 2099 bp, Citrus sinensis
  misc_feature (201)..(202): n is a, c, g, or t
  misc_feature (241)..(242): n is a, c, g, or t
aatgcatagagtcagtaaaggggcaccagagcagattctaaatcttgcacacaacaagtcagacattgagagaagagttcatgctgtgatcgacaagtttgcagagcgaggtttacgatctcttgctgtggcctaccaggaagttcctgaaggaaggaaggatagtcctggaggcccatggcaatttatgggcctcatgcnnctctttgatccaccaaggcatgatagtgcagagaccatnnggagggctttgaatcttggagtaaatgttaaaatgattactggagatcaactggcaataggaaaggagactggacgtcgtttgggaatgggaaccaacatgtatccttcatctgctttgctaggacaggacaaggatgagtctatcgctgctttacctattgatgaactgatagaaaaagctgacggctttgctggtgtcttccctgaacacaagtatgagatagtaaaacgcttacaagctaggaaacatatatgtgggatgactggtgatggtgtcaacgatgctcctgctctcaagaaggctgacattgggatagccgttgcggatgcaactgatgctgctcgtagtgcttctgacatagtccttacagaacctggccttagtgtcatcatcagtgctgtcttgaccagtcgagctatcttccagcggatgaaaaattacacaatatatgcagtatccattaccattcgtattgtgcttggtttcatgctgctggcgctcatatggaagtttgactttcctccatttatggtgcttatcattgccatcctgaatgatggtacaattatgacaatatcaaaagatagggtgaaaccgtctcctctgccagatagctggaagcttgctgaaatttttacaactggcattgttcttggcagttacttggcaatgatgacagttattttcttctgggcagcatataaaacagatttctttccgagagtatttggggtggcaacccttgagaaaacagctcatgatgacttccgaaagcttgcctcagcaatttacttgcaagtgagcactatcagtcaggcccttatattcgtaacacggtcaagaagttggtctttcgttgagcgacctggtatattgctgcttgtggcttttctgattgctcaactgattgctactctgattgccgtttatgcaaactggagttttgctgcaattgaagggattgggtggggttgggccggtgtggtctggctttacaacatcatcttctacatcccacttgatttcattaagttcttcatacgctatgctctgagtgggaaggcctgggatcttgttatcgagcagaggattgctttcacaaggcaaaaggattttggtaaggaacaacgtgagcttcaatgggcacatgcacaaagaacattgcatgggttgcaaccacctgataccaagatgttcaccgagcgaactcatgaacttaatcagatggctgaagaagccaaaaggagagctgaaattgctaggttaagagaactccatacgttaaaaggtcatgtggaatcagtagtgagattgaaaggccttgacatagacacgattcagcaagcttacacggtctaagagatcatctattgacgtaatcgttatctattaagaaacatttcctggtgctgtgaagatatgtaatcagcatgttgttgcaagttacccgccaaacaagagtgtttttttgtgctagtatattttcctttccagcacgtcagagtgctgtggtaagtatttatctttctgttttcatctctgctcttaactttcgccaccaaatgcccacagtatgtacttatttctgtcgtggcatttgatgcttatattagtaaggtctaaggttcgccgttctttaaatcaactgttctaaggacaaactcttgatagttgataggcaattgcttcggttgtaatattttgggcaacaagcggttagaaactctagatatatttggtgctgcactctctgctcctatacattgcttaaagttgttttcttgataaatttttagcatagcagttagtaattgttttatagtcaataaataatactaccgcaaactcatattac

SEQ ID NO: 2358 - DNA, 1688 bp, Cajanus cajan
tggctgctcgtgctgccagaatggaaaaccaagacgccatagatgctgctattgtagggagtgttgggtgatccaaatgaggcaagggctggtattgaagaggttcacttccttcccttcaacccaactgacaagcggactgcaatgacctatatagacaatgaaggtaaaatgcatcgcgttagcaaaggtgcaccggagcagattttgaatcttgcacacaataaatcagagatagaacgtagagttcattctgtcattgataagtttgcagagcggggcttacggtctcttgcagttgcctaccaggaagttcctgatggaaagaaagaaaacaaaggagggccttggcaatttattggactcttgcctctatttgacccacctagacatgatagtgctgagacaatacgaagggcattaaatcttggagtaaatgttaaaatgataacaggtgatcaactagcaataggaaaagaaacaggacgccgtttgggaatgggaaccaacatgtacccgtcatcgtctttattgggccaaaacaaggatgaagcaattgccaccttgccagttgatgagttgattgaaaaagctgatggatttgctggtgtttttccagagcacaagtatgagatcgtgaagcgcttacaagctaggaaacacatatgtggaatgactggtgatggggttaatgatgctcctgctcttaaaaaagcagatattgggatagctgttgctgatgctactgatgcagctcgtagcgcttctgacattgttctgacagaacctggtctcagtgttatcatcagtgctgtactgaccagtcgagcaatattccaaaggatgaagaattacacaatctatgcagtttccatcacaatccgtattgtgcttggtttcatgttactggccctcatatggcaatttgattttccacccttcatggtgctgattattgctattcttaatgatggtaccattatgacaatatcgaaggacagggtaaaaccatctccatatcccgatagctggaagttggcagagatctttacgactggaataattcttggtggttatttggctatgatgacagtcattttcttttgggcagcatataaaacagattttttcccaaaaacatttggggtctcaagtcttcagaaaaaggatagggatgacattagaaagcttgcctcagcaatatacctacaagttagtacaattagtcaggccctcatattcgttacacgagcacgaagttggtcttacattgagcgtccagggttgctacttgtagcagcatttgttattgcccagctgatagctaccttaattgcagtttatgcaaattggagttttgctgcaattgaagggattggatggggttgggctggtgttgtttggctttataacctcatctttttcattccacttgattttatcaagttcataattcgatatgccttgagtggaagggcttgggatcttgttattgaacaaaggattgcttttacaaggaaaaaagattttggaaaggaagaacgtgaacttaaatgggcacatgcacagaggacactccatggccttcacccaccggagagtaagatgttcggtgaacgcacaaattacacagaacttaatcagatggctgaagaggctaaaaagacgtgcagagattgcaagactga

SEQ ID NO: 2359 - DNA, 3010 bp, Selaginella moellendorffii
ctgcaatagaggagatggcaggaatggatgtcctttgcagtgacaagaccggcaccttaactttgaataagctaaccgtcgacaagaatctcgtggaggtttttgcaaaaggatacgacaaagattacgttttgctacttgctgctagagcgtcaaggatggaaaatcaagatgccattgacgcagctgttgtcggtacgcttgctgatccaaaggaggcccgtgctggtattgaggaagttcactttcttccatttaatcctacggataagcgtactgctctgacttatattgactctgacgggaagatgcacagagccagcaaaggcgcacctgagcagatattagatctttcttacaataaggttgagattgctcaaagggtgcacgccgtcattgacaaatttgctgagcgtggccttcgctctcttgcagtcgcatgccaggacgttcccgagggcaacaaagagagtccagggggtccatggcaatttgtaggcttaatgcctttgtttgatcctcctcggcatgacagcgccgagactattcgtagggccctgaatcttggggtcaacgtaaagatgataactggggaccagcttgctattggcaaagaaactggccgacgtcttggcatgggaactaacatgtatccgtcatcttcgcttcttggacaaagcaaaggggaggcatttgaaggattgccaattgacgaactgattgaaaaagccgatggatttgcgggggtatttccagagcacaagtacgagatagtaaagcgcttgcaaatgaagaagcatatatgtggaatgactggtgacggtgtcaatgatgcgcctgctctgaagaaggcagatataggaattgcagtggcagatgcaacagatgcagcaaggggtgcttcagatatagtcctgacagaacctggcctgagcgtgataataagcgccgtgctaacaagtcgcgcgatttttcagaggatgaagaactatactatttatgccgtatccatcactataaggatagtgcttggttttatgctgctggcgttgatatggaagttcgattttcccccattcatggtgctaatcattgcaatattgaacgatggcacaatcatgaccatctccaaggacagagtgaaaccatctcctttgcctgacagttggaagctctcggagatttttgcgacaggagttgtgatcggcagttaccttgcgcttatgacagtcattttctactggctggcagacaagactacctttttccctgaccatttccacgttcctcacattggaagcgatgccaacaaaatgcattcggccatctatttgcaagttagtatcgtaagccaggctctgattttcgtcacgaggtcgagaagctggtccttcatggaaaggcctggatttcttctcgttgtggcgtttcttattgcccagctgattgcgacttttattgccgtgtacgccaactggggctttgcctttgtggagggaattggctggggttgggccggtgttatatggctatacaacatcgtcttctacttccctctggatgttatcaagttcgctgtgcgttacatactaagtggcagagcatgggagcttctattcgagcaaagaactgcttttacgcgccaaaaagacttcggaagggaggctcgggaagtgaagtgggctcaggcgcaacgaactctacacgggctccagccaccggacttcaagatacccgagaagggtactcacaaagagacgtcagacatggccgagcaggctttaaggagagccgagattgcaaggttgagagagcttcacactttaaagggtcacgtcgaatctgtagtgaggttgaaaggcttggacatcaacaccatccagcaggcctacactgtctagaggcgatcgatcgagtgagcgacgcgatagtagtggaatgtggatatatttccagtgatgctagtgagctagctagcacagctatggtggtttgtagcgtttggacaattatcatactgacatatatgttgaataataggagataggagagaaagcggagcgtgacaagacgctttgtaacactttgtcgtcacaatgcatggccgtggcggatacaagcgaggcgactgatgggcgatactgcgggagtgactcgacaagttcttgtgcgagcacaagctggccggatcgcgcgatgctatcgacaatgcagctgtggtggtcgggcgtgggagtgatttgccagtcggtttgcatggagcggaagagccggcatgccgcggcggtaagcccaacgtggctgcatgccaccagcaagcacacaaaggtaatgttatcgggcggtatgccgcacagtagcatgtcacggaaacggtggaatgcggtaatggtgtcgctgtggcgggcatagccggcaataaggccattccaggtgttcgtggtgggagccggggcgagagacaaaaactgttcggctttattcagatgcccggcttgggcatttgctgcaacaacagcattccaagagagctggtttttttgtggtgtcgattcaaacatttccattgcttgttggagctgtccagcgcgagcaagcgcagccacagtgacgttccaagtggttgtatcccaagcgggcatcttctggcggaaggacgtgaaggtggcgacgttgtcggcaaagaagccgagcatcgagttccaggtgatgacagtccgtgtgccgcgcggcatggcgtcgaacaggcgccgtgcggtatccacgcgccccgcagagccgtaggcggtaagcatggcggtccatgacgcggcgtccttgcgcggcgtggcgtcaaacacccgctgggcatcctccagctgacccagccgcgcatacccgtgcagcagcacgttccacgacaccgtgtcgtgcgtcagcatggccgtgtggaagaagcgcccggcgtcgcccatcctgcccgccgcgcagtgggcgtgcagcatgacgttgcaggccacctggtcgtgcc

SEQ ID NO: 2360 - DNA, 2789 bp, Glycine max
caggagagcaaggttttgaagtttttaggatttatgtggaatcctctttcatgggtcatggaagctgcagcaatcatggccattgctttggccaatggaggaggaaaacctcctgattggcaagactttgttgggattatcacactccttattatcaattcaacaataagtttcattgaggagaacaatgctggtaatgctgcggcagctctgatggctcgtttagcacctaaagctaagttccttcgagatgggaaatggattgaggaggatgctagcattcttgttcctggtgatataattagtgttaagctaggggatattatccctgcggatgctcgtctacttgaaggtgatccactgaagattgatcagtctgcacttacaggcgagtctcttcctgtcacaaaaggccctggtgatagtgtttattcaggctccacatgcaagcagggagagatcaatgcagttgttattgccacaggagttcataccttctttggcaaagctgctcatcttgtggactccacaaatcaagtcctgactgcaattgggaacttctgcatatgttccattgctgtgggaatgatagtagagataattgtcatgtacccaattcaacaccgggaatatcgtcctgggattgacaatctgcttgtgcttcttattggaggaattcctattgccatgcctactgttttgtcagtgacaatggcaattggatcccatcgcttagctcagcagggtgctattactaaaagaatgacagcaatagaagagatggcaggaatggatgtattatgtagtgacaaaactggaactttgactttgaataaactgacagttgacaagaatcttattgagatttttgctaaaggagttgacgtagatactgttgttctcatggccgctcgggctgcacgattggaaaaccaagatgctatagatgccgctattgtagggatgttgggtgatccaaaagaggtaggctcatatatgatgatatatcactttttcatgcttgcaaaacatgctattttgaatcttgcacgcaataaatcagagatagaacgcagagttcattctgtcattgataagtttgcagagcgaggattacggtctcttgcagtagcttaccaggaagttcctgatggaaagaaagaaagccaaggtgggccttggcaatttattggactcttgcctctatttgacccacctagacatgatagcgctgagacaatacgaagggcattaaatcttggagtaaatgttaaaatgataacaggtgatcaactagcaataggaaaagaaacaggacgccgtctggggatgggaaccaacatgtacccttcatcggctttattgggccaaaacaaggatgaagcaattgctaccttgccagttgatgagttgattgaaaaagcagatggatttgctggtgtttttcctgaacacaaatatgagatcgtgaaacgtttacaagctaggaaacacatatgtggaatgactggtgatggggttaacgatgctcctgctcttaaaaaggcagatattggaatagctgtcgccgatgctactgatgcagctcgtagtgcttctgatattgttctgactgaacctggtctcagtgttatcatcagtgctgtactgaccagtcgagcaatattccaaaggatgaagaattacacaatctatgcagtttccatcacaatccgtattgtgcttggtttcatgttactggccctcatatggcattttgattttccaccattcatggtgctgattattgctattcttaatgacggtaccattatgacgatatcaaaggacagggtgaaaccatctccatatccagatagctggaagttggccgagatctttaccactggaataattcttggtggttatttggctatgatgacagttattttcttttgggcagcatataaaacagattttttccctcaaacatttggagtctcaagtcttcagaaaaaggatagggatgactttagaaagcttgcctcagcaatatacctacaagttagcacaattagtcaggccctcatattcattacacgggctcggagttggtcttatgttgaacgtccgggtttgttacttgttgcagcttttgttatcgcccagctgatagctaccttaattgcagtttatgcaaattggagtttcgctgctattgaagggattggatggggttgggctggtgttgtttggctttacaacctcatcttttatatcccacttgactttatcaagttcataattcgatatgccttgagtggaagggcttgggatcttgttattgaacaaaggattgcttttacaaggaaaaaagattttggaaaggaagaacgtgaacttaaatgggcacatgcacagaggacgcttcacggccttcacccaccagagactaagatgttcaatgaacgtacaagttacacagaacttaatcagatggctgaagaggctagaagacgagcagaaattgcaaggctgagagaactgcatacacttaagggtcgtgttgagtctgtggttagactgaagggtcttaacattgacacaatacagcaagcatacactgtctagaatgttgagtttcatgcatgaatcgtgtatgtataatgtgtgtataatgccgttagaagagtgtgatcatagagcagcaaaaaatatatactttaaatgtttgttaaagcagttttggtggacttttttagacatgaaattattggtgcattaatacttaaatgttaaaaagagttcca

SEQ ID NO: 2361 - DNA, 2609 bp, Selaginella moellendorffii
cagggtgctattactaagcgaatgactgcaatagaggagatggcaggaatggatgtcctttgcagtgacaagaccggcaccttaactttgaataagctaaccgtcgacaagaatctcgtggaggtttttgcaaaaggatacgacaaagattacgttttgctacttgctgctagagcgtcaaggatggaaaatcaagatgccattgacgcagctgttgtcggtacgcttgctgatccaaaagaggcccgtgctggtattgaggaagttcactttcttccatttaatcctacggataagcgtactgctctgacttatattgactctgacgggaagatgcacagagcaagcaaaggcgcacccgagcagatattagatctttcttacaataaggttgagattgctcaaagggtgcacgccgtcattgacaaatttgctgagcgtggccttcgctctcttgcagtcgcatgccaggacgttcccgagggcaacaaagagagtccagggggtccatggcaatttgtaggcttaatgcctttgtttgatcctcctcggcatgacagcgccgagactattcgtagggccctgaatcttggggtcaacgtaaagatgataactggggaccagcttgctattggaaaagaaactggccgacgtcttggcatgggcactaacatgtatccgtcatcttcgcttcttggacaaagcaaaggggaggcatttgaaggattgccaattgacgaactgattgaaaaagccgatggatttgcgggggtatttccagagcacaagtacgagatagtaaagcgtttgcaaatgaagaagcatatatgtggaatgactggtgatggtgtcaatgatgcgcctgctctgaagaaggcagatataggaattgcagtggcagatgcaacagatgcagcaaggggtgcttcagatatagtcctgacagaacctggcctgagcgtgataataagcgccgtgctaacaagtcgcgcgatttttcagaggatgaagaactatactatttatgccgtatccatcactataaggatagtgcttggttttatgctgctggcgttgatatggaagttcgattttcccccattcatggtgctaatcattgcaatattgaacgatggcacaatcatgaccatctccaaggacagagtgaaaccatctcctttgcctgacagttggaagctctcggagatttttgcgacaggagttgtgatcggcagttaccttgcgcttatgacagtcattttctactggctggcagaccagactacctttttccctgaccatttccacgttcctcacattggaagcgatgccaacaaaatgcattcggccatctatttgcaagttagtatcgtaagccaggctctgattttcgtcacgaggtcgagaagctggtccttcatggaaaggcctggatttcttctcgttgtggcgtttcttattgcccagctgattgcgacttttattgccgtgtacgccaactggggctttgcctttgtggagggaattggctggggttgggccggtgttatatggctatacaacatcgtcttctacttccctctggatgttatcaagttcgctgtgcgttacatactaagtggcagagcatgggagcttctattcgagcaaagaactgcttttacgcgccaaaaagacttcggaagggaggctcgggaagtgaagtgggctcaggcgcaacgaactctacacgggctccagccaccggacttcaagatacccgagaagggtactcacaaagagacgtcagacatggccgagcaggctttaaggagagccgagattgcaaggttgagagagcttcacactttaaagggtcacgtcgaatctgtagtgaggttgaaaggtttggacatcaacaccatccagcaggcctacactgtctagaggcgatcgatcgagtgagcgacgcgatagtagtggaatgtggatatatttccagtgatgctagtgagctagctagcacagctatggtggtttgtagcgtttggacaattatcatactgacatatatgttgaataataggagataggagagaaagcggagcgtgacaagacgccctgtaagactttgtcgtcacaatgcatggccgtggcggatacaagcgagacgactgatgggcgatactgcgggagtgactcgacaagttcttgtgcgagcacaagctggccggatcgcgcgatgctatcgacaatgcagctgtggtggtcgggcgtgggagtgatttgccagtcggtttgcatggagcggaagagccggcatgccgcggcggtaagcccgacgtggctgcatgccaccagcaagcacacaaaggtaatgttatcgggcggtatgccgcacagtagcatgtcacggaagcggtggaacgcggtagtggtgtggctgtggcgggcatagccggcaataaggccattccaggtgttagtagtgggagccggggcgagagccaaaaactgttcggctttattcagatgcccggcttgggcatttgctgcaacaacagcattccaagagagctggttcttttgtggtgtcgattcaaacatttccattgcttgttggagctgtc

SEQ ID NO: 2362 - DNA, 3020 bp, Manihot esculenta
atgggggacaaaggtgaagttttggaggctgtcttgaaggaaactgtggatttggaaaacatacccatcgaagaagtgtttgagaatctgagatgtagcaaagaaggtctcacaactgaggctgctgaagagaggctgacaatttttggccacaacaagcttgaagagaaacaggagagcaaattcttgaagtttttggggttcatgtggaatcctttgtcatgggtgatggaggcagctgctattatggctattgctcttgcaaatggaggagggaaacctccagattggcaagattttgtgggtattattactctacttttgatcaactcaactatcagttttattgaggaaaacaatgctggtaacgctgctgctgctctcatggctcgtctcgctccaaaagcaaaggttcttcgagatggaaggtggagtgagcaggatgctgctgttttagttcctggtgatattgttagcatcaaacttggagatattgttccagctgatgctcgtttactagaaggtgatccactgaaaattgaccagtctgcacttactggtgaatctcttcccgtgacaaaaggacctggagatggtgtttactctggttctacttgcaagcaaggagagattgaagcagtggttattgccactggtgttcataccttctttggaaaggctgctcaccttgtggatactacaaaccaagttggccacttccaaaaggcaaggagatagaaataaagtcttgactgcaatagggaatttttgcatatgttcaattgctgtggggatggtaatagagattattgtcatgtacccaattcaagatcgagaatatcgtcctggaattgacaatcttcttgtgcttctcattggaggaattccaattgccatgccaactgtcctgtcagtgacaatggctattggttctcataggttatctcagcagggtgccatcacaaagagaatgactgcaattgaagagatggccggcatggatgtgctttgcagtaaaatgcatagagttagcaaaggtgccccagagcagattctaaatcttgctcgcaataagtcagatattgaacgaagagttcatgctgtcattgacaagtttgcagagaggggtttgcggtctcttgctgttgcataccaggaagttccagaaggaaggaaagaaagtcctggaggcccttggcagttcattggcctcatgcccctctttgatccacctaggcatgacagtgctgagactataaggagggctttgaatcttggtgtgaatgtcaaaatgattacaggggaccaactggcaatagggaaggaaactggacgtcgtttgggaatgggaaccaacatgtatccttcatctgcattgctaggacaagacaaggatgagtctatttctgctttaccaattgatgaactgattgagaaagctgatggctttgctggtgttttccctgagcacaaatatgagatagtaaaacgcttgcaagctagaaaacacatttgtgggatgactggtgatggagtcaatgatgctcctgctcttaagaaagctgacattgggattgctgttgctgatgcaactgatgcagctcgtagtgcttcggatattgtcctcacagaacctggccttagtgttatcattagtgctgtcttgacaagtcgagcaatcttccagaggatgaaaaattacactatctatgcagtttccattacaattcgtatcgtgcttggtttcatgctgctggccctcatatggcagtttgattttccaccttttatggtgcttatcattgctattcttaatgatggtaccattatgacaatatctaaggatagggtgaaaccatctcctctgccagacagctggaagctggcagagatttttaccactggcattgttcttggaagttacctggcaatgatgacagtcatcttcttttgggcagcatataagacggacttcttcccaagggtatttggagtatcaactctggagaaaacagctcatgatgacttcagaaagcttgcatcagcaatttacttgcaagtgagcactatcagtcaggccctaatttttgtaactcggtctcgaagttggtcttacgttgaacgccctggattactactcgttgtggcttttttggttgctcagctgattgctactttgattgcagtctatgcaaattggagttttgctgcaattgaagggattggttggggttgggcaggtgtaatatggctttataacatcatcttttacatcccacttgacttcatcaagttctttatacgctatgctttgagtggtagggcctgggatcttgttatcgagcaaaggattgctttcacaaggcaaaaggatttcggtaaggaacaacgagagcttcagtgggcacatgcacagagaacattgcatggcttgcaaccaccagacaccaagatgtttacagagcgaacccatttcactgaactcaatcagatggctgaagaagctaaaaggagagctgaaattgcaagattgagggaacttcatacgctgaagggtcacgtagaatcagtggtgagactgaagggcctggacatagacacaattcaacaagcatacactgtgtgagaactacttggtgtacaacaacaataagcgacttgcgttactgcttcctagattagagacctgtaagcagcactcacctacgagttatcttgaaacgacaatgccctacaacgtttcatgagttccaccatctaaaagagtgcatcctcaaattctttctgtattttcgttccttagttatctacgtcttttgccttctgatgcccacaagagggggaggtctcatgttttttgccattttgtgtctatattagtaaaggttatggctgttggtctttttatttatgtactactctacatatgataggtgggtaattatgctatgctactctctggagttagaacttttccagttttggataattaagtgataaaattgctgttttcacttctc

SEQ ID NO: 2363 - DNA, 1768 bp, Arachis hypogaea
cgaacgcagagttcatgcagtgattgataagttcgcagagcgcggtctgcgatctcttgctgtagcataccaggaagttcccgatggaaggaaagaaagtgctggaggcccatggcagtttattggccttatgcctctctttgacccacctaggcatgatagtgccgaaacaatacggagggcactaaatcttggagtaaatgtcaaaatgattacaggtgatcaactagctataggaaaggaaacaggacgacgcttgggaatgggtaccaatatgtacccttcatctgctttacttggacaggacaaggatgaatccattgctgccttgcccattgatgaactaatcgaaaaagccgatggatttgctggtgtatttcctgagcacaagtatgagattgtgaagcgattgcaagcgaggaaacatatctgtggaatgactggtgatggagtgaatgatgcacctgctctaaagaaggcagacattggtatagctgtcgccgatgccacggatgctgctcgtagtgcatctgatattgttttaacagaacctggtcttagtgttatcataagtgctgttttgaccagccgagctattttccagagaatgaaaaattatacaatttatgctgtctcaatcacaattcgtatcgtgctcggtttcatgttgctggctctcatatggaagtttgattttccaccttttatggttcttattattgctatcctgaatgatggtactattatgacaatttcaaaggatagagtaaaaccgtcaccactgccggatagctggaagctagcagagatatttactactggcattgtgctcggaagttacttggcaatgatgactgtcattttcttttgggctgcatacaagacaaatttcttcccgcgagtgtttggtgtttcaacccttgaaaaaagtgctcatgatgatttccgaaaactcgcctcagcaatctatcttcaagtgagcaccattagccaagctcttatattcgtgactcgttctcgaggctggtcatatgtcgagcgtccgggattattgctggtggttgctttcatcgttgctcagctgatcgccacgttgatcgcagtatatgcaaactggagctttgcggcgatcgaaggaataggatggggttgggctggtgtaatatggctatataacataatattctacatccctcttgatatcatcaaattcttgattcgctatgctttgagtggaagggcttgggatcttgtcattgagcaaaggattgcattcactaggcaaaaggactttgggaaagaacaaagggaacttcaatgggcacatgctcaaagaacactgcatggattgcaagcccctgacactaagatgttcactgagcgcacgcatttcaacgagctcaatcaaatggccgaagaagctaagaggagagccgaaattgcgaggttgagagagctccacacactgaaaggtcatgtggaatcagttgtgagattgaagggtctggacatagacacaattcagcaagcatacacagtttgagaggttttgttgcatagtgatgataatattattattatgattattgtaaaggattgatagttattatcgctgagagggagataatgtaatgaatgaatgattgcactctctagtgtttttattatatttttttatttgtgacttttgctttaagcacttaaaagtagtgctctcttctgtcagctttatctatctatgcacctttgcttctttttaatcatataa

SEQ ID NO: 2364 - DNA, 2630 bp, Marchantia polymorpha
  misc_feature (2616)..(2616): n is a, c, g, or t
tccattgccatgcccaccgttctttcggtgacgatggctatcggatctcaccgtcttgcacagcagggtgctattacaaagaggatgacagctattgaggagatggctggcatggatgttctctgcagtgacaaaactggaacattaaccctcaacaaactgacggttgacaagaacttgattgagacgtttactcctggagttgacaaggatatggttgtgctgcttgcggcgagggcatcaagaacggaaaatcaagatgctatcgatgcagctatcgtgaacatgcttgcggatccgaaagaagccagagcaggtgttcaggagattcactttctgccattcaatccaacagacaagagaactgctttgacctacgttgataacgaaggtcactggcacagggctagcaagggtgcaccagagcagattctggaacttgcccacaacaaggacatcatcagttcaagagtgcatgctgtgattgataaatttgccgagcgcggtttaagatctcttgctgtcgcacgtcagaaaattcctgaaggaaccaaggagagtgctggtgggccatgggaattttgtggattgctgcccctcttcgatcctcctcgacacgacagtgctgaaactattcgccgtgctttgaatttgggcgtaaacgtgaagatgattacaggtgatcaacttgcaattgcgaaggaaactggtcgtcgtcttggtatgggtatcaacatgtacccgtcgtcttcactattgggtcagcacaaggatgaagctattgccgctctccctatcgatgagttgattgagaaggctgacggatttgctggagtgttcccagagcacaagtacgaaatcgtgaagcgtctccaagagaagaagcacatctgcggtatgactggtgatggtgttaatgatgctccagctcttaagaaagcagatatcggaatagcagtagccgatgctacagacgcggcaagaagtgcgtccgacattgtcctcactgagcctggtctaagtgtcatcatcagtgcagttttgaccagtcgtgccattttccaaaggatgaagaactatacaatttacgctgtgtccatcaccattcgtattgtgctcggtttcttgctcttggctctcatttggaagttcgacttttctcctttcatggttctgattattgcgatattgaacgatggtactatcatgacgatctccaaggacagagtgaaaccttctcctctgcctgatagctggaagttgaaagaaatttttgccaccggtgtcgtactgggaacttatcttgctgttatgaccgttgtgttcttctggttagcacacaagactacatttttccaggaaaagtttggtgtccgagatatctccggcgataggaatgagttgacagctgctgtatacttgcaagtcagcattgtcagtcaggcgctcattttcgtcacccgttctcgaagttggtctttcctcgagcgtcctggatttctgttggtggccgctttctggatcgctcagctgattgccaccttcatcgctgtgtacgccaactggtccttcgctttcatcaagggtattggatggggttgggctggagtcatttggctctacagtttgatattttacatcccccttgacatcataaagttcctcgtacgttatattctcagcggtcgcgcatggcattacatgatcaaccaaaggactgccttcaccactcagaaggatttcggaaaggaggctcgtgaaatgaaatgggctcacgctcagagaactctacatggtcttcaatccccggacgtgaaaatggctggagatagaggaagttacaaggagttaaacgatattgccgagcaagcgaagaggcgtgccgagattgccaggttgagagagttgaatacgctgaagggacatgtggaatcggtcgtccgtatgaagggtttagatatcgacactattcagcaagcgtacacagtataatctacaatgacgaaattattattcgaaatattggctggtgatggccgagataagtcggctgagttcgtagaatggggctgccttgaaggcttcagtcatgcaacaaatttccacaggcctgattgtaaaaagaagggcgtcaaggcttgtgggtaaacctcgatgccaattgcgtcggtgctcttttttgcaaatcttaaacctgaagaggtatggaacaggtgactaagtgcgccagacatactaagcgacctgcaatccagaccggtccctacatatgtaatctcattatcctcgagattggagaagtggcttcgtcttctgagccgccgaagagctactgtggagacagaggcacttgttgatagattagggagatagaatattgattcttgaggaaaggccgaggagtaactgtagagttgttggagaacgtgaatgtgagaagcgaatatgctcaagagtacgacattcggtgtccgatttgagaaaacttagctgttcggctggtgtttggtccgaaaacccgactagagtgagtgggtgaggtgtttgaatccaatgaatgtttggcgctgcctaagttggcagtctcacataatgtaaaattctgcagtcacgcanattggcttaaaaaa

SEQ ID NO: 2365 - DNA, 1754 bp, Centaurea maculosa
  misc_feature (1098)..(1098): n is a, c, g, or t
  misc_feature (1119)..(1119): n is a, c, g, or t
  misc_feature (1534)..(1534): n is a, c, g, or t
  misc_feature (1539)..(1539): n is a, c, g, or t
  misc_feature (1577)..(1577): n is a, c, g, or t
tgaaatagaatgcatcgtgtcagcaagggtgcccctgaacagattttgaaccttgcacataataaatcagacattgagcgcagggttcaattgtgatagataaattcgctgaacgctggtttgcgatcccttgcagtagcatatcaggaagtccctgagggaaagaaggaaagcccaggaggtccatgggaatttgttggcctcatgcctctctttgatccacccaggcatgacagtgcagagacgattaggcgggccttgaatcttggagtaagcgttaaaatgatcacaggtgatcagctagcaataggaaaagaaactggacgacgccttggaatgggaaccaatatgtacccttcatctgcattactgggacaaaacagggatgaatcgattgttgccttgcccgttgatgagctgattgaaaaggctgatgggtttgctggtgttttccctgagcataaatacgagattgtaaaacgtctgcaagctagaaagcatatatgtggtatgactggtgatggagtgaatgatgcccctgcactcaagaaagcggacattggaatagcggttgccgatgcaacggatgctgctcgtagtgcatctgatatagtgctcacagaacctggtcttagcgttatcatcagcgctgtactaactagtcgagcaatctttcaaagaatgaaaaattacaccatctatgctgtttccatcactatccgtattgtgcttggtttcatgctactagccctcatttggaagtttgactttccacccttcatggtgctgatcattgccattctcaatgatggtaccattatgacgatctcgaaggacagggtgaaaccgtctcctcaaccggacagctggaaattgtccgagatttttgccacagggatcattcttggtagctacttggctatgatgactgtcattttcttttgggcagcatatgataccaactttttcccgcgtgtgtttggcgtttcaagccttcagaaaactccaaacgttgctgaggacgaacaagacttcaggaagctagcctcggccatatacctacaagtgagtaccatcagccaggcacttatattcgtnacacgatccagaagttggtcnttttacgaacgtccaggagctctacttttcggtgctttcttgattgctcaactgatcgcgacgcttattgccgtttatgcaaactggagtttttgtgccattgaagggatcggatggggttgggcgggagttatatggctttacaacatcgtcttctacatcccactcgatatcatcaagttcttcatcagatacgctttaagcggtagagcttgggatcttgtcatcgaccaaagggttgccttcacgagaaaaaggaacttcgggaaggaagaccgtgagctcaaatgggctcaagcgcaaaggacattgcacgggcttgacccgcccgagacccagtttgttgaacgcaacaaccacaacgagcttaatcaaatggcggaagatgcaattcgccgagctgagatgacaaggntgcgngaattgcttactctcaaaggtcacgtggaatcggttgngaagttgaagaacatcgacatagatacgattcaacagtcgtacaccgtttgagaatgcttcatacttccacctgaatatacatgtatgcaaagagtagcaacatagttaacgttttaatcaagcgtgtgttgtttccgcgttttgtatcataaggggacgtatggtttgaccaaatg

SEQ ID NO: 2366 - DNA, 1823 bp, Cucumis melo
aaagttcatgctgtgatagacaagtttgcagagcgaggtttacgctcccttgctgtggcataccaggaagttccagatggtcgaaaggagagtgctggaggtccatggcagtttgttggcctcctgccactgtttgacccaccaaggcatgacagtgcagagacaataaggagggcattaaatcttggagtgaatgtgaagatgattactggtgaccagctggccattggaaaggaaacaggacgtcgcttggggatgggaaccaacatgtatccctcatctgctttgctaggacaggacaaggatgagtctattgctgctttacctgttgatgaactgatagaaaaagctgatggctttgctggcgtttttcctgagcacaaatatgagattgtaaagcgcctgcaggcaaggaaacatatctgtggaatgactggggatggagtaaatgatgctcctgccctcaaaaaagctgacatagggatagctgtcgctgatgctacagatgctgctcgcagtgcttcagacatagtccttacagagcctggtttgagtgttatcattagtgctgttttgaccagccgtgctatctttcagaggatgaaaaattacactatatatgcagtttcgatcactattcgtatagtgcttggtttcatgttgctggctctcatatggaaatttgacttcccaccatttatggtgcttatcattgccattctcaatgatggtacaataatgacgatttcaaaggatagagtaaaaccgtctcctttgcctgatagctggaaactggctgaaattttcacaactggcattatacttggcggttacttggcaatgatgactgttatcttcttttgggcggcctataagacaaacttttttccacgagtctttggggtagcaactctcgagaaaactgctcacgatgacataaggaaactggcctcagcagtgtatcttcaagtaagcactataagtcaggctctcatatttgttactcgctctcgaagttggtcttatgtggaacgtcctgggttattactggttgcagcttttctggttgcacagctgattgctactttaattgcggtttatgcaaactggggctttgctgccattgaaggaattggatggggttgggctggtgttatctggctttacaacattatcttttacatcccacttgatctcattaagttctttatacgatatgctttgagtgggagggcttgggatcttgttattgaacagaggattgccttcacgagacaaaaggattttgggaaggaacaacgggagctacaatgggctcatgcgcaaagaacattacacggattgcaagcacctgacgccaaaatgttccacgaccgaactcatttcaccgagctcaatcagatggctgaagaagccaaaaggagagctgaaattgcaaggttgagggaactacacaccttgaaaggccatgttgaatcagtggtgaggctgaaaggacttgacattgacacaattcagcaagcttacacagtgtgaagaagaaacactgtttgagatcactctcattgtaaatcatggcaactttgtcagttctgaaactgaagaaaatttgcaaaaccataatgttttgtttaatattctaaatgagtcctaatgtctattttaatgaatatctaaatcactcgtctccatcccccaatcttagcaatgcttgcattctgcattctcagaaatgcttcagtaggtctataatacgaccaactttttttgtagcttacacagattaatttattatatactttgttactgttgttaatgttaca

SEQ ID NO: 2367 - DNA, 2202 bp, Pennisetum glaucum
atggatgtccttgcagcgacaagactgggacattgacattaaacaagttgactgtggacaagagcctcattgaggttttccaaagaggggttgatcaggatacggtaattctgatggctgccagagcttctcgtacggaaaatcaggatgccatagatgccacaatagttggtatgctggctgatccaaaggaggctcgtgctggtgttcaagagattcactttctgccatttaatccaactgacaaaagaactgctttaacctaccttgatggagagggaaaaatgcatcgtgttagcaagggagcaccagagcagatccttcatcttgcacacaacaagtcagatattgaaagaagggtcagagctgtgattgacaaatttgctgagcgtggcttgcgagcacttggtgtagcttaccaggaagtgccagatggtaggaaagagagtcctggaggaccatggcagttcatcgggctcttgcccctttttgacccccctcgtcatgatagtgcagaaacgatcagaagggcactcgatcttggtgtcaatgtcaagatgattacaggtgatcagctcgctattgggaaggaaacagcacgtcgtttgggcatgggtaccaatatgtacccttcatctgctttactcgggcaggataaggatgagtcgattatttctttgccagttgatgaattgatcgagcaggctgatggttttgctggagtctttccagaacacaagtatgagatcgtgaaacgcttgcaagcaaggaaacacatttgcggcatgactggggatggtgtaaatgatgccccagctttgaagaaggctgatatcggtattgcagtagcagactccaccgatgcagcacgtagtgcatcggacattgtcctgactgaaccaggccttagcgtgattattagtgctgtgctgacgagtcgggcaattttccaaaggatgaagaattatacgatatatgctgtgtcaattaccatccgtattgtgcttggctttatgcttcttgcgctgatatggaagtttgacttcccaccgtttatggtcctgataattgccatcctcaatgatggtaccattatgactatctcgaaggacagagtaaaaccatctccaatgcctgatagctggaagttagctgagatctttgcaactggagtagttcttggtggatatttggccatgatgacagtcattttcttctgggctgcatacaagactaacttcttcccgagagtgtttggtgtcgaaagccttgagaaaactgcccaggatgattttcagaagcttgcttctgccgtgtaccttcaagtcagcaccataagtcaagccctcatctttgtgacacggtctcgcagctggtcgtttatggagcgtcctggattcttgttggtctttgctttcttggtagcacagctgatcgctactctgattgctgtatatgccaactgggcgtttgccgcaatcaagggcatcggatggggctgggctggtgtcatctggctttacaatgttgtattctacttcccgctggatatcatcaagttcctcacccgttacgctctgagcgggagggcatgggatctcgtacttgagcagaggatcgcattcacaaggaagaaggattttggaagggaagagagggagctcaagtgggcacatgctcagaggacgctccacgggctccaggcaccagagccatccatcttcgagaacaagacgaccttcaatgaactgaaccagctcgcggaggaggcacgcaggagagccgagatggcgaggttgcgagaagtgaacaccctcaaggggaagatggagtcggtggtgaggcagaaggggttggacatggagaccatccagcagtcctacaccgtgtgattgatcgattgatctgggatatggattgattatagaggcggcttcttactactactactatatatatatactgtactaggcagcaataaggaaacccgtggttggtccttgataacgatgatgatatgtttctaacagtcggtgcggtgcttatcgctctagtctctcacccctatatgctgtttgtccattaaccacccccggcagaccatttaccgcattgagatgagacatactcatgtagagtccttattagcagatgatggtatagtacaacatttttgcttgttatatcctgtgctatctggtc

SEQ ID NO: 2368 - DNA, 592 bp, Triticum aestivum
ttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcaacgaggtggaggaggtcaagaaggagtaccctgacgcctatgtccgtgtcatcggcttcgacaacatgcgccaggtgcagtgcgtcagcttcattgccttcaggccaccaggctgcgaggaatctggcaaggcctaaagtgcaagttgaagtaacacatatacatgccatgttagttcacatttgtcggcagctctgctttctcggttttacttctcgttctactcatatgtgaatatatgagcatatgtatgtaagcacctaccaacgtaggtcgaggacgatgcatatgagaattacaacactggctatacatacacacatatattatatgcaatccgtgaattattgtcttgccatcaattgatggaaatgttactttgtttgcag

SEQ ID NO: 2369 - DNA, 993 bp, Triticum aestivum
  misc_feature (873)..(873): n is a, c, g, or t
aatcaagtgtggcctagctagctatcgcctccccacctaacaatttacgtactcgggcatggccccagccgtgatggctttttccggcaccaccgatcgcgcccttccaggggctcaagtcgaccgccggcctccccatcagctgccgctccggcagcaccggcctcagtagcgtcagcaatggcggaaggatcagatgcatgcaggtgtggccgagtgagggggtctattttttcgagaccctgtcttacttgccacccctctccagggaggccctcttgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggttaagaaggagtaccctgatgcgtatgtccgagtcatcggcttcgacaacatgcgccaggtgcaatgcgtcagcttcattgccttcaggccaccaggctgagaggaatccggcaaggcctagagtgcaagtagaagtaaccgatatacatgtcatgttagtcaagattgtcgggggctctgcttactcagctgtacttctcgtcctactcatatgtgaatatatgagcatatgtatgtaagcccctaccaatgtaggtcgaggaggatgcatatgagaattattggccgggctaacatatacctatgtatgatatgcaaccaagggattatgtcctgccgtccattgatgaaaatgtactttccttggggccgtgtgcaaacccctcaagcccagtacaaggcccccnggggggggcggcccaaaattttccctaagggggcccaggtttcccggacccggcctttttggaaaaggggggccccaagggggggtggatttcaaaccaaagggcggcgcgggggtatac

SEQ ID NO: 2370 - DNA, 580 bp, Hordeum vulgare
tgtcttacttgccaccgctctccacggaggcactcctgaagcaggtcgactacctgatccgctccaagtgggtgccttgtctcgagttcagcaaggttggattcatcttccgtgagcacaatgcctctccagggtattacgatggccgatactggacaatgtggaagctacctatgtttgggtgcaccgacgccacacaggtgttaaacgaagtggaggaggtcaagaaggagtaccctgacgcctatgtccgcatcatcggattcgacaacatgcgtcaggtgcagtgcgtcagcttcatcgccttcaagccaccaggctgcgaggagtctggcaaggcctaaacaagctaactcccttttatcatacaacatggtttcgtgccaggttcattttatttccctttttacttttgttctgcttgtgtatgtgttctctccctgcaactcgagttaacattgtatgagtactacaatcataagagtactacaactacgtttgggtgaggtgcatgtaaactacggctatgcataaagagaaatatacatgataagaattccagtgatatctaaaaaaaaaa

SEQ ID NO: 2371 - DNA, 655 bp, Hordeum vulgare
tccagcgccagcctcggcagcgtcagcaatggcggaaggatcaggtgcatgcatgtgtggccgattgagggtatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgtttgggtgcaccgacgctacacaggtgcttaacgaggtggaggaggtcaagaaggagtaccctggcgcttacgtccgtatcatcggcttcgacaacctgcggcaggtgcagtgcgtcatcttcatcggcttcaggccaccgtgttgcgaggagtccggcaaagcataaactacgaggtgaaagaagggcctatgacgcatgaagggcttttgtgaacttcacttttgtccacaactctgctttccaaacagaacataaatgactcctctatgatctgtggttgtacgaacataggtggaggagcctatttgcaaagggagaatcctacgaccggccacacattaacaacacccgggtcatattgataaaatttcaaacagacggcctt

SEQ ID NO: 2372 - DNA, 374 bp, Pinus taeda
acgtgcgaccttggctgtcactcatctcgagtttagcaaggttggcttcatcttccgtgagcacaatgcctctccagggtactacgacggtcgatactggacaatgtggaagctacccatgtttgggtgcaccgacgccacccaggtgataaacgaggtggaggaggtcaagaaggagtaccctgacgcctatgtccgcatcatcggattcgacaacatgcgtcaggtgcaatgcgtcagcttcatcgccttcaagccaccaggctgtgaggagtccggcaaggcctaaacaagctaactacccttcatcatacacatggtttcgtgtcaggttgatttttatttcccttttttactttgttctgcttgtgtat

SEQ ID NO: 2373 - DNA, 749 bp, Triticum aestivum
tatacctacatagtacagccatggcccccaccgtgatggcctcgtcggcccctccgtcgctcctttccaggggctcaagtccaccgccggcctccccgtcagccgccgctccaacggcgctagcctcggcagcgtcagcaacggtggaaggatcaggtgcatgcaggtaaacaacatcgtctctgtctttctactcattttctagctgacggacggaagtcaataacatcaattgtgtagaactagaattctagcctgttaatgtatcaaaaatgtcaatcttatttgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcattgccttcaagcccccgggctgcgaggagtccggcaaggcctaaacagctcactcaccacgggccacatataaagtgccattgcagttttgtcacctccgacatcgctccgggttttcctt

SEQ ID NO: 2374 - DNA, 572 bp, Triticum aestivum
cctgtcctacctgccaccgctcagcacggagggcctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttatttgttcctaagaatatgtgtatgtccatgttcatgtaccaacatggctcgagaaagcatgcttcgtatgtgaatgctatcggtggctatgtatatgcacggacgcataatattatacaatatgtcaacta

SEQ ID NO: 2375 - DNA, 644 bp, Triticum aestivum
  misc_feature (5)..(5): n is a, c, g, or t
  misc_feature (8)..(8): n is a, c, g, or t
  misc_feature (36)..(36): n is a, c, g, or t
  misc_feature (62)..(62): n is a, c, g, or t
  misc_feature (69)..(69): n is a, c, g, or t
  misc_feature (99)..(99): n is a, c, g, or t
  misc_feature (132)..(132): n is a, c, g, or t
ggtancangcgttcctacccgtcaggcactggagtnacatggagatagtctcagttgcgatnggctcanattggacttctattccacctttcaagagcncttaacagtgatactaacgtccatggtccttcntaggttagcaagttgtttgtctttgtggcccaaagttccccggtatacgaaggccgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttaaaacaatggcctatgtatgattgtcttttgtgaacttcacttttgtccaaggactctgcttcccgaccagagcatatttttccttcggtatgatctgtgtttgtacgaacataggttgtggagcatgcatatgtaaattctagcaccggctacacatatacaacaccagtgtgatatttattatatacaacaagcggaccattgtcctgctgttaattctcggaaaactttctttatttggcactgcaa

SEQ ID NO: 2376 - DNA, 502 bp, Triticum aestivum
cacgagggtcagccgccgctccagcagtgcggctggcctcggcagcgtcagcaacggcggaagaatccggtgcatgcaggtgtggcctattgaaggcatcaaaaaattcgagaccttgtcttacctgccaccgctctccacggaagccctcctgaaacaggtcgactacctgattcgctccaaatgggtgccgtgtctcgagtttagcaaggttggcttcatcttccgtgagcacaatgcctctccagggtactacgacggtcgatactggacaatgtggaagctacccatgtttgggtgcaccgacgccacccaggtgataaacgaggtggaggaggtcaagaaggagtaccctgacgcctatgtccgcatcatcggattcgacaacatgcgtcaggtgcaatgcgtcagcttcatcgccttcaagccaccaggctgtgaggagtccggcaaggcctaaacaagctaactacccttcatcatacaacatggtttcgtgtca

SEQ ID NO: 2377 - DNA, 592 bp, Lolium multiflorum
gccgattgagggcatcaagaaattcgagaccctatcttacctgccaccgctctcggccgaggccctcctgaagcagatcgactttttgatccgctccaaatgggttccctgcttggagttcagcaaggttggcttcatcttccgtgagttcggcagcactcccggatactacgacggcaggtactggacaatgtggaagctgcccatgttcggctgcactgacgccgcccaggtcctcaaggaggtggatgaggtcaagaaggagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggccgctatatatatatacttttgccgaagactcggtttattttgcatttaatgtgattgtgtttgcacgtattcaagtatgtatttgcctaccgacctaggaagagctgtgatatgtgaattctagaaccggctacatgtaaaagcatacacatacacatataatattatatattatttccgagtgtatttatatcc

SEQ ID NO: 2378 - DNA, 632 bp, Avena sativa
ccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagcttcccatgttcggctgcaccgacgcctcacaggtgatcaaggaggtggaggaggtcaagaaggagtatcctgacgcctatgtccgcatcatcggcttcgacaacatccgtcaagtgcagtgcgtcagcttcatcgccttcaagccaccgggttgcgaggagtctggcaaggcctaagccacgagctgggagtaaccgccttttctgagaatctgggaatagccgcctatgcaaggcatgttagttcactttttgttgatgactctcctttcggtgttttacttcaggttccatacaattgtgtatgtatgtacctatgtttgggcgtacctatctacgtaggtcgaggaacatgcatatgttgattgtataaccggctacacatacacatatatatttatatacaaaccacatactattgtcttcttgctagttgatgaaaaatttctttatttgctgctaaaaaaaaaaaaaaaaaa

SEQ ID NO: 2379 - DNA, 583 bp, Avena sativa
gacttcttgattcgctccagtgggttccctgcctcgagttcagcaaggttggcttcatcttccgcgagtacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggaaaggcctaagccacgagctgggaagaacagatgctatatgaagtgtcttgttcaaatttgtcgacaattctgattttggggttttacttctggttccatataattatgtatgtacacacgtatgtatgtatgtatgtatgcacctacaaacgtaggtcgatgaacactcgcaggcttgagtaagtctgttccgtattagattgtcttcgttggctaacccaggcagtgcaaatgaggtttcagatttatgcgagggattctatatgtttgctggtgatgttgtttggaatctggat

SEQ ID NO: 2380 - DNA, 781 bp, Avena sativa
aagtccaccgctggcctccccgtcacgccgtcgcagctccggaagcctcggcagcgtcagcaacggtggaaagaatcaagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcacccctggatactatgacggcaggtactggacaatgtggaagctgcccatgttcggctgcactgacgcctcacaggtcatcaaggaggtggaggaggtcaagaaggagtaccctgacgcctatgtccgcatcatcggcttcgacaacatccgtcaagtgcagtgcgtcagcttcatcgcattcaagccaccgggctgcgaggagtccggcaaggcataagctgcgatccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgtgatgcaagtgtaagccttttttcagtatgtttctacataaatagaacaattttg

SEQ ID NO: 2381 - DNA, 631 bp, Avena sativa
gcagcgtcagcaacggtggaagaatcagatgcatgcaggtgtggcctattgagggcatcaagaagttcgagaccctttcttacctgccaccactctcagaggaggccctcctgaagcagatcgacttcttgatccgctccaagtgggttccctgcctcgaattcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatgaaacaacggccgcgctatatacttttgccgacgactctgctccagggttttgttttgcaagcaatatgattgtgtatgtacgtatgcttgtatgtatgtacctatcaacctaggtgaagagctcaaatgtgaattctagaaccggctatacgtaaggacatacacatatatttttt

SEQ ID NO: 2382 - DNA, 817 bp, Avena sativa
ccaccaccgtcgcgcccttccacgggcctcaagtccaccgctggcctccccgtccagccgtcgcagctccggaagcctcggcagcgtcagcaacggtggaagaatcagatgcatgcaggtgtggccgattgagggcatcaagaagttcgagaccctttcttacctgccaccactctcagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgacccgggaataacagatgctatatgaactgtcttgttcaaatttagtacaaaaattttgattttgtaggttttacttctggttccataatataggtggatgaacaatcgcaggcttggttaagtttgttcctttttagattgttttcattgattaaacccggcaacgcaaatgaggtttcagatttttgggagggattttatttgtttgttgttgatgttttttggaatttggatatatataaaaagctatgtgatgcaagtgtaacccttttttcagtatgtttttacataaatagaacaattttgagttt

SEQ ID NO: 2383 - DNA, 685 bp, Avena sativa
ttacttgccaccactctcagaggaggccctcctgaagcagatcgacttcttgatccgctccaagtgggttccctgcctcgaattcagcaaggttggcttcatcttccgcgagcacggcagcactcctggatactatgacggcaggtactggacaatgtggaagctgcccatgttcggctgcactgacgcctcccaggtcatcaaggaggtggaggaggtcaagaaggagtaccctgacgcctatgtccgcatcatcggcttcgacaacatccgtcaagtgcagtgcgtcagcttcatcgcattcaagccaccgggctgcgaggagtccggcaaggcataagctgcgatccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgcgatgcaagtgtaaggctattttcagtatgtttcaacataaatagaacaattttgagttttagaaatggagggttgctttgttaagatcc

SEQ ID NO: 2384 - DNA, 675 bp, Avena sativa
gaggcatcaagaagttccgagacccctttcttaccctgccaccactctcagacggaggccctcctgaagcagatcgacttcttgacccgctccaagtgggttccctgcctggagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgatccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgcgatgcaagtgtaaggctattttcagtatgtttcaacataaatagaac

SEQ ID NO: 2385 - DNA, 826 bp, Avena sativa
cctagctagctatctcatctctaattagcagtatacttagcaccatggcccccgtccgtggcttcgtcggccacctcggtcgcgcccttccaggggcgtcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtctggcaaggcctaagccgcgagctgggaataacagatgctctatgaagtgtcttgttaaaatttgtcgacaattctgattttgaggttttacttctggttccatataatagggcgatgaacaatcgcaggcttgggtaaagtctgttccttcgtagattgtcttcgttgattaaccccaggcaatgcaaatgaggtttctgatttatgcgaaggattctatccgttttgttttttatgttgtttggaatctggatatatatatatatatata

SEQ ID NO: 2386 - DNA, 834 bp, Avena sativa
catctctaattagcagtatacttagcaccatggccccgtcgtggcttcgtcggccacctcggtcgcgcccttccaggggttcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatgaaacaacggccgcgctatatacttttgccgacgactctgctccagggttttgttttgcaagcaatatgattgtgtatgtacgtatgcttgtatgtatgtacctatcaacctagggtgaagagctcaaatgtgaattctagaaccggctatacgtaaggacatacacatatattttttccgaatgtgtttatatccaatccacaagtgtgtttgataataattgattggaatttctattaattcttcct

SEQ ID NO: 2387 - DNA, 638 bp, Avena sativa
agcaatgccggccttggcagcgtcagcaacggtggaagaatcagatgcatgcagggtgtggccaattgagggcatcaagaagttccgagaccccgtcttacctgccaccactctcagaggaggccctcctgaagcagatcgacttcttgatccgctccaagtgggttccttgcctcgagttcagcaaggttggcttcatcttccgcgagcacggcagcacccccggatactacgacggcaggtactggacaatgtggaagctgcccatgttcggctgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgaggttttacttatggttccatataatagggcgatgaacaatcgcaggcttgggtaaagtctgttccttcgtagattgtcttcgttgattaacccaggcaatgcaaatgaggtttctgatttatgcgaaggat

SEQ ID NO: 2388 - DNA, 829 bp, Avena sativa
gcctagctagctatctcatctctaattagcagtatacttagcaccatggcccccgtccgtggcttcgtcggccacctcggtcgcgcccttccaggggcgtcaagtccactgctggccttcccgtcagccgccgcagcaacgccggccttggcagcgtcagcaacggtggaagaatccgatgcatgcaggtgtggcctattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggtttgttttacaagcaatatgattgtgtatgtacgtatgcttgtatgtatgtacctatcaacctaggtgaagagctcaaatgtgaattcttgaaccggctatacgtaaggacatacacatattttttttccgaatgtgtttatatccaatccacaagtgtgtttgataataattgattggaatt

SEQ ID NO: 2389 - DNA, 637 bp, Avena sativa
agaccctgtcttacctgccaccactctcagaggaggccctcctgaagcagatcgacttcttgatccgctccaagtgggttccctgcctggagttcagcaaggttggcttcatcttccgcgagcacggcagcaccccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtctggcaaggcataagccacgagctgggaataactgccttttctgagaatctgctgggaataactgcctatgcaaggcatgttagttcactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaaaccacatactattgtcttcttgctagttgatggaaattttctttatttgctgctag

SEQ ID NO: 2390 - DNA, 869 bp, Avena sativa
ccaccgtgatggcttcgtcggccaccaccgtcgcgcccttccagggcctcaagtccaccgctggcctccccgtcacgccgtcgcagctccggaagcctcggcaggcgtcagcaacggtggaaagaatcagatgcatgcaggtgtggccgattgagggcatcaagaagttcgagacccttcttacctgccaccactctcagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcccaggtgatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaacccaggcaatgcaaatgaggtttctgatttatgtgagggattctatctgtttctttttgatgttgtttggaatctggatatatatacgtagccatgtgatgcaagtgtaagactacttttttcccagtatgtttctacataaataaaacaagtttgagttaaagtaaaaaaaaaaaaactaaaagagac

SEQ ID NO: 2391 - DNA, 429 bp, Avena sativa
cgagaccctttcttacctgccaccactctcagaggaggccctcctgaagcagatcgacttcttgatccgctccaagtgggttccctgcctggagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgctatcatcggcttcgacaacatccgtcaagtgcagtgcgtcagcttcatcgccttcaagccaccgggctgcgaggaatctggcaaggcataagttgccagctggtacaagtggccgctatatgaaacagtggccgcgctatatacttttgtccgacgactctgctcca

SEQ ID NO: 2392 - DNA, 546 bp, Avena sativa
catcaagaagttcgagaccctgtcttacttgcaccgctctcggaggaggccctcctgaagcagatcgacttcttgatccgctccaagtgggttccctgcctggagttcagcaaggttggcttcatcttccgcgagcacggcagcacccccgggtactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggctgcgaggagtccggaaaggcctaagccgtgagatggggataacagatgctatttgtcacacacttctgattttgaggttttacttctgattttgagtatataagtagccatgtgatgcaagtgtaaggctacttttgtcagtatgtttcaacataagtaaatactagaacaagtttgagttttagaaatggaagggttgctttgcca

SEQ ID NO: 2393 - DNA, 813 bp, Avena sativa
acctcccggttcgcgcccttccagggcctcaagtccaccgctggcctccccgtcagccgccgcagcaagccggcctcggcagcgtcagcaacggcggaaggaccaggtgcatgcaggtgtggccgattgagggcatcaagaagttcgagaccctttcttacttgccaccactctcggaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaacccaggcaatgcaaatgaggtttctgatttatgtgagggattctatctgtttctttttgatgttgtttggaatctggatatatatacgtagccatgtgatgcaagtgtaagactacttttttcccagtatgtttctacataaataaaacaagtttg

SEQ ID NO: 2394 - DNA, 802 bp, Avena sativa
gtcgcgccctccacggggttcgaagtccactgctggccttcccgtccagccgccgcagcaacgccggccttggcagcgtcagcaacggtggaagaatccgatgcatgcaggtgcgggcctattgagggcatcaagaagttcgagaccctgtcttacctgccgccactctcagaggaggccctcctgaagcagatcgacttcttgatccgctccaagtggggttcccttgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaaccccaggcaatgcaaatgaggtttctgatttatgtgagggattctatctgtttctttttgatgttgtttggaatctggatatatatacgtagccatgtgatgcaagtgtaagacttacttttttttccctagtatgtttctacataaa

SEQ ID NO: 2395 - DNA, 587 bp, Avena sativa
ctgccaccactctcagaagaagccctcctgaagcagatcgacttcttgatccgctccaagtgggttccctcgcctggagttcagcaaggttggcttcatcttccgtgagcatggcagcactcccggatactacgacggcaggtactggacaatgtggaagctccccatgttcggatgcaccgacgcctcccaggtcatcaaggaggtggaggaggtcaagaaggagtaccctgacgcgtatgtccgcatcatcggcttcgacaacatccgtcaagtgcagtgcgtcagcttcatcgccttcaagccaccgggttgcgaggagtctggcaaggcctaagccacgagctgggaataaatgccttttctgagaatctgggaataactgcctatgcaaggcatgttactagttcactttttgttgatgactctcctttcggggttttacttcaggttccatacaattctgtatgtatgtactatgtttgggcgtaccaatctacgtaggtcgaggaacatgcatatgttgattgtataaccggctacacatacacatatatatttatatacaaaccacatactattgtctt

SEQ ID NO: 2396 - DNA, 801 bp, Avena sativa
ccgtgatggcttcgtcggccaccaccgtcgcgccctccagggcctcaagtccacagctggcctcccccgtccagccgtcgcagctccggaagcctcggcagcgtcagcaacggtggaagaatcagatgcatgcaggtgtggccgattgagggcatcaagaagttcgagaccctttcttacctgccaccactctcagaggaggccctcctgaagcagatcgacttcttgatccgctccaagtgggttccctgccctggacgttcagcaaggttggcttcatcttccgcgagcacggcagcacccccggatactacgacggcaggtactggacaatgtggaagctacccatgttcggctgcaccgacgcctcccaggtcatcaaggaggtggaggaggtcaagaaggagtaccctgacgcgtatgtccgcatcatcggcttcgacaacatccgtcaagtgcagtgcgtcagcttcatcgccttcaagccaccgggttgcgaggagtctggcaaggcctaagccacgagctgggaataaatgccttttctgagaatctgggaataactgcctatgcaaggcatgttagttcactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaaaccacgtactattgtcttcttgctagttgatggaaattttctttatttgctacc

SEQ ID NO: 2397 - DNA, 581 bp, Avena sativa
tcgagaccctttcttacttgccaccactctcagaggacggccctcctgaagcagatcgacttcttgatccgctccaagtgggttccatgcctggagttcagcaaggttggcttcatcttccgtgagcacggcagcactcccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacaacggccgcgctatatacttttgccgacgactctgctccaagggttttagttttaaaagcaatatgactgtgtatgtacgtatgcttgtatgtatgtacctatgaacctagggtgaagagctgaaatgtgaattctagaaccggctatatgtaaggacatacacatatatttttttccgaatgtgtttatatc

SEQ ID NO: 2398 - DNA, 638 bp, Triticum aestivum
ggtggaaggattaaggtgcatgcaggtgtggcccattgagggcattaagaagttcgagaccctgtcctacttgccaccgttcagcagggaggccttcttcaagcaggtggactacctgatccgctccaagtgggtgccttgcctcgagttcagcaaggttgggtttatcttccgtgagcacaacgcatcccctgggtatacgatggccggtactggacaatgtggaagctgcctatgttcgggtgcactgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtacaatctgtcgactatgta

SEQ ID NO: 2399 - DNA, 860 bp, Hordeum vulgare
ctccttggggcaagctatatacctacatagaacagccatggcccccaccatgatggcctcattggccacctccgtctctcctttccaggggctcaagtccaccgccggccttaccatgagtcgccgttccaacggagctatcctctgcagcgtaacctactgtgggaggatcaggtgcatgcaagtgtggcccatcgagggcattaacaatttccagaccctgtcttacttgccaccacatcagcacggaggccctccttaagcacgtcgactacctgatccgctccaagtgggtgccttgcctcgagttcatcaaggttgggttcatcttccgtgagcacaacgcatctcctgggtactacgatggccggtactggacaatgtggaagctgcctatgttctgatgcaccgacgccacacaggtgctcaacgaggtggaggaggtcaagaaggagtaccctgacgcgtatgtcctcatcatcggattcgacaacatgcgtcaggtgcagtgcgtcagcttcatcgccttcaagccaccaggctgcgaggagtccggcaaggcatacacagctcactggcgatgggccacatataaagtgccattgcagttttggcaactctgacattgtttgggggtttccttgctcaatatctttcttaattggtccctaaaaggtgggggtgcccatgttcatgtaccagctgggtcgaaaaaccagctcggtgtgaatgcttcggggggtttggtttgccatgccataatttttgcaatcgtcgcctttggaagaaaaaaaaaaaagacccgagggggggcccggcccccaatccccctatagggattgattatcaattaatggccg

SEQ ID NO: 2400 - DNA, 732 bp, Avena sativa
  misc_feature (222)..(222): n is a, c, g, or t
  misc_feature (231)..(231): n is a, c, g, or t
  misc_feature (234)..(234): n is a, c, g, or t
gtcagccgtcgcagctccggaagcctcggcagcgtcagcaacggtggaagaatcagatgcatgcaggtttggccgattgagggcatcaagaagttcgagaccctttcttacttgccaccactctcagaggaggcccttctgaagcagatcgacttcttgatccgctccaagtgggttccctgcctcgagttcagcaaggttggcttcatcttccgcgagcanggcagcacnccnggatactatgacggcaggtactggacaatgtggaagctgcccatgttcggctgcaccgacgcctcccaggtgatcaaggaggtcgaggaggtcaagaaggagtaccctgacgcctatgtccgcatcatcggcttcgacaacatccgtcaagtgcagtgcgtcagtttcatcgccttcaagccaccgggttgcgaggagtctggcaaggcataagttgtcagctgaaacaacggccgctatagaaacaacggccacactatatacttttgccgatgactctgctcgagggtttgttttgcaatcaatatgattgtgtatgtacgagtatgcttgtatgtatgtacctatcaacctagggtgaagagctcaaatgtgaattctagaaccggctacacataattaaggacatacacatatatattatttttgaatgtgtttatattccatccgcaagtgtgtttgatattaattgattggaatttatatttatttgtcctg

SEQ ID NO: 2401 - DNA, 870 bp, Hordeum vulgare
cagctcctattatctattaacgatggctcccactgatcatgtccaacaggctgccaccgccgtagcagcatatccaggactcaagcccacacgcggtctaccaatcagccacctcttcggcaacgcggctggcctctgcagtcggcgcaacggcggaagaatacagtgcaggcgaggatggcccatagaaggcatcaagaagttcgagactttgtcttacttgccaccgctctccacggaggcactcctgaagcacgtcgactacctgatccgctccaagtgggtgccttgtctcgagttcagcaaggttggattcatcttccgtgagcacaatgcctctccagggtattacgatggccgatactggacaatgtggaagctacctatgtttgggtgcaccgacgccacacaggtgttaaaccaagtgggcgaggtcaagaaggagtaccctgacgcctatgtccgcatcatcggattcgacaacatgcgtcaggtgcagtgcgtcagcttcatcgccttcaagccaccaggctgcgaggagtctggcaaggcctaaacaagctaactcccttttatcatacaaccatggaatgctgccaagctcatttatgtttcccttaaacttaaagacagctgtggatgcgagacactccctgcaacttgatttagcttgggttgaagtctacaggaagaagaaaaaagaaaaactcgtgggggggcccggagtgccaagggggccgtgagggagggggtgccaggagcctgggccgaggagggcacaggagaggccggggaaaccccggagagtccgaggttaaggaggtagagagcgtagcagcagaggtagctagaggagagtgaagatgaccg

SEQ ID NO: 2402 - DNA, 691 bp, Avena sativa
ccgcagcaacgccggcctcggcagcgtcagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcccaggtgatcaaggaggtggaggaggtgaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattatgtgcgtatatatgcttgtatttgtatgtatgtacctatcaacctagcgtgaagagctcaaatgtgaattctagaaccggctacacataaggacatacacatatatatattattttcgattgtgtttatatcgaatccgcaagtgtgtttgatattttaattgattggaat

SEQ ID NO: 2403 - DNA, 609 bp, Avena sativa
gcaatgccggcctcggcagcgtcagcaacggcggaaggatcaggtgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagtacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccaggctgcgaggagtccggaaaggcataagctgtgacctgggaataactgcctatgcaaggcatgtttgttcactttttgttgatgactctcctttcgtggttttacttcacgttccatgtaattgtgtatgtatgtatgctcgaatctatcaatatgttgactgtacaaccggctacacataaacatatattttatatacaaa

SEQ ID NO: 2404 - DNA, 610 bp, Avena sativa
ccgcagcaatgccggcctcggcagcgtcagcaacggcggaaggatcaggtgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagtacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccaggctgcgaggagtccggaaaggcataagctgtgacctgggaataactgcctatgcaaggcatgtttgttcactttttgttgatgactctcctttcgtggttttacttcacgttccatgtaattgtgtatgtatgtatgctcgaatctatcaatatgttgactgtacaaccggctacacataaacatatattttatata

SEQ ID NO: 2405 - DNA, 550 bp, Avena sativa
ttgccaccactctcagaggaggccctcctgaagcagatcgacttcttgatccgctccaagtgggttccctgcctcgagttcagcaaggttggcttcatcttccgcgagcacggcagcacccctggatactacgacggcaggtactggacaatgtggaagctgcccatgttcggctgcaccgacgcctcccaggtgatcaaggaggtggaggaggtcaagaaggagtaccctgacgcctatgtccgcatcattggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattatgtgcgtatatatgcctgtatttgtatgtatgtacctatcaaactagcgtgaagagctcaaatgtgaattctagaaccggctacacataaggacatacacatatatatattattttcgattgtgtttatatcg

SEQ ID NO: 2406 - DNA, 647 bp, Avena sativa
gatgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagcttcccatgttcggctgcaccgacgcctcacaggtgatcaaggaggtggaggaggtcaagaaggagtatcctgacgcctatgtccgcatcatcggcttcgacaacatccgtcaagtgcagtgcgtcagcttcatcgccttcaagccaccgggttgcgaggagtctggcaaggcctaagccacgagctgggagtaaccgccttttctgagaatctgggaatagccgcctatgcaaggcatgttagttcactttttgttgatgactctcctttcggtgttttacttcaggttccatacaattgtgtatgtatgtacctatgtttgggcgtacctatctacgtaggtcgaggaacatgcatatgttgattgtataaccggctacacatacacatatatatttatatacaaaccacatactattgtcttcttgcta

SEQ ID NO: 2407 - DNA, 793 bp, Avena sativa
ctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcatggcagcactcctggatactatgacggcaggtactggacaatgtggaagctgcccatgttcggctgcactgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaacccaggcaatgcaaatgaggtttctgatttatgtgagggattctatctgtttcttttttatgttgtttggaatctggatatatatacgtagccatgtgatgcaagtgtaagcctactttttttttccagtatgtttctacataaataaaacaagtttgagttttagaaaaaaaaa

SEQ ID NO: 2408 - DNA, 718 bp, Avena sativa
ctgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcaccccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctggcgaggagtctggcaaggcctaagccacgagctgggaataactgccttttctgaggatctgggaataactgcctatgcaaggcatgttagttcactttttgttgatgactctcctttcggtgtttacttcaggttccatacaattgtgtatgtatgtactatgtttgggtcgtacctatctacgtaggtcgaggaac

SEQ ID NO: 2409 - DNA, 833 bp, Hordeum vulgare
cccacgcatgctctttacatactacttgcagccgtctacatcaccatgatggccttagcagacatctacaaggatcgttgccagaggctcaaatccaccggcgaccttcccgtcagccaccgctccaacgagactagcctaggcagcgtcagcaacggtggaaggatcatgtgcatgcaggtgtggcccatcgagggcatcaagaagctcgagaccctgtattactagccaccactcaacacggaggccctccttaagcaggtcgactacctgatccgctccaagtgggtgccttgcctcgagttcatcaaggttgggttcatcttccgtgagcacaacgcatctcctgggtactacgatggccggcactggacaatgtggaagctgcctatgttcggatgcaccgacgccacacaggtgctcaacgaggtggaggaggtcaagaaggagtaccctgacgcgtatgtccgtatcatcggattcgacaacatgcgtcaggagcagtgcgtcagcttcatcggcttcaagccaccaggctgcgaggagtccggtaaggcataaacagctcactgacgatgggccacatataaagtgccattgcagctttgtaaactatgacattgatttggggtttccttatacaatatctttcttattcgtacctaaaaatgtgagtatgcgcatgtacaaggaccaacatggctagaaaaagcatgctcgaatgttaaatgcctaccggggctatgtataatgcacatgcccatagttttattccatcttggcagccttcgttaactaatacggcggaatgtcccaatgtccgtaatagaccc

SEQ ID NO: 2410 - DNA, 564 bp, Avena sativa
gtcttccgcgagcacggcagcacccccgggtactacgacggcaggtactggacaatgtggaagctgcccatgttcggctgcaccgacgcctcacaggtcatcaaggaggtggaggaggtcaagaaggagtaccctgacgcatatgtccgcatcatcggcttcgacaacatccgtcaagtgcagtgcgtcagcttcatcgccttcaagccaccgggttgcgaggagtccggaaaggcctaagccgtgagatgggaataacagatgctatatgaaagtgccttgtacaaatttgaggtcgacaattctgattttgaggttttacttctggttccatatatataataggtcgatcaacaatcgcaggcttgggtaagtctgttcctttttagattgtcttcattgattgaaccccggcaatgctgcaaatgaggtttcagatttatgcgagggattctatctgtttgttgttgatgttgtttggaatctgcataaatgtgacgcaagtgtaaggctacttttgtgagtatatgtttcaacataagtaaatactagaacaagtttgag

SEQ ID NO: 2411 - DNA, 415 bp, Hordeum vulgare
gcctcggcagcgtcagcaacggtggaaggatcaggtgcgtgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcagatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccgg

SEQ ID NO: 2412 - DNA, 676 bp, Avena sativa
cctcctgaagcagatcgacttcttgatccgctccaagtgggtcccctgcctggagttcagcaaggttggcttcatcttccgcgagcacggcagcaccccccgggtactacgacggcaggtactggacaatgtggaagctgcccatgttcggctgcaccgacgcctcacaggtcatcaaggaggtggaggaggtgaagaaggagtaccctgacgcctatgtccgcatcattggcttcgacaacatccgtcaagtgcagtgcgtcagcttcatcgccttcaagccaccgggttgcgaggaatccggcaaggcctaagccacgagctgcgaataacagatgctgtatgaagtgtcttgttcaaatttgtcgacaattctgattttggggttttacttctggttccatataaatatgtatgcgtgtacgtatgtatgtatgtacatacgaacctaggtcgatatgaacactcgcaggcttgagaaagtctgttccttctttagattgtcttcgttgattaagattaacccacgcaacacaaatgaggtttctgatttatacgagtgattctatacgtttaccggtgatgttgtttggaatctggatacgtatgcatgttatccaagtgtaagtttactcttttttcagtgtgttgcaatataaatagaacaagtttgtgc

SEQ ID NO: 2413 - DNA, 615 bp, Triticum aestivum
  misc_feature (21)..(21): n is a, c, g, or t
  misc_feature (38)..(38): n is a, c, g, or t
  misc_feature (99)..(99): n is a, c, g, or t
  misc_feature (101)..(101): n is a, c, g, or t
  misc_feature (117)..(117): n is a, c, g, or t
  misc_feature (136)..(136): n is a, c, g, or t
  misc_feature (141)..(141): n is a, c, g, or t
gcaatgggatagagttggacnttttcttccacctttcnaggggcctctaaacggtgatacctaaccgtcaagtggtccttcctgattagcaagttgttngnttccgtggcaaacagntccccggtatagacggcgntactngacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaaggcctaaactacgagttgaaacaatggcctatctcgtatgaaggtcttttgtgaacttcacttttgtccaaaactctgctgtacgactctgctttctgaccggagcataccttttgttctatatgattttgtgtatgtatgtacgaacataggttcttgagcatgcatacgtaattcctcataggtctatatcttcttcttcggcacaacccccgaatacatcaatggacgagatctgtctataccttttcataataaagagtaggatggtctttcaagaaaaaaaaaaaa

SEQ ID NO: 2414 - DNA, 657 bp, Triticum aestivum
  misc_feature (43)..(43): n is a, c, g, or t
  misc_feature (197)..(197): n is a, c, g, or t
  misc_feature (385)..(385): n is a, c, g, or t
atagcctgggaagcgtaagcaacgtggaagaatcaggtgcaanaaagtgtgggcccatagaaggcatcaaagaaggtcgagacccctgtctaactggccaccgctcaagcacggaagcccctcctcaagcaggtggaactacctgatccgctccaaagtggtggcctgccctcgagttcagcaaaggtggggtaatnttccgtgagcacaacgcatcccctgggtatatgatggccggtactggacaatgtggaagctgcctatgttcgggtgcaccgacgccacacaagtgatcaacgaggtggaggaggtcaagaaggagtaccctgacgcgtatgtccgcatcatcggattggacaacatgcgccaggtgcagtgcgtcagntttatcgccttcaagccaccgggctgcgaggagtccggcaaggcctaaacagctcactcacgacaggcaaaaaataaagtgccattgcagttttgtcaaatctgacattgctttgggttttccttccccaataatctttctaaattgttccaaagaaaaagtgaaagtccatgttaatgtaccaacatggctcgagaaagaaagctcgtatgagaatgcaatcgggggcaaagaaaatgaacggacgcataatattatacaaaatgtcgaca

SEQ ID NO: 2415 - DNA, 403 bp, Triticum aestivum
  misc_feature (189)..(189): n is a, c, g, or t
  misc_feature (242)..(242): n is a, c, g, or t
  misc_feature (377)..(377): n is a, c, g, or t
ggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgtacgaaaggtnggaggaggtcaagaaggagtaccctgacgcgtatgtccgcatcatcggattcnacaacatgcgccaggtgcagtgcgtcagcttcatccgccttcaaagccaccgggctgcgaaggagtcccggcaaggcctaaacagtcactcaacgacaggcatatataaagtgccattgcattttgtcaactccnacattgcttgggttttccttccccat

SEQ ID NO: 2416 - DNA, 1030 bp, Triticum aestivum
cccctttttttgggcaccactaagagaaccaggtgtttgcccaaaaaaccggcctgggttcccggtcccggatttcccccgaaatttttttaccacaccccttcccccggtttggggcccgcagggacccctaccctggggtttaaagggtttgaaaaaacccaaagtccccccctccttgcccaggtttaatcccttccttagtaccccccctggcccccccccgtggtggcttttttgggccacctcccttggtccttttccagggggttaagtccaccgccgggcttccccgtcaagccccggttccaaggggggtatacctcgggagggttaacaccggtggaaggatcaggtgcatccaggtgtggcccatcgagggcatcaaaaagtttgagaccctgtcttacctgccaccgctcagcgcggaggccctcctcaagcaggtcgactacctgatccgctccaagtgggtgcctttcctcgagttcagcaaggttgggttcatcttccgtgagcacaacgcatttcctgggtaatacgatggccggtattggacaatgtggaaactgcctatgttcgggtgccctgaccccacacaggtgttcaacgaggtggaggaggtcaagaaggagtaccctgacgcgtatgtccgcatcatcggattcgacaacatgcgtcaggtccagtgcgtcaggtttattgccttcaaacccccgggctgcgaggagtccggcaaggccttaacagctccctcacgacaggccatatataaagtgccattgcagttttatccaccccccccttgctttgggttttccttctccatttatcttttttatttgttcctaagaaaatgtgtatgtccatgttcatgtaccaacatggctcgagaaagcatgctcgtatgtgaatgctatcggtggctatgtatatgcccggacgcataatattatacaatatgtcccccatatacgttttaatggtaaccaatgggcccctcccccagaaacccaaaataccaaaggga

SEQ ID NO: 2417 - DNA, 1047 bp, Triticum aestivum
cgctcgacacgccggtctttttgccagtgggcctggggacggtttcaaacttgccacggggggttcccgctttgccccgctgggccttttttgggggcgcccaatccaaccagtttgtcccaaaaagaacggcgtgtttccggtccggatttccccgggtttttggtcgacccatggtgcgggggctgggccccgaggcccctgacgtggattgaaggaggtggtttaagcccagattcccccctcctagcaggtttaaacctacatagtccagcctgcgcccccaccgtgatggcctcgtcggccacctcggtcgatcctttgccagggggttaagtccacccccgccgtcccgtccatcagccgctgcaacggcgctagcatcggcagggtcagcaacggtggaaggataaggtgcatgcaggtgtggcccactgagggcatcaagaagttggggaccctgtccgacttgccaccgctcagcacggaggccctcctcaagcagatcgactacctgatccgctccaagtggttgccctgcctcgagttcagcaaggttgggttcatcttccgcgagcacaacgcatcccctgggtactatgatggccgctactggacaatgtggaatctgcatatgttcgggtgcaccgacgccacacaagtgatcaacgaggtggaggaggtcaagaaggagtaccctgacgcgtatgtccgcatcatcggattggacaacatgcgccaggtgcagtgcgtcagcttcatcgccttcaagccaccgggctgcgaggagtacggcaccgcctataccgctcactcacgacaggccatatataaagtgccattgcagtttggtcaactctgacattgctttgggttttccttctccatttatctttcttatttgctcctaaggatatgtgtatgtccatgttcatgtaccaacatggctcgagtaagcatgctcgtatgagaatgctatcggtggctatgtatatgaacggccgcctaatattatacaaaatttcgacggtatacgttttaatgtta

SEQ ID NO: 2418 - DNA, 487 bp, Triticum aestivum
  misc_feature (44)..(44): n is a, c, g, or t
  misc_feature (54)..(54): n is a, c, g, or t
  misc_feature (59)..(59): n is a, c, g, or t
gagttcagcaaggttggttcatcttccgtgagcacaacgcatcncttggtatangatgnccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcgactatata

SEQ ID NO: 2419 - DNA, 1064 bp, Triticum aestivum
tcaccccccgggttattccctaggccccggggggtaacccttttccccccagaccgcgttttgcccttgggcctttttggggccccattgacaccttttttcccaaaaacaggggggttccggcccggatttcccgggaaatgtctctccccacgttcccgctttgggcactggagaccttaactggattgaggggttaaaaaaaccccggggcccccctcctgccaagcttaccctcattgggcccccctgggcccccccctgggtggcctgttgggccccctccttggtccctttccgggggttcaaatcctccgcgggcctccccgtcaaccccggtgcacgaggagttaaccttggaagggtaagcaacgggggaaggatcaggtgcatacaggtgtggcccctcgagggcatcaaaaattttagaccctgttttacctccccccgctcagcacggaggccctcctcaaccaggttgattacctgatcccctccaagtgggtgccttgcctcgggttcaccaaggttgggttcattttccgtgggcacaacgcatttcctgggtaatacgatggccggtattggacaatttggaacctgcctatgttcgggtgccctgaccccacccaggtgatcaacgaggtggaggaggtcaagaaggagtaccctgacgcgtatgtccgcatcatcggatttgacaacatgcgtcaggtgcagtgcgtcagctttatcgccttcaaacccccgggctgcgaggagtccggcaaggcctaaacagctcactcccgacaggccatatataaagtgccattgcaattttgtcccccccgccccccctttgggttttccttctccatttatcttttttatttgttcctaagaaaatgtgtatgtccatgttcatgtaccaacatggctcgagaaagcatgctcgtatgtgaatgctatcggtggctatgtatatgcccggacgcataatattatacaatatgtccccctcatacgttttaatggtaacccatgggaaacacccccaaaaaaaaaccaattaccaaaggaga

SEQ ID NO: 2420 - DNA, 879 bp, Hordeum vulgare
atgaaactggcgactccaccgcctgggcgtgccactttatagctaccaaataccccggctgaattacatgtgtccaagcatgcggggggggggtgagtacatctatagacaccacctatgatggcctcgatagccacctgatgagacctatccaggggctcaagatacaccatctgtctccccgtcaaccaccgatcaaacggtgctagcctctgcatcttcagcaaccgtggaacgatcaggtgcgggcaggtgtggcccatcaagggcatcaacaacttctagaccctgtcttacttgccaccactcaacacggaggccctccttaagcaggtcgactacctgatccgctccaagtgggtgccttgcctccagttcagcaaggttgggttcatcttccgtgagcacaacgcatatgctgggtactaccatggccggtactggacaatgtggaagctgcctatgttcagatgcaccgacgccacacatgtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtactggcatgcataaacagctcactgacgatgggccacatataaagtgccattgcagctttgtcaactctgacattgcttatgggttttcctcctccatttatcatttcatatttgctcctaagaatatgtcgaatgtccatgttcatgtacccacatggctccagaagacatgctagaatgtgaatgctggcgggggctatgtatattcaccttcccattatattatacaatatatggcaactttatacgtttaaatggt

SEQ ID NO: 2421 - DNA, 611 bp, Hordeum vulgare
gagggctgcttcgagaaatgtgcctccccgggctgaggattgtgccaaatgctgaacgagccggcctccccgtcagtcgccgctcgaacggtgctagcctcggcagcgttagcatcggtggaaggatcaggtgcatgcaggtgtcccccatcgagggcatcaagaagttcgagaccctgtcttacttgccaccactcagcacggaggccctccttaagcaggtcgactacctgatccgctccaagagggtgccttgccttgagttcaacaaggttgggttcatcttacgtgagcacaacgcatctcctgggtactacgatggccggaactggacaatgtgtaagctgcctatgttcggatgcaccgacgccacacaggtgcttaacgaggtggaggaggtcaagaaggagtaccctgacgcgtatgtccgcattataggattcggcaacatgcgttaggtgcagtgcgtcaacttcattgcctttaaaccaccaggctgttagggagtcggcaaggcataaactgctcactgacgatgggccacattataagtggcattggagttttgtcaactctgaaattggtttgggttttgcgttttcaattatgtg

SEQ ID NO: 2422 - DNA, 482 bp, Lolium multiflorum
gacggcaggtactggacaatgtggaagctgcccatgttcggctgcactgacgccgcccaggtcctcaaggaggtggatgaggtcaagaaggagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggccgctatatatatatacttttgccgaagactcggtttattttgcatttaatgtgattgtgtttgcacgtattcaagtatgtatttgcctaccgacctaggaagagctgtgatatgtgaattctagaaccggctacatgtaaaagcatacacatacacatataatattatatattatttccgagtgtatttatatccaattcgcctattcagtttttggatgtgaatatctatcatttgcattgttgataaaaaaaaaa

SEQ ID NO: 2423 - DNA, 746 bp, Triticum aestivum
gtcgcaccgaccacgaaagcctacaattttgtgctcaactcgtgcccgacagtggtgtcgatggcccgtgaattgggcccttcgctaccgttgtcggcggcgaagttggtgaggaagctcaattctacatctccatggccggcagaagctgaggtggtgcaggagcttctggcagcctcgtcagtgttgaacaaggcgatggtttggtcagaaactgaggtgaagctgaacctacatgggttcagtataacttcagcctatgtgctgatgctgcagtgggtggacgcggtgaaaggggaccgcacattgccattggaagtgtctgtcgtttgtggtgtcgggaagcacagcgatgtccggggtgagcccaaagtgcgggagctggcacaagaggttctgagccggatggggagccctctgcggctgtccgcaaggaacaaaggccggctcgtggcgaagcgagacagggtgaaacaatggctggccactgagtggacttccatggtgcctgaggagagcacggatcagtcacccaattcaagtgatcagcaacaatttttgcccaatcttttaagaaaactcgggcagtttttttcctcatttgtgccagtttccagatgaatggcaagctgtttattgtagagtaggaggttccgaataggcataatatcttccttatgttgtagactgatacaagatgggtgttgtgtgaatgctggaaaaaatagtcatctcttttctaaaaa

SEQ ID NO: 2424 - DNA, 746 bp, Triticum aestivum
gtcgcaccgaccacgaaagcctacaattttgtgctcaactcgtgcccgacagtggtgtcgatggcccgtgaattgggcccttcgctaccgttgtcggcggcgaagttggtgaggaagctcaattctacatctccatggccggcagaagctgaggtggtgcaggagcttctggcagcctcgtcagtgttgaacaaggcgatggtttggtcagaaactgaggtgaagctgaacctacatgggttcagtataacttcagcctatgtgctgatgctgcagtgggtggacgcggtgaaaggggaccgcacattgccattggaagtgtctgtggtgtgcggcgtcgggaagcacagcaatgtccggggcgagcccaaagtgcgggagctggcacaagaggttctgagccggatggggagccctctgcggctgtccgtgaggaacaaaggccggctcgtggcgaagcgagacagggtgaaacaatggctggccactgagtggacttccatggtgcctgaggagagcacggatcagtcacccaattcaagtgatcagcaacaatttttgcccaatcttttaagaaaactcgggcagtttttttcctcatttgtgccagtttccagatgaatggcaagctgtttattgtagagtaggaggttccgaataggcataatatcttccttatgttgtagactgatacaagatgggtgttgtgtgaatgctggaaaaaatagtcatctcttttctaaaaa

SEQ ID NO: 2425 - DNA, 2167 bp, Brachypodium distachyon
ggcggccccaactcccaagcccaagcagcaaaatgccggcggcgacgtcgctcccggcacgggcaccggcgccgtcagcggcgcggcgcaggaggtcctcccgcgcggcggtggtttcggcgtcgtcgtcgctgcgccgggccgcgtcgggcgggggctcgagctggcggagcgagcggcggctcatgtcggagctggaccgcacggtgacgtccggcgcggcggagcgcgtcatccgcggctacgtcggcacaaaatccgagcgcgccgccctcgccgcgctctcccgcctcctcatcgactccgaccccctcgccattcccgtgagcccccttcaatttcatctcgaaccctgttcctcgccgggggggaatttattcaaatctcgattgcagttctacgaggcggtgacgcaggcgcggtggttcaagtggagctcgatccacgcggcgggggtcgcggcgctgctcgaagccacaggcggcgcggaggagtccagatccctcgtcgccggctccgccgcgcgcctccagtgcccctccgaggtcgccctcttctactgcgacctcatggccgccttctcctcccgcgggctcaatcgccgggccatggatttctacgcgcagctccgggcgatgcctccgccggcgctctccgggtctggcgccggcggcggcggcggtggcaggatctacatggccatgatcaagtccctgtgcctcatgggcctcgccgccgaggccgaggaggcgctcagggagatggtctctctggggcacaagcctgatgcgtttcagtttggattggtggcgaaatgctatgggaaggcagggcagttggctgagatggagagggtgattgcgtccatgtcggacgctggtatccggctcggcactggcgcggccaacattgtcctctcatgctacagcgcgtgccgtgatcatggcaagatgctaatgtggctgaagaggatgaggaagctgcgcattgcgccgactacaaaagcctacaattttgtgctcaactcgtgcacgacggtggttaagatggctcgagaattggggccctcgctcccgttgtcatcggcgcagctggtgaagaagctcaggtctggatctccatggccggcagaagctgatgttgtgcaggagcttctggcagcctcgtcggtgctggacaaggcgatgaattggtcagaaaatgaggtgaagctgaacctgcatgggttcagtgtaacttcagcctatgtgctgatgctgcagtgggtggacgcgattaaggggggccgtgcattgccattggaggtttctgtggtgtgcggcgtcgggaagcacagcgatgtccgtggcgaacccaaagtgcgggagctggcgcaagaggttctgagccggacggggagccccctgcggctgtctgcaaggaacaaaggccggcttgtggcgaaacgagacagagtgaagcaatggctgaccactgagtggacttctccgttgcttgaggagagcaccgatcaatcgtccagtacgagtgatcagcaaccatttttaccaaagcttttgagaaaactcggacagatgttttcctcttttgtgtcagtttctagatgaatggcgaaatgttctttgtaatttaggcagctcagacttcagaataggcatactgaatgatacaaaaatgccttctaatcctagttctgatggtgaatgaaatgttatgcctcaatcagctgcttgaaggtgattgcaccggtgaaccgtgcaggaggtcccagaagaggaactttctgtgatcgctgcagtatctggagttgggggtgcaaccttcctcggcattgaacttgccaccaccacagcacgccacctcagcatacactccttcacctctgtaaaccctgcatctaacaaagtgagcaaggttgcagatattccagaaaaagagatggccatattgcatacttagtacaggctattaatgctcgtgtaaagttgttgcaatttacctagtgatgaaaatacgagtactagggtttagagttatgcctttttccttgtgattatgttgccaggcagaaattgtgccagaacagctgatggaaaaaagtagtgcatatatacttatatagtggtcatcaacaaacctgaagcaatgaatctcaagctcattggtg

SEQ ID NO: 2426 - DNA, 2530 bp, Gossypium hirsutum
aagacaataacacatcagcagggcagattgagcttgtgaatgattggaaaaatgttttcaatcgtgctactgttgttgtcttcccaaactatgcgcttccgatgatctattctacatttgatactggaaattattatgttattcctggttctcctgctgatgcatggaaaggagagaatgcaatgtatttgtacaaagataatcagcgtgcgagtatgggctatggacctaatgaagtgcttattgcaattgttggaagtcaatttatgtacagaggcttgtggttggagcatgcacttattttacaggctttattgccgctctttgccgacttttcttctgataatgattctatttcccaccctaaaatcattgttttaagcagtgattcagcaagcaactacagcatggctgttgagaaaattgctcttaacttaagatatcccagtggggtggtgaagcatgtagctgttcatggagatgttgatggcgttctgagcatgactgaccttgtgatatatggctcgtttcttgaggagccttcatttccagaaattttgataaaagccatgagccatgggaaaccgatcgtagcaccagatctctccagtataaggaaatatgtagataacagggtaaacggttatcttttccctaaggagaatattagtgttctgacacagatcatattgcaaatgatatccaaagggaaattgtcaccattggctctaaacattgcttcgattgggagaggaactgttaaaaatatgatggttcaggaaactattgaaggatatgcgatgctactggaaaatgttctcaagtttccatcagaagttgcacctcctaaggctgttatagaacttccttcaaagttgaaggaagaatggcaatggaatctatttgtgaatcttcagaattctacacttgaagacaagagttccaaatttttaaacaatttagaggaacagtggaaccattctcaaagaaagaagtttggttcgccagttgctatgaatgattcattttcatatgagatttgggaggaagaaaaagatgcatattttcatactaaaaggagacgagaggaacaagagttgaaagatagaactgatcaatctcgtggcacctgggaggatgtatatcgaaatgccaagagggctgatcatgcaaggaatgacctgcatgaaagggatgagagggaacttgaaaggactggtcaaccattgtgtatctatgaaccttactttggtgaaggaacatggcctttcctgcaccgaagttctctttatcgtggaattggactgtccaccaaaggtcgaagacccaggatggatgatgttgatggaccatctcgtttggagcttcttagaaactcctactaccgagatattcttggtgaatatggagcctttttgcaattgctaaccggattgaccacctacacaggaatgcctggatagggtttcagtcatggagagcaacggctaggaaggcatccttgtctgaagttgctgagacatcattgttaggcgccattgaaaagcgtaagtatggtgatgctctgtacttttgggttcggatggataaggatcctagaaacagcttgcagcaggacttttggtcattttgtgatgctataaatgctggaaattgcaagtttgcattctctgagactcttaaaaagatatatggcataaggaccgaattgaattctttgccacccatgcctgaagatggaggcacatggtctgtcatgcagagttgggctttgccgacaaagtcctttctcgagtttgtcatgttttcaaggatgtttgtggatgcattagatgcacagatgtatgatgagcaccatcaaagtggtcactgttatctaagtttctcaaaggacaagcattgctactcaaggatgctcgagctacttataaatgtttgggcataccacagtgcacgacggatggtgtatgtgaatcctgagagcggtgtgatgcaagaataccacatattcaaagatcggagaggtaaaatgtgggtgaaatggtttgccttgaacactttaaaggcgatggatgaggatttggcggaggaggcagattcagaccactcaaagagaagatggatatggccatcgacaggggaggttgtgtggcaaggcgtactggatcgagagaggaacatacgcaaccgtcagaaagagaaaaggaagcagaaaagcaaggataaacaagagcggatgaggcataaacaccgtcaaaaggccttaggtaagtatgtgaaaccccttccagaagaagatatggaaatttcaaattcaacattattaacatctaactagcttcatcagtgtgtgttttgcagccaatccatgctagtagaatctttaatttttattttttgctagaaaggatgtgcattatttgtgtacattgttaagtttttttttttttaatttttatgtaaagctaacggcatacctctggtcattgatgtttatgaatggctcaaattgtatttggtggagattata

SEQ ID NO: 2427 - DNA, 3309 bp, Manihot esculenta
aggacgaatccgctttggcttcttgaccttccattgccgcccccaccctctctctctctctctctcagtctctctctattactcaactcaactcaactcaactcacaactgtgttcgtgctcgtgggtttgtcttgttttgcttttctttttcatgttatctgcatgtaattgtagtccattttggagctaattgatgagtctctagatgggttctctggagactgcgcttccattgaagagggagagtcttcttcgctcttcttcagctggtagaaccgagagatatcccttttctcagagacccagatcgagattttcccgcttcttgctgttcaggaagctagattacctgcaatggatttgcacggtggctgtatttctcttcgttgtgatttcttttcagatgtttttgcctggttctgtgattgagaaatcacaggattcgtggaaagagttggacatggtatctggggatttgctgtctttgaaggagacggggactttggattttggagaagacatcaaattcgagccttcaaagcttatagagaaatttgaaaaggaagctagagatgtcaataatctgtcatttaatttcagtgtaacacaacgtcgtttcgggtataagaagccccagctcgctctggtcttcgccgatctgttagtggatccacagcagctgctgatggtgactgttgcaacagcattgcaggagattggttatataacccaggttttttcaattgaagatggtcctgcgcatgaaatatggaagagcataggagtcccggtcaccattttccagagcaagcacaggatggagattgcggttgattggctgatgtatgatggtatacttgtgagctcattggaaaccaaggttgttttgtcatgttttatgcaggaacctttcaagtccttacctcttatatggaccattcatgaaaaagcacttgctgttcgttcaagaaaatacactgaaaatgggcaaattgagcttgcgaatgactggaaaagagtttttaaccgtgctactgtagtcgtcttcccaaatcatgttctgccgatgatgtactcttcatttgatgctggaaattattatgttattccgggttctcctgctcaagcatgggaagcagatgctttggtggcattatacaaagataatgtgcgtgtgaaaatgggttatgggcctgatgatattatcattacaattgtaggaagtcagtttctgtacaggggtttgtggctggagcatgcactcattttgcaggctctgttaccgcttttttccaagttcccttttgatgataattcaatttctcgtctcaaaatcattgttttaagcgggaattcaaccagtaattacactatggctgttgaggcaattgctgttaacttacattatccaagaggtgctgtgaagcacatagctattgatgaggatgaaggcagcgtgctaagtgcatctgatattgtggtatatgggtccttccacgaggagcaatcttttcctgaaattttgataaaagccatgtgcattgggaaacccatcgtagcaccagatctccacatgatcaggaaatacgttgatgacagggtgaatggctttcttttccctagggagaaaatcagggttctaacacatattatcttgcaattgattttaaatggaaagttatcacccgtagctcgcaacattgcttcagtaggaaaaggtaccgctagaaacctgatggttgcagaaactgttgaaggctatgcttctctgcttgaaaaaattatcaggctcccttcagaagttgctcttcctgaagcttttgtggaaattccatccaaattgaaagaagaatggcgctggcatctatttggagcattttcaaaatcggcatatgaagagagaactttgagaatttccagatccttagacaagattgaggagcagtggaaccgtacacaaagagagagctctcgttctatcacttctattgatgaatcattcttgtatgacatctggaaagaagagaaagacaatgagatccttaatgcaagaaagagaagagaggaagaagagctaaaagatcgaagtgatcaacctcatggtacatgggaggaagcatatcgaggtgccaaaagggctgatagatctagaaatgatttgcatgaaagggatgaaggtgaacttgagaggacaggtcagccattgtgcatttatgaaccatactttggggaagggacctggtcttttcttcaccatagttcactgtatcgtggagtggggttgtcttcaaagggtagaagacctagggcagatgacgtcgatgcaccttctcgtctaccacttcttaataatccttactatagggacgcccttggtgaatatggagctttttttgcaattgcaaatcgaattgaccgagttcacaagaatgcttggatagggtttcaatcttggagggcaactgcaaggaaggcttctttatctcggactgctgaattggcattattagatgctattcaaacacaaaggcatggggatgcactctacttttgggttcgcatggacatggatccaagaaaccagttgcaacaagatttttggtcgttttgcaatgctattaatgctggcaattgcaagtctgcattttctgaggcattcagaaggatgtatggtgttgagcaagatttggattatttaccaccaatgcctgatgatggggatacatggtctgtcatgctgagttgggctttgccaacaaggtccttcctagagtttgtaatgttctcaagaatgtttgtagatgcattggatgcacaaatgtatgatgagcaccatcagagcgggcattgttatctgagtttatcaaaggataagcagtgctactcacgagtcctcgagctgctcataaatgtctgggcataccacagtgcaaggcagatggtgtatgtgaaccctgagactggtttgatgcaagagcagcacaaaataaagagcaggagaggcaaaatgtgggtcaaatggttctcatacaccacactaaagagcatggacgaagacttggctgaagaggcagattctgaccaaccaaagagaagatggttatggcctaatacaggagaagttgtctggcaaggtgtgtttgagaaagagaggagtctccggaatcagcagaaggagaagaggaggcaacaaagcaaagacaaactaaacaggatgaggagaaaacatcgtcagaaggtaatagggaaatatgtaaagcccccaccagaagacatagaaaattcaaactcaacaatgttaatgtga

SEQ ID NO: 2428 - DNA, 3643 bp, Populus trichocarpa
ctactttgccctgcgtgtatattttctctttcaacatcgattagcttatctgcatgtcgctctacagaggaggcaaagagttgaatttttttatggaactctaaatgggttcattagagacgggaggaatctccttcaaaagagacaaaaacactctcattcgttcttattcagctggtagaactgaaagacacccctttttgtatagacccagatcaagtttttctcgtttcttgcgtttcaagaagttagattacattcaatggatttgtactgttgctgtttttctcttctttgtagttctctttcagatgtttttgcctggttctgtggttgagaaatctgaactaggttcttctccatggagaggaatggaattggttgataaggatttgtggtatctgaaggagattggtgggttagattttggtgaagatattaagtttcaaccttcgaagatattacaacattttcgaaaagaaaatagagagatgaatatgtcatttagtaacaggacattaagtcgttttccttataggaaaccccagcttgcattggtatttgcggatctgttggttgatccacaccagctgttaatggtgactgttgctactgcattgcaagagattggctacacaattcatgtttattcactaggagatggtcctgcgcaaagcatttggaagagcatgagatctccagttaacatcatccaaatcagccacaaaatggagattgctgttgattggctaaactatgatggcatacttgtgaattctctagaaacgaagagtgtcttctcttgttttatgcaggaacctttcaagtctgtgcctcttatatggaccatcaatgaaagaacactcgctactcattcaagacagtacacttcaagttggcaaattgagcttctgtatgattggagaaaagctttcaaccgggctacagtagttgtcttcccaaatcatgtccttccgatgatgtactctgcatttgacactggaaactattatgttattcctggttctcctgctgatatatgggaaacagaaactacaatggcattgtataatgatgaaatacatgtgaagatgggctatgaacccgatgacattgtcattgcaattgtgggaagtcaatttttgtacaggggtttgtggctggagcatgcacttgttttgaaggctctattgccactttttgcagaattttcattagataataattcaaaatctcatctcaaaatcattattttaagtggggatcctactggcaactacagtgtggctgttgaggctattgctgctaacttgagttatccaagaggtactgtaaagcactttgctgttgatgatgatgtgggcagtcccctcggtgcagctgatcttgtgatatatggatccttccttgaggagcagtcttttcctgaaattttggtgaaagccatgtccattggaaaacccatcataaccccagatctctccatgatcaggaaatatgttgatgacagggtgaatggctatctttttcctaaggaaaacctcaaggttctaacacagattgtattgcaagcgatctccaaagggacattatcacctctggctcgtaatatcgcgtcaatgggaaaaaatactgctaaaaacctcatggttctagaaaccgttgaaggctatgctacactacttgaaaatgttgttgagcttccatcagaagtcacacctcctaaggctgtttcagaaattcctccaaaactgaaaaaagagtggtgctggcatctatttaaagcatttatgaattctacgcatgaagacagaactttgaaaagttccagatatttaaaaacagttgaggagcagtggaactatatgcaaaaagagagctctggttccatagctgctactaatgattcattctcatatgacatttgggaggaagagagaaatattatgatgctcaatactagaaagagaagagaggaagaagagctaaaagatagaactgatcaacctcatggaacatgggaggatgtgtataaaagtgccaaaagggctgatcgttccaggaatgatttacatgaaagggatgaaggagaacttttgaggacagggcaaccattatgcatttatgaaccgtattttggggaaggaacctggtcttttcttcaccaaagttcgctttatcgtggaataggattgtccacaaaaggtcgaaggcccaggacagatgacatcgatgccccctcccgtctatcacttcttagcaagccatactaccgagatgccctaggtgaatatggagctttttttgcaatcgcaaatcggattgaccgtattcataagaattcttggatagggtttcaatcttggagagcaacggcaaggaaggcatctttgtctaggattgctgaaaaggcattggtagatgctatagaatcacgaaagcatggggactcactttacttttgggttcgcatggacatggatccaagaaacgacttacagagcgacttttggtcattctgtgatgctataaacgctggaaattgcaagttagctttttctgaggctcttaagaggatgtatggcatcaagcatgatttggaatttttgccacccatgcctgaagatggggatacatggtctgtcatgctgagttttgctttgccaacaaggtccttcctagagtttgtaatgttttcaagaatgtttgtggacgcactggatgcacagatgtatgatgagcaccatcaaagtggacgatgttatctgagtctagctaaggataagcattgctactcacgggttcttgagctgcttataaatgtctgggcataccacagtgcaaggcagatggtgtacgtgaaccctgagactggcttgatgcaagagcagcatgcagtcaagagtcgcagaggcaatatttgggtcaaatggttctcatacagcatccttaagagcatggatgaggacttggctgaagaggcagattctgatcagcccaagagaagatggttatggccatcaacaggcgaggttgtatggcaaggattatttgagaaagagagaaatctgcggaatcatcagaaagagaagaggagacagcaaagcaaggacaaacaacaaagaatgaggaaaaaacgccgtcaaccagtgctggggaaatatgtgaagcccccaccggaggacatagaaaattcaaactctacggtgtccatgtcggaatctttgtagcattaagttcaggctgggcagcattggaggtagggtctagtttgatcattcttttattgttgatttttcctcttcagttcatttatttggcagataggatgcatgcttttgtatcttttatacgaaggggtttgtatgtaagtagctgcatcctacgtcgttagtgttgttgatgagtgtgtatactaattttcccttttcttttcattctctccacaccccattgtagaggttgttgcgttcatgacagaaaaacgagggagaaattgtaatttccagatttctctttagaatttccgacatttaccatggccctgattgccagttatagaactgttccgatccatactgaagacgagagaagcctgttggtttctttttttcttgcaagacaaatagtgtaatttaaattc

SEQ ID NO: 2429 - DNA, 3263 bp, Populus trichocarpa
ctactttgccctgcgtgtatattttctctttcaacatcgattagcttatctgcatgtcgctctacagaggaggcaaagagttgaaattttttatggaactctaaatgggttcattagagacgggaggaatctccttcaaaagagacaaaaacactctcattcgttcttattcagctggtagaactgaaagacacccctttttgtatagacccagatcaagtttttctcgtttcttgcgtttcaagaagttagattacattcaatggatttgtactgttgctgtttttctcttctttgtagttctctttcagatgtttttgcctggttctgtggttgagaaatctgaactaggttcttctccatggagaggaatggaattggttgataaggatttgtggtatctgaaggagattggtgggttagattttggtgaagatattaagtttcaaccttcgaagatattacaacattttcgaaaagaaaatagagagatgaatatgtcatttagtaacaggacattaagtcgttttccttataggaaaccccagcttgcattggtatttgcggatctgttggttgatccacaccagctgttaatggtgactgttgctactgcattgcaagagattggctacacaattcatgtatgtattttggtacttgaattgttatgccgagtttattcactaggagatggtcctgcgcaaagcatttggaagagcatgagatctccagttaacatcatccaaatcagccacaaaatggagattgctgttgattggctaaactatgatggcatacttgtgaattctctagaaacgaagagtgtcttctcttgttttatgcaggaacctttcaagtctgtgcctcttatatggaccatcaatgaaagaacactcgctactcattcaagacagtacacttcaagttggcaaattgagcttctgtatgattggagaaaagctttcaaccgggctacagtagttgtcttcccaaatcatgtccttccgatgatgtactctgcatttgacactggaaactattatgttattcctggttctcctgctgatatatgggaaacagaaactacaatggcattgtataatgatgaaatacatgtgaagatgggctatgaacccgatgacattgtcattgcaattgtgggaagtcaatttttgtacaggggtttgtggctggagcatgcacttgttttgaaggctctattgccactttttgcagaattttcattagataataattcaaaatctcatctcaaaatcattattttaagtggggatcctactggcaactacagtgtggctgttgaggctattgctgctaacttgagttatccaagaggtactgtaaagcactttgctgttgatgatgatgtgggcagtcccctcggtgcagctgatcttgtgatatatggatccttccttgaggagcagtcttttcctgaaattttggtgaaagccatgtccattggaaaacccatcataaccccagatctctccatgatcaggaaatatgttgatgacagggtgaatggctatctttttcctaaggaaaacctcaaggttctaacacagattgtattgcaagcgatctccaaagggacattatcacctctggctcgtaatatcgcgtcaatgggaaaaaatactgctaaaaacctcatggttctagaaaccgttgaaggctatgctacactacttgaaaatgttgttgagcttccatcagaagtcacacctcctaaggctgtttcagaaattcctccaaaactgaaaaaagagtggtgctggcatctatttaaagcatttatgaattctacgcatgaagacagaactttgaaaagttccagatatttaaaaacagttgaggagcagtggaactatatgcaaaaagagagctctggttccatagctgctactaatgattcattctcatatgacatttgggaggaagagagaaatattatgatgctcaatactagaaagagaagagaggaagaagagctaaaagatagaactgatcaacctcatggaacatgggaggatgtgtataaaagtgccaaaagggctgatcgttccaggaatgatttacatgaaagggatgaaggagaacttttgaggacagggcaaccattatgcatttatgaaccgtattttggggaaggaacctggtcttttcttcaccaaagttcgctttatcgtggaataggattgtccacaaaaggtcgaaggcccaggacagatgacatcgatgccccctcccgtctatcacttcttagcaagccatactaccgagatgccctaggtgaatatggagctttttttgcaatcgcaaatcggattgaccgtattcataagaattcttggatagggtttcaatcttggagagcaacggcaaggaaggcatctttgtctaggattgctgaaaaggcattggtagatgctatagaatcacgaaagcatggggactcactttacttttgggttcgcatggacatggatccaagaaacgacttacagagcgacttttggtcattctgtgatgctataaacgctggaaattgcaagttagctttttctgaggctcttaagaggatgtatggcatcaagcatgatttggaatttttgccacccatgcctgaagatggggatacatggtctgtcatgctgagttttgctttgccaacaaggtccttcctagagtttgtaatgttttcaagaatgtttgtggacgcactggatgcacagatgtatgatgagcaccatcaaagtggacgatgttatctgagtctagctaaggataagcattgctactcacgggttcttgagctgcttataaatgtctgggcataccacagtgcaaggcagatggtgtacgtgaaccctgagactggcttgatgcaagagcagcatgcagtcaagagtcgcagaggcaatatttgggtcaaatggttctcatacagcatccttaagagcatggatgaggacttggctgaagaggcagattctgatcagcccaagagaagatggttatggccatcaacaggcgaggttgtatggcaaggattatttgagaaagagagaaatctgcggaatcatcagaaagagaagaggagacagcaaagcaaggacaaacaacaaagaatgaggaaaaaacgccgtcaaccagtgctggggaaatatgtgaagcccccaccggaggacatagaaaattcaaactctacggtgtccatgtcggaatctttgtag

SEQ ID NO: 2430 - DNA, 3032 bp, Sorghum bicolor
agggcttgaaatcatggatttgtttgcaattgactcggatagtgagtcttatactgggaccagtgacagtgaagaccaagaatgtgaatttgcatatagcgaccatgcccaaaacatcttgtccagcctggatgagagcattgtcaagattgataattttctgacttttgaaagggggtttctgcatggggatatagtctgccctgtttctgatccctcaggtcagctgggacgtgttgttggtgtttcaatgcttgttgatttggagacaagctcaggtgacataattaaagatgtaaacagcaagaagctatcaagggtgagatcttttgtttcaggtgaccgtgttgttatggggccatggattggccgagtgatcagagcatttgatcttgtcacacttctgttcagtgatggagcgaagtgtgaaatcctgttaagggatttggatgtactgaagcctgttcctcctattctttttgaagatgcaccttacttttattatcctggccaacgtgtgaggatagtcgatccgtcagtttccaagtcggcaacatggttgtgtggatcatggaggcccagtagagacgattgtattgtctctcatgttgatgtagggctggtgcatgtgaactggatcacatctgtgaccaatgtttggggagataaatcatcgagtccttcaaacattcaggacccaaagaagctcacattgctgtcatgtttcccttatgctaattggcaactaggtgattggtgtgctcttatggccgacaacaatggatatctctggatggattctggcaagtcttgtattcttagtgaagaccataagtgtgactctcatgggcacatgtatttcgaaagttatggttcagattgttctcaaacatatgttgttgccaagacaaagagcactgtcgatgttctgtggcagaatggaactgtatctcttggtctagaaccccaggcattagtccctgtgagtacccttggtgaccatgatttttggccaggccaatatgtcctagaaaaactgactgtagaggatgctgcaaaatgtcagcgaacggcaatagtgagagatgtggatgcactggagcgaacagtaaatgtaaaatggattgatccagctcatagtgacactgtcagctatggaagtgaccctgcagtggagactgtaagtgtttatgagctagtagagcacccagatttctccttctgcactggtgaggtcgttatcaggtcagctgtgaacatagacaagtctgaagcagatctcacaaacgggtcattagcaagcaaagaatcattggttacctcctctggcttcttatcatgcatcggaaatgtacttgggtacaaggacaatggaattgaagttcaatgggctaatggtgtgatatccaaggtgcagcattttgagataattggattggacaggcttcttgataatagttctctagaatcaatgaatgaggaacatacaattggtgattcgctaggcgaggctgagcaggaggaaatgcaccatgagattgctctggagtctactgaagactgcactgggtccttgtgcaaagccactgcttttctatttcccaagacagcttttgacttcctgacaaatgtggctgctagtttgtttggtactcgtggttctccatctccaagctcagtttcggtagatcctcgatatgaaattgtgaagatggcagaaatgcagccatgtgtagaagaattgccaaaagaaaaacagatagtgaagtttgtggcgcagattgagaagccaatcctctcttcagaagatgccatctcaaaaagatttgatgtagtcactgactgtttggatcatcattttgtgaaggaaaatggccatgaaagtgttacaagaggttggctgaagaaggtgcaacaggaatggagcatcctgcaaaatgatctaccagatggtattcatgtgagagtttatgaggaaaggatggatcttctgagggcttgcattgttggggcagctggaacaccttatcatgacaacctttttttctttgatattttctttcctcctgactatccccatgaaccaccttctgttcactatcactctggtggtcttcgtttgaatccaaatttgtacgagtcgggaaaagtgtgtctcagcctcctgaagacatggacaggaactggtaatgaagtgtggaatgccgagaactcaactgttcttcagctcttgttatcgcttcaggcccttgttctcaatgaaaaaccttatttcaacgaggcgggatatgacaaatttgtgggtaaggctgatggagagaagaactccatcacatacaatgagaatgctttcctgctgtcatgcaaatccatgatgtatgttttacacaagccaccaaagcattttgagaagttggtcaaggagcatttcacttgtcgttccctgcacattctggatgcctgcgaggcttatcttgggggtgatcttgttggacatgcgcacgacaaagcatacatatcagaggacggcagcaagaactgttcaaccggtttcaagataatgcttggtaagcttctgccaaagcttgttactgccttctatgaggctggtatcaccagtgacccgtaaaccagagcaagcctgctctctacatcagtaatgaaattgggacccttttatattgtgcgtgtatgtcgatgcttgtgtattccaaataaaatgttgcctggtttatgtgttacttatgcctgtcttgtaaatgtggaacagtatatacacatgattgttgaactgatatgcttgtcatgtaaatgcggaacggtatatacgcatgattggtgaactgatatgttgctaagctaaaggcagctagagactgaagtgtctgggtttgggttgtattctgcttttggtgtgaaaaaaattgtatatatatgttcaatggtttttggactatcgacatagcagttgtctgtacatatttgcttatactgcaatgtgaaatacaaaggcaaggcgatatctccatgat

SEQ ID NO: 2431 - DNA, 3162 bp, Panicum virgatum
ggtaattctcctttggcattatcagtcataaattctaccaaaatatcaagaagtacttctggaaggtggaaggaatacttggccaactgtgttggtatattgccattccaaacatcaacttgcttattgttgtttgtttttgagattaccacgttatccatacagtacacaccttattctaagaaggacttggaatcatggatttgtttgcaattgactcggatagtgagtcatatagtgggaccagtgacagcgaagaccaagaagaatgtgaatttacgtacagtgaccatgcccaaagtatcttgtccagcctggacgagagcattggcaagatcgataattttctgacttttgaaagggggtttctgcatggggatatagtctgccctgtttccgacccctcaggtcagctgggacgtgttgttggcgttgcgatgtttgttgacttggagacaagctctggtgacataattaaagatgtaaacagcaaaaagctatcaagagtgagatccttcatttctggagactgcgtcgtaatgggaccatggattggacgggtgatcagagcatttgaccttgttactgttttgttcagtgacggggcgaagtgtgaaatgctgttaagggattctgaggcactgaagcccattccacctattctttttgaagatgcaccttatttttactatcccggccaacgtgtgaggattgttgaaccctcggtttaccagtcagcaacatggttgtgtggatcatggaggccaggtagagatgacggtgttgtttctcatgtagatgttgggatggtgcatgtgaactggatcacatctgtgacaaatgtttggggagataaatcatcaagtcctccaaacattcaggatccaaagaaactcactttgctgtcatgcttcccttatgctaattggcaactgggtgattggtgtgctcttacggttgacgaccatggatgtctgtggatggattctgggaagtcttgcattgttagtgaagcctggaagtgcaactctcctgggcacatgcatttggaaaattgtagttcaggttattctcaaacatatgttgtctccaagacaaagagtactgttgatattctttggcaaaatggaagcatatctcttggtctggaaccccagacactggttcctgtgagtacccttggtgattatgatttttggccagggcaatttgtcctagagaaactggctgttgaggattctgcaaggcgtcaacgaactgggatagtgagagatgtggatgcactcgagcgaacagtaaatgtattatggattagtcctgcaggcagtgacactgtcagctatggaagaagtggctctacagtggagactgtgagtgcttacgagctggcagagcacccagatttctccttctgcactggtgaggtcgttatcatgtcagctgtgaacatagagaagtctgaagcagatctcacaaatgggtcattagcaagcagggaatcattggttacccactctgacttcttatcatgcattggaaatgtgcttggctacaaggatgacggaattgaagtccagtgggctaatggtgtgatatccaatgtgcagcattttgaaataattggattggataaacttctcgatagttcactagaatcgatgcatgaggaaaatacagccggtgattcagtagacgtggatgagcaggaggaaatgcatcatgagaatgctaacattgctctggaatctactgactgcactggttccttgtgcaaagtcactgcctttctttttcccaagacagcttttgatttcctgacaaatgtggcttctagtttgtttggtactcatggttctccatcgccaagctcagttgtgatagatactcaatatcaaattattaagacggtagaaatgcagacatctgcagacgaattgccagaggaaaaacaggtagtggagttggtggcaaagattgagaaaccaaatctcacttcagaagataacatatcaaaaagatttgatgtagtgactgactgttcggatcatcactttgtgaaggaaagtggccacgaaagtgttacaagaagttgggtgaagaaggtgcaacaagaatggatgatcctgcaaaatgatttaccagatggtattcatgtaagagtttttgaggaaaggatggatcttcttagggcttgcattgttggggcagctggaacaccttatcatgataatctttttttctttgatattttctttcctcctgactatccccatgaaccaccttctgctcactaccactctggtggtctccgcctgaacccaaatttgtatgagtcgggaaaagtatgtctcagccttctcaagacatggacaggaaccggtaacgaagtgtggaatccagagaactcaactgttcttcaactgctgttgtcccttcaggcccttgttctcaatgaaaaaccttatttcaatgaagcgggctatgacaaatttttggggaaggctgatggagagaagaactctatcacttacaatgagaatgctttcctgctgtcatgcaagtccatgatgtatgttttacacaaaccaccaaagcattttgagaagttggtcaaggagcatttcgcttgtcgcgcccgacgcattctggatgcctgcgaggcttatcttggcggtgatctcgtaggacatgcacacgacaaagcatacatatcagaggacggcagcaagaactgttcgaccggtttcaagataatgcttggcaagcttctgccgaagcttgccgctgccttctctgaagctgggatcatcagcggccagtaaactgggaccctttatcagtgattattgtgtgtattttgatgcttgtgtattccaaataaaatgctacctggttcatgcgttagttatgtttgtcttgtaaataaggaacagtatatatatacccacgattgctgaactgaaatgttgctaagctaaaggcagctcaagtgtggagtgcctggatttgggttgtattctatgttaagtgtgaagggtatgtaaatgtgtgttcttgaaaggtttgcctaaagtattgaaagtgcagttgtatacgtattgctagtactaaactctgaaattttaaaaaagacagcgtatcaaacggccagttcggcagtct

SEQ ID NO: 2432 - DNA, 3134 bp, Pennisetum glaucum
agctatatcagggtaattctcctttggcattaacagtcaagtgtgcttgctgcgtgcacacaacctctaccaaaatatcaagaagtacttctggaaggtggaaggattactcggccagctgccttggtacattgccattccaaacgtcaacttgtgtattgttggttgttcttgagattaccacgttatccatacagcacataacttattctaaggacttgcaatcatggacttgtttgcaattgactcggacagtgagtcgtacagtgggaccagtgacagcgaagaccaagaagaatgtgaatatacatacagtgaccatgcccaaaatatcttgtccagcctggacgagagcattggcaagattgataattttctgacttttgaaagagggtttctgcatggggacattgtctgccctgtttctgatccctcaggtcagcttggacgtgttgctggggttgcaatgtttgttgacttggagacaagctctggtgacataattaaagatgtaaacagcaagaagctatcaagagtgagatccttcgtttctggggattgcgtcgttatgggaccatggattggacgggtgatcagagcgtttgaccttgttactcttttgttcagtgacggagcgaagtgtgaaatgctggtaagggattcagaggcactgaagcccattcctcctattctatttgaagatgcaccttatttttactatcctggtcaacgtgtgaggattgtccaaccctcgattttcgagtcagcaacatggttgtgtggatcatggaggcccaatagacatgatggtgttgtctctcatgtagatgttggcctggtgcatgtgaactggatcacatccgtgaccaatgtttggggagataaatcatcaagtcctcgaaacattcaggatccaaagaatctcactttgctgtcatgcttgtcttatgctaattggcaacttggtgattggtgtgctcttacatctgacgaccatggatgtctgtggatggattctgggaagtcttgcattcttaatgaggcctggaagtgtgactctcatgggcacatgcattcaggttattctcaaacatatattgtctccaagacaaagagcactgttgatgttctgtggcaaaatggaagcatatctcttggtctggaaccccagacactggttcctgtgagtacccttggcgattatgatttttggccagggcagtttgtcctggagaaactggctgttgacgattctgcaagatgtcaacggactgggatagtgaaagatgtggatgcactcgagcggacagtaaatgtaaaatggattagtcctgcaggcagtgacgctgtcaactatggaagaagtggcccaacagtggagactgtgagtgcttacgaactggtagagcacccagatttctccttctgcactggtgaggttgttatcaggtcagctgtgaacatagacaagtctgaagcagatctcacaaatgggtcattagcaagcaaggaagcattggacttcttatcatgcataggaaatgtgcttgggtataaggatgatggaatcgaagtccaatgggctaatggtgtgatatctaaggtgcagcattttgaaataattggattggataagcttcttgatagttcactagaaccaatgcacgaggaacatgtcggtgatgcagtagccatggctgagcaggaggaaatgcaccatgaaaatgcaaacattgctctggagtctactgactgcactggttccttgtgcaaagccactgcttttctctttcccaagacagcttttgatttcctcacaaatgtggctactagtttgtttggtgctcatggttctccatcaccaagctcagttgtggaagatcctcaatatcaaattattaagacggcagaaatgcagacatctgcagacgaattgccagaagaaaaactgactgtggagctggtggcaaaggttgagaagccaaatccctcctcagaagatagcatctcgaaaagatttgatgtggtgactgactgttcagatcatcactttgtgaaggaaattggtcatgaaaatgttacaagaggttgggtgaagaaggtccaacaagaatggacgatcctgcaaaatgatttaccagacggtattcatgtaagagtttttgaggaaaggatggatcttctgagggcttgcgttgttggggcggctggaacaccttatcatgataatctttttttctttgatattttctttcctccagactatccccatgaaccaccttctgttcactaccactctggtggtctccgcctgaacccgaatttgtatgagtcgggaaaagtatgcctcagccttctgaaaacatggacaggaactggtaacgaagtgtggaatgctgagaactcaactgttcttcaactgctgttatcccttcaggcccttgttctcaatgaaaaaccttatttcaatgaggcgggctatgacaaatttttggggaaggctgatggagagaagaactccatcacttacaatgagaatgctttcctgctgtcatgcaagtccatgatgtatgttttgtgcaaaccaccaaagcattttgagaaaatggtcaaggagcacttcacttgccgcgccccatgcattctggatgcctgcgaggcttatcttggtggtgatctcgttggacatgcacacgacaaaacatacatatcagaggatggcagcaagagctgttcaacgggtttcaagattatgcttggtaagcttctgccgaagcttgccactgccttctctgaggctggaatcaccggtggctagtaaaccagagccaccgccttctctgaggctggaaccattagtaatgaaatcgggaccctttatcagtaattattgtgtatgctggtgcttgtgtattccaaataaaatgctgcctggtgtatgtgttacttttgtgtgccttcttccaaatgtggaacggtatatatgcatgattgctgaactgattgttaagccaaaggcagctccagtgcggagtgcctgggtttgggttgtaaacttgtgattctacattgagtgaaaaatatgtaaatgtatgttctttgaaggtttgtctaaattattgacagtgcaatta

SEQ ID NO: 2433 - DNA, 3021 bp, Setaria italica
cacatcccaaaagagtggaaaggtcggaggatcttgctgcactttgaagctgttgattctgcttttttcgcttgggtaaatggggtgccgattgggtacagccaggacagcaggcttcctgctgagtttgaagttactgattgctgccatccttgtgattcagacaaggaaaatgttcttgctgttcaagttatgaggtggagtgatggctcttatctagaagatcaagaccactggtggttatctggtattcacagggatgttctactactatcaaagccacagatttttattacagattactttttcaaagcaaccatggatgagaatttcagtttagctgatattgaggttgaggtggaaattgattcacacaagcaagaccgggagcatgtttcaactttgtctattgaagccacactttatgataattctggaccatctatcagtttagatggtgatctttcatttgctaatgtggttaatttgaaaccgaagccaaaaacaagtcgaggcccttgtcttggttttcatggttacgttcttggtggaaaaatagaaaatccaaaactttggtctagtgaacatcccaacttatacacacttgttgttctccttaaagatgccaatgggaagcttattgagtgtgaatcatgccaagtgggcattcgcaatgtggtccgtgcacacaagcaaatgcttgtcaatggatgtcctgttgtactaagaggtgtcaacagacatgagcaccatccacgccttggaaagacaaatatagaagcatgcatgatcaaggatctgattttgatgaggcaaaacaatattaacgctgtaagaaatagtcattatccccagcattcgaggtggtatgagttatgtgacatttttggtctttacgtaatcgatgaagccaacatcgagacacatggctttgatgaaaatagccatttcaaacatcctacactagaacctatatgggcaaatgcaatgcttgatcgtgttgttggcatggtggagagagataagaatcatgcatgcattattgtatggtccctgggaaatgaatcttcatatggtcccaatcatgcttccatgtctgggtggattcgtgaaagggacccgacaaggctcctccattatgaaggaggtggttccagaacatcatccacagatattgtatgccccatgtatatgcgtgtctgggatattattaagatagcaaaagacccatctgaaacaaggcccttaattctctgcgaatattcgcatgctatgggaaacagtaacggaaatattgatgcatattggatggccatagacaacacttttgggctccaaggaggtttcatatgggactgggttgatcagggtttactaaaggaggattcagatggatccaaattttgggcatatggtggcgactttggagatactcctaatgacctaaacttttgcctcaatggcattgtgtggcctgatcggacaattcacccagctgttcatgaagttaaatacctttaccagcctatcaaaatatcatcagcagataacatgcttaagattgaaaatggacactttttcgatacaacagaagctttggacttcagttgggttcttcaaggagatggttgcatcttgggctctggttcgctgaatgttccaactttagcaccgcagactagtcaccttatcaacatggaatcgtcaccttggtttgctctttggagtacttgtgcagtcaaagaagtatttttgtctgtaaatgtgaaacagaggtaccatacgcgatgggctaaagatggtcatctcttggcttcagcacaactttgtttacctcagaaaaatggctttgttccccatgcagtagcattctccagtagccctctggtctgtgaacgcactggtgatagtgtaataatcagcaagaatgatgcctggaaaatcaaagtgaacagtcaactgggaacaatagacagttggaaggtcagcaatgttgagcttatgagcaaggggatattcccatgcttttggcgcgcaccaactgacaacgacaaaggaggtttctacaccaagccctatgtttcgcaatggagagaagcctccctcgataacgtctcgttctacagcagccagttttccgtgaaggaattgcccgacaacactgtggagctttccactgtctactatggtcttcctgggaacttacccaagcccgacgatgctgctctttcacaagctcccgagtctactcttttccaggtgaacatgctctgccggatctacgagtcaggcgacgtggttcttgagtatgaggtaaaccccaaggccgatctccctccccttccccgggtcggtgtcgtgttcaacgcagagaaatccctgagccacgtcatgtggtacgggaggggcccgttcgagtgctaccccgaccgcaaggctgcggcgcacgtcggcgtgtacgagagcagcgtggaggaccttcacgtgccgtacatcgtcccgggcgagtgcggcggccgggcggacgtcaggtgggtggcgctccggaacgccgacggcttgggcctccaagcgtcggtccatggcgagtccccgccgatgcagatgagcgcgagctactacggcaccgaggagctcgaccgggcgacccatgtccacaagctggtgaagggggatgacatcgaggtgcatcttgaccacaggcacatggggttgggcggggacgatagctggacgccgtgcgtgcacgagcagtacctgctgccgccgacccgctacgccttctccatgcggctctgccccctgctgccatcgtcgtcgtgtcatgacatctacaagtcccagctcccctagtgacgaatgacgatatgatgtgatgtgtgccggacagccgaggccggaggcacgtcagcacgtgagagggcaatggaatggaaccaagtgaaataattaggaaatgatgcagagacgccttccgctcctgcagtggccaggatgttgggctggccgacttttttattt

SEQ ID NO: 2434 - DNA, 3015 bp, Saccharum officinarum
  misc_feature (489)..(489): n is a, c, g, or t
  misc_feature (607)..(607): n is a, c, g, or t
  misc_feature (917)..(917): n is a, c, g, or t
  misc_feature (926)..(926): n is a, c, g, or t
  misc_feature (928)..(929): n is a, c, g, or t
  misc_feature (931)..(933): n is a, c, g, or t
  misc_feature (951)..(951): n is a, c, g, or t
  misc_feature (980)..(980): n is a, c, g, or t
  misc_feature (1053)..(1053): n is a, c, g, or t
tgtagacacacgtgtgcggaggggcgcatttcatctgagtttgaggtcgacgtggcgatagactcacacaagctataccgggagcatgtcccgactttgtctattgaagcaacactctttgataactctggactatctaacagtatagatgctgatctttcatatgctaatgcagtcaatttgaaactgaagccaaaaccaactcgaagcccttgtcgtggttctcatggttatgttcttggtggaaaaatagaaaatccaaaactttggtctagtgagcatcccaacttatacacgcttgtggttctccttaaagatgccaatgggaagcttattgactgtgagtcatgccaagtgggcattcgtaatgtggtcctggcacacaagcgaatgcttgtcaatggatgtcctgtagtactaagaggtgtcaacagacatgaacaccatccacgccttggaaagacaaatttagaagcatgcatgattgangatgtgattttgatgaagcaaaacaatatcaatgctgttagaaatagccattacccacagcacccgaggtggtatgagttatgtgacatctttggtctttatgtcatagatgaagccnacattgagacacatggttttgatgattctagcgctttcaagcatcctacactagaacctatctgggcaatgcaatgcttgatcgtgttgttagcatggtggagagagataagaatcatgcatgcattattgtttggtccctaggaaatgaatcttcatatggacctaatcatgcttccatgtctgggtggattcgtgaaagggatccaacaagactcctccattatgagggaggtggttccagaacatcatccacagatattgtgtgccccatgtatatgcgtgtctgggatattgttaagatagcaaangatccatcngnnannnggcctctaattctttgcnaatattcacatgctatgggaaacagtaangggaatattgatgcgtattggatggccatagacaacacttttggactccaaggaggttttatatgggactggnttgatgagggtttactgaaggaggactcagatggatctaaattttgggcatatggtggtgactttggagatactccaaatgactccaatttttgcctcaatggcattgtgtggcctgatcggacgattcacccagctgttcatgaagttaaataccttcaccagcctatcaaaatatcatcagcagaaaacatgcttaagattgaaaatggacacttttttgagacaacagaagctttggacttcagttgggttcttcatggagatggttgcatcttgggctctggtcctttgaatgttccaactttggcaccgcaaactagtcagctcatcaacatggaatcatcaccatggtttgccctttggagtgcttgtgcagcaaaagaagtatttttgtctgtaaatgtgaaacagaggcatgaaacacgatgggctaaagccggtcatctcttggcttcagcacaactgtgtttgcctcagaaaaatgtctttgtccccaacgtgatagcattctccagcagccctttggtctgtgaacgcattggtgataatgtaaccatctgcaagaataatgcatggaaaattaaagtaaacagtcaattgggaacaatcgacagctggaaggtcaacgacgtggagcttatgagcaaagggatactcccatgtttttggcgcgcaccaactgacaacgacaaaggaggtttcttcaccaagccatatgcttcgcgatggagagaagccttcctcgacaacgtctcgttccacagcagccagttctccgtcaaggaattgccggacaacaccgtggagttctccaccgtctactatggtgttcccgggcacttaccgaagcctgacgacgaagcctccgagtccattctcttccgggtgaagatggtctgccggattcacgagtcaggcgacgtggttctcgactacgaggtgaaccccagggccgacctccctccccttccccgggtgggcgtcgtgttcagcgccgagaggtccctgagcaacgtcacgtggtacggccggggccccttcgagtgctacccggaccgcaaggcggcggcgcacgtcggcgtgtacgagagcagcgtggaggagctgcacgtgccgtacattgcccccgtggagtgcggcggccgggcggacgtcaggtgggtggcgctccgcgacgctggcgggcttggcctgttcgcgacggcgcatggcggctccccgccgatgcagatgagcgccagctactacggcgcggcggagctcgacagggcgacgcacgtccacaggctggtgaagggagacgacatcgaggtgcatcttgaccacaggcacatggggctgggcggcgacgacagctggtcgccgtgcgtgcacgagcagtacctgctgccgccgacgcggtacgccttctccctgcggctctgccccgtgctgccgacgtcgtcgtgccgtgacatctacaggtctcagctccccagctgatggtgccgtgccggaggcccgtgaagagagaggcccatcgagccttgcgaaacaacaatgaaccagagacgcattcgatcctgcaatggcctggccagtaaattattataataaaataataaagcagagacgcattcgctcctgcaagctgcaacggcctggttcccgtgatgttctgacaaatcctggatatgtttatcggttactagcaaacgtgcttggcgttgcttggaagtcttgaaatcagacttcgtactgaattctatgggtttggttcatgaatgcggatagcaaatcgagatatggagaacgtgagcgccgggatacagatcgagggcactttggaaagaaaaaagagggatatagtttgggttgggagtaaaaaaatgaaaaaaaaaccctggtaatctttataattttgtgtaagagagaacactaaatttcttccaacaatgtatgaaaaaggtgaattattttt

SEQ ID NO: 2435 - DNA, 3256 bp, Triticum aestivum
gtcgctcagcgggcactggaagttccggctggcgcagtcgccggagaccgtcccggacaagttctacgacgcgcagttcaatgactctgactgggaggctctgccagttccatcgaattggcagatgcacgggttcgaccgtccgatctacacaaatgtcacttatcccttcccgatgaacccgccgtttgtgccttccgagaaccccacaggctgttacagaaaggtttttcacatcccaaaagaatggaaaggtcggagaatcttgttgcactttgaagctgttgattcagcgtttcttgcttgggtaaatggcgtaccaattggatacagccaagacagcaggcttcctgctgaatttgaaatcactgattgctgccatcattgtgattcagacaaggaaaatgttcttgcagttcaagtcatgaggtggagtgatggttcttatcttgaagatcaagaccattggtggttgtccggtattcacagagatgtgttactattatcaaagccgcagatctttatcacagattactttttcaaagcaaccttggatgagaacttccgggtagctgatattgaggttgaggtggaaattgattcacacaagcaagacagggagcatatcccaactttgtcgattgaagcaacattatttgataattctgaatcatctgatgatttgaattcagacatgtcagctgctaacatagtcaacttgaagacaaagccaaaacctaagggaggcccttgccatggttttcatggttatgttcttggtggaaaagtggaaaatccaaagctttggtctagtgaaaaaccgaacttatacactcttgttgttctccttaaagatgccaatgggaagcttattgattgcgaatcatgccaagtagggattcgtaatgtggtcctggcacacaagcagatgcttgtcaatggatctcctgttgtaattagaggtgtcaacagacatgagcatcatccacgtgttgggaagacaaatttagaagcttgcatgatcaaggatctggttttgatgagacaaaacaacatcaatgctgttagaaactcccattacccccaacatccaaggtggtatgagttatgcgacatttttggtctttatgtaattgatgaagccaatatcgagacacatggctttgatgaaaatagccatttcaaacatcctacactagaacccatctgggcaaattctatgcttgatcgtgtcgttggcatggtggagagggacaaaaatcatgcgtgcataattatttggtccttgggaaatgaagcctcatatggaccaaatcactctgctatgtctgggtgggttcgtggaagagacccaacaaggctcatccattatgaaggaggtggctccagaacatcatccacagatattatatgccccatgtacatgcgtgtctgggatattctcaagattgcaaatgacccatctgaaaacaggcccctcattctttgcgaatattcacatgctatggggaacagtaatggaaatattgacgcatattggaaggcgatagacaacacgatggggctccaaggaggttttatatgggactgggtcgatcagggtttactgaaggaggatgccgatggatctaaatcttgggcatatggtggtgactttggagacattccaaatgacttaaatttttgcattaatggcattgtgtggcctgatcggacgcttcaccctgctgttaatgaagttaaatatctttaccagcctatcaaaatatcgctggtggataatattctcaagattgaaaatggaaaattttctgagacaacagaggctttggacttcagctggattcttcatggggatggaagcgtttggggctctggttcactcagtgtcccaaacttagcaccacaaagtagccatcttatcaacatggaatcatcgccttggtttactctttggagtacctgtgcggcaaaagaaacttttttgtctgtacacgtgacactgagggaccaaacacggtgggctaaagctggtcatgtcttggcttcagcgcaactcagtttacctcagacaaagggctttgttcctcatgtgatagcattgtccaagagccctctgacctctgagcaggttggtgatggtgtaatcattagcaagaaccacgaatggcaaatcaaaataaacagtcagttgggaacaattgacagttggaagatcaacaacgtcgagcttatgagcaagggaatatttccttgcttttggcgcgcaccaaccgacaacgacaatggaggcttctacaccaagtcctatgccacaacatggagggaagccttccttgacaacgtctccttctacagcagccagttttcagtgaaggagctgccagaccacaccgtcgaggtttctaccacatattacggccttcccgggcacctgccaaaaccggatgatgccgctctttcagaagcttctgagtccgtgcttttccgggtccatatgcgctgccggatctacgagtccggcgacgtgatcctcgactacgaggtaaaccccaagagcgacctcccccctctcccgcgggtgggcatcgtgttcaatgcagagaaatccctgaaccatgtcacatggtacgggaggggcccgttcgagtgctaccccgaccgcaaggccgcggcgcacgtcggcgtgtacgagagcagcgtggaggacctccatgtgccctacatcgtcccgggcgagtgtggcggccgcgcggacgtctggtgggtggcgcttaagaacgccgacgggttcggcctcttcgcctcgacccacggcgagtccccgccgatgcaggtgagcgcgagctactacggcgccgcggagctcgaccgggccacccatcagcacaagctggtcaagggagacgacatcgaggtgcatcttgatcacatgcacatgggggtgggcggggacgacagctggacgccgtgcgtgcacgaggagtacctgctgtcgccggcggcgagctacaggttctcgctgcggctgcgccccctgtcgccgtcgtcatcgtgccacgacatctacagctcccggctacctaattgatcgtcccatctgtctgatgtggccgtcagaggtgcgtctgagagagaaagaacattcgagagactgaaacaatactgtccgagtcgctctcgctcgtgtaaacgtaagaagactgtaactggacaggtacctgtcaataagagaagcgagcgtgatgtgctgctc

SEQ ID NO: 2436 - DNA, 3813 bp, Brachypodium distachyon
ttcttctgcgatttcgtccccaactcgtctcactctccccagcctcacttcttcgacggcgagcgacgaccaacgacgcctactgccaccggacttccgtgggagtccttcatctcttcctcctctcgccggttcttccccggcgcgcgagatcgatgagcagttcgttttgaggacagtcgacagagaggaagagagagagaggatacggatacgtgcccttgtttgtttggtctccgtgatggcgttggcttctgccagcggcgcgatgtttccgcccacgaattcggcgagcaagccctgggaggacccgtcgttcttccggtggaggaagcgggaggcgcacgtgccgctgcgctcgcacgacacgctcgaaggggcactgaagtactggcatgaacggaggaacgttagctatcttgattccgagtctgctgtatgggacgatgacgctgttcgtggcgcgctggagagcgccgcgttttgttccctcaaattggcaaatgcatgggtttgaccgtccaatttacacaaatgtcacttatcctttccccatgaacccaccatttgtgccttctgaaaatccgacaggctgttatcgaaaggtttttcacatcccaaaagagtggaaaggtcggaggatcttgttgcactttgaagctgttgactcagcgttccttgcttgggtaaatggggtaccaattgggtatagccaggatagcaggctccctgctgagtttgaaatcactgattgctgtcatcattgtgattcgggcaaggaaaatgttcttgctgtccaagtcatgaggtggagtgatggttcttatcttgaagatcaggaccattggtggttgtctggtattcatagggatgtgttactactatcaaagccagagatttttatcacagattacttcttcaaagcaaccttggatgagaacttccttgtagctgatattgaggttgaggtggaaatcgattcacataagcaagaccgggagcatatctcaactttgtctattgaagcaaaattgtttgataattctgtaccatctggtggtttaaattctgatatgtcagctgctaatgtggtcaatttgaaggcaaagccaaaaccaaaaccaagccattgtcatggttttcatggttatgttcttggtggaaaagttgaaaacccaaaactttggtctagtgaaaaaccgaacttatacactcttgttgttctccttaaagatgccaaagggaagctcattgagtgtgaatcatgccaagtaggaatacgtggtgtggtcctagcacacaagcagatgcttgtcaatggttgccctgttgtaatacgaggtgtcaacagacatgagcatcatccacgtgttgggaagacaaatatagaagcatgcatgatcaaggatctggttttgatgagacaaaacaacatcaatgctgttagaaactgccattacccccaacatccaaggtggtatgagttatgcgatattttcggtctttatgtgatagatgaagccaatatcgagacacatggatttgatgaatctagcagtttcaaacatcctacacttgaatccatctggactaattgtatgcttgatcgtgtcgttagcatggttgagagggacaaaaatcatgcatgcattattgtttggtccttgggaaatgagtcctcatatggaccaaatcactctgcaatgtctgggtgggttcgtggaagggatccgacaaggctcatccattatgaaggaggtggttccagaacatcatccacagatattgtatgccccatgtacatgcgtgtctgggatattcttaagatagccaatgacccatctgagaataggcccctcattctttgcgaatattcacatgctatgggaaacagtaatggaaatattgatgcttattggatggcaatagacagcactatgggactccaaggaggttttatatgggactgggttgatcagggtttactgaaggaggatgtcaatggatcaaaattttgggcatatggtggcgactttggagacactccaaatgattcaaacttttgtcttaatggcattgtatggcctgaccggacgattcacccagctgtttatgaagttaaacatctttaccaacctatcaaaatatcattaatggataacacgctcaagataaacaatgcacaattttctgagacaacagaggctttggacttcagttggattcttcatggggatggttgtgttttgggctctggttccctcgaccttccagacatagcaccacaaagtagccatcttatcaacatgcaatcatcaccttggtttaccctttggagtgcctgtgcagcaaaagaaacctttttgtctataaatgtgaaactgggggggcaaacacgatggtctaaagatggtcatatcttggcttcagcacagctttgtttacctcagacaaatagctttgtccctcatgttatagcattatccaggagcccactagtctctgaacatgttggtgatagtgtaatcattagcaagaacaaggactggcaaatcaaagtaaacactcgatcgggaacaattgacagctggaagatcaacaacattgagcttttgagcaaggggatacttccttgcttttggcgtgcaccaactgacaatgacaacgggggcttctacaccaagtcctatgctacgagatggcgagaagccttcctcgacaacatcgtctttcgcagcagccagttttcagtgaaggagctaccggaccatgccgtcgagatttctaccacatattatggtcttcctggtcacttggtaaaaccggacgacgctgctctttcagaagctcccgagtccacacttttccaggtccccatgcgctgccggatgtacgagtcaggtgacgtgatactcgaatacgaggtaaaccccaagagtgacctcccccctctcccgagaatcggcatcgtcttcaacacggagaaatccctgagccacgtcacgtggtacgggaggggcccgttcgagtgctaccccgaccgcaaggccgccgcgcatgttggcgtgtacgagagcagcgtggaggacctccatgtcccctacatcgtcccaggcgagtgcggtggccgcgcggacgtcaggtggacggcgctccggaatgccgaggggttcggcctgttcgcctcggtccacggcgagtccccaccgatgcagatgagcgccagctactatggcgccgcggagctggaccgggcaacccacaaacacaagctggtcaagggagatgacatcgaggtgcaccttgatcacaggcacatggggctgggaggggacgacagctggacgccgtgcgtgcacgagcagtacctgctgccgccggaccgccgctacgccttctccgtgaggctccgtccgttgctgccgtcgacgtcgtgcgatgacatctaccgctctcagctcccccattgattcagagggagaaagcaactgaaagatggaaacaaacaaataaacgccgagtcgcgttcgctagctcactgtaatgtaattggccacagggtacctgtcaataaaagaagcgagcgtgatgttgcgctgctctgcaataaatgagaaacgacttctctttgtggatctttttggcgccagccattggtaatttaaccggggcaggtttgttgtttgtgtggtgtattaagggcctgttttgttttcaacgctagcatttctcatcagatgttttgagggccttttggatcacaggaactatgaaacatagaaacagtgaatataaagcacataaatgagattg

SEQ ID NO: 2437 - DNA, 989 bp, Saccharum officinarum
  misc_feature (179)..(179): n is a, c, g, or t
  misc_feature (249)..(249): n is a, c, g, or t
  misc_feature (264)..(264): n is a, c, g, or t
  misc_feature (574)..(574): n is a, c, g, or t
  misc_feature (687)..(687): n is a, c, g, or t
  misc_feature (690)..(690): n is a, c, g, or t
  misc_feature (713)..(713): n is a, c, g, or t
  misc_feature (728)..(729): n is a, c, g, or t
  misc_feature (832)..(833): n is a, c, g, or t
cgttctctcccgcgccgtcgtcgtccaggtcgcccggcggcggcaggagcatctcccgcctgccggctcgcgtcgccggcgcggtggtccgcagcctgctcaccgtcgtcttcgcggcagtgggcatggttctcggggccgtcacgggcgcgctgatcgggctcgccacggagagcggnctggtgcgcgggccggcatcggggccatctccggcgccgtcgtgtccatggaggtcgtcgactctccgtngccatctggcgctcngacgagtccgggatctggagcgtcctatatgtgcttgatgtcctctggagtctgctcaccggccgcctggtgcgcgagaaggtggatcccgccgtgcagagcgccgtcgacagccagatgaacgccgcggactcgggggacatggcgtcgccgacactggcggacatgttcgagacgggcgccgccgccgccgccaagggcatgccggccgccgccatcgcggcgctccccgtcacagccttcaccgagcacaccgtcgcggacgcctccggggagcccatcggctgctccgtgtgccttcaggacttcnaggccggcgagacggcgcggagcctgccggggtgcgggcacacgttccacctgccgtgcatcgacgtctggctgctccggcacgcgtcgtgcccgctgtgtcgccgcgcggtntangccgctgcgggcgcgcgcgtttngtcagggtgtctttnngcgatcgtgcgcctgcacatcacgtgtcccggaccaggagcagagtaggctagctagtagcaggacaccttggttgtctttcttgcataccttgatttttctnntttttttcttcggttgggcacgcgtgtacagatacagtacgttgctcacactgtcacacacacgatgtggatgtaaatatgtactgtacagaggtggatgttgtaaataatgtaatatagttgtagcattgagattttttcgatgatcactggtgc

SEQ ID NO: 2438 - DNA, 827 bp, Zea mays
ttcgttgcagtgggcatggttctcggggccgtcacgggcgcgctgatcgggctcgccacggagagcggcctggtgcgcggcgccggcgtcggggccatctccggcgccgtcgtgtccatggaggtcgtcgactcctccgtcgccatctggcgctccgacgagtcagggatctggagcgtcctatacgtgcttgacgtgctatggagcctggtgaccggccgcctggtgcgcgagaaggtggaccccgccgtgcagagcgccgtcgacagccagatgaacgccgcggactcgcaggacacggcgccgacactggcggacatgttcgagacggccgccgcgggcatgccagccgccgccatcgcggcgctccccgtcacggccgtcaccgagagtaccgtcaccgacgcctccggggagcccatcggctgccccatctgccttcaggacttcgaggccggcgagacggcgcggaggttgccggagtgtgggcacacgttccacctgccttgcatcgacgtctggctgctccggcacgcgtcgtgcccgctgtgccgccgcgcggtctaggccgccgccgccgccgccgcgcgcgtttcgtttggagggtgtctttcagcgacacacacgtttccccgaccataccatgagcagagcattctaggatagtaggagtgcagggcacctggttctttcttgcataccttaatcttttttctattcgtcttgggcagtacgcatttacagatacagtacatggctcccattgtcacacacacacacgcgcggcgtggacgtaaaaatgtatagaggtgaatattgtaaataat

SEQ ID NO: 2439 - DNA, 813 bp, Saccharum officinarum
tgctgctgtgtcatctgctctgctacgactaagccggagctcccaccgtcaggtcttcttccccccttcgtgtcctctgcctgcgcgcgcggaccgtcaagcgagcgagcaatcgtcatggacatggaggcggccgcgatcttcggcaccgccagcgcgtcgttctctcccgcgccgtcgtcgtccaggtcgcccggcggcggcaggagcatctcccgcctgccggcgcgcgtcgccggcgcggtggtccgcagcctgctcaccgtcgtcttcgcggcagtgggcatggttctcggggccgtcacgggcgcgctgatcgggctcgccacggagagcggcctggtgcgcggcgccggcatcggggccatctccggcgccgtcgtgtccatggaggtcgtcgactcctccgtcgccatctggcgctcggacgagtccgggatctggagcgtcctatatgtgcttgatgtccttggagtctgctcaccggccgcctggtgcgcgagaaggggaccccgccgtgcaagcgccgtcgacagccagatgaacgccgcggactcgggggacaagacggcgccgacactggcggacatgttcgagacgggcgccgccgccgccgccaagggcatgccggccgccgccatcgcggcgctccccgtcacagccttcaccgagcacaccgtcgcggacgcctccggcgagcccatccgctgctccgtctgccttcaggactttgaggccggcgagacggcgcggacccttgcggagtgcgggcacacttttcacctgccggggcatgacgtctggctggtccgg

SEQ ID NO: 2440 - DNA, 955 bp, Panicum virgatum
  misc_feature (128)..(128): n is a, c, g, or t
  misc_feature (163)..(163): n is a, c, g, or t
  misc_feature (221)..(221): n is a, c, g, or t
  misc_feature (833)..(833): n is a, c, g, or t
  misc_feature (841)..(841): n is a, c, g, or t
  misc_feature (888)..(888): n is a, c, g, or t
ggcgttctctcccagcacgccggcggcgccgagcggcggcgcgggaggcggaggcaggagcatctcccgcctgctgccggcgcgcgtcgccggggcggtggcccggggcgtcgtcaccgtcgtcttcncggcagtgggcgtggtcctcggggccgtgacgggngcgctgatcgggctggccacggagagcggcctggtgcgcggcgccggcgtcggggccntctccggcgccgtcgtctccatggaggtcgtcgactcctccgtcgccatctggcgctcccacgactcggggatctggagcgtcctctacgtgctcgacgtgatctggagcctcctgaccggccgcctcgtgcgcgagaaggttgaccccgccgtgcagagcgccgtcgacagccagatgaacgcggtggactcgccgttcggggagatggcgccgacgttggcggacatgttcgagactggcgccgccggggcggcgaagggcatgccggccgccgccatcgaggcgctcccgtccgtgaccttcaccgagcgcgccgccaccggcgacgaccgggaccggctgctccgtctgcctccaggaattcgaggccggcgagacggcgcggagcttgccggtgtgcgggcacacgttccacctgccgtgcatcgacgtctggctgctccgccacgcgtcgtgcccgctgtgccgccgcgcggtcgaggccgttgccgcgcctgcagagccccggcacgcggtgtgcagtggttagcttagcactctttcgtgctcatgtcttcgtcgtcgctttcgagcttgaggacgtacggtgtacagatacagatactttagntccacgtnggctatatacacgccatggttgtgaatatgttgtatagaggtccatnttgtagatgattgattcttgtagaattgagtttttctctctgttagtaaaattatttttcattgttc

SEQ ID NO: 2441 - DNA, 1077 bp, Cenchrus ciliaris
  misc_feature (393)..(393): n is a, c, g, or t
  misc_feature (417)..(417): n is a, c, g, or t
  misc_feature (439)..(439): n is a, c, g, or t
  misc_feature (852)..(852): n is a, c, g, or t
  misc_feature (862)..(862): n is a, c, g, or t
  misc_feature (884)..(884): n is a, c, g, or t
  misc_feature (892)..(892): n is a, c, g, or t
  misc_feature (905)..(905): n is a, c, g, or t
  misc_feature (908)..(908): n is a, c, g, or t
  misc_feature (945)..(945): n is a, c, g, or t
  misc_feature (948)..(948): n is a, c, g, or t
  misc_feature (963)..(963): n is a, c, g, or t
  misc_feature (1034)..(1034): n is a, c, g, or t
  misc_feature (1041)..(1041): n is a, c, g, or t
  misc_feature (1047)..(1047): n is a, c, g, or t
cccatctcccatcctgcgcgccgagcagctagcagccagccagtcatggaggcagtctcctccgccagcacctccttctctcccagcacgccgttggcggcagcgtcgagcggcagcgggaggggcagcagcgtctcccgcctgccggcgcgcgtggcccgggcggtgctccgtggcgtgctcaccttcgtcttcgcggcggtggggatggtcctcggcgccgtgactggcgcgctgatcgggctcgccacggagagcggcctggtgcgcggcgccggcatcggggccatctccggcgccgtcgtgtccatggaggtcgtcgactcctccgtcgccatctggcgctcccacgactcggggatctggagcgtcctctacgtgctcgacgtgatntggagcctcctgaccggccgcctngtccgcgagaaggttgaccccnccgtgcagagcgccgtcgacagccagatgaacgccgtggactcgccgttcacggagacgaccccgacgacattggcggacgtgttcgagaccggcgccaagggcatgccggccgccgccatcgaggcgctccccgtcaccaccttcaccaccgaggacgccgccgccaccggcgaccacgacggcgacagggccggctgctcggtctgcctccaggatttcgaggccggcgagacggcgcggaggttgccggagtgcgggcacacgttccacctgccgtgcatcgacgtctggctgctccggaacgcgtcgtgcccgctctgccgccgcgcggtctaggaggctgttttgttgcgcgcgagcagagcacacagccacacacgtccggacctgcagggcagcagacgcggtggncattggcatntacgccaaagttccttttgttnttcgtgtnctcgattcatttnttngtcgttttgacgacgtacagacactgtagttccacgnggntggtaggtacatatncgacatattgccatgggtgtaaatatgtgcagaggcgagtgttgtaaataatccttgtagaattgagattnttttttntcgttnttttttttttaatagaaaatccttcatcca

SEQ ID NO: 2442 - DNA, 1532 bp, Sorghum bicolor
actcctgcagcttgcatattgctttgcatgtcatcgccgacgcaaatggcttcccttgccgttctcgtttccctcgtctgcgcagcgcttgcctccaatgccgcggccgtccgcgtggagctcacgcgcatccacgccgaccccagcgtgaccgcgtcccagttcgtccgcgacgccctgcgccgcgacatgcaccggcacaacgcccggcagctcgccgcgtcgtcgtccaacggcactacggtgtccgcgccgacccagatctcgcccaccgccggggagtacctgatgacgctggccatcggcacgcctccggtgtcctaccaggccatcgccgacacgggcagcgacctcatctggacgcagtgcgcgccctgcagctcccagtgcttccagcagccgacgccgctgtacaacccgtccagctccaccacgttcgccgtgctcccgtgcaacagctcgctgagcatgtgcgcggcggcgctggccgggacgaccccgccgccggggtgcacctgcatgtacaacatgacgtacggcagcgggtggacgtctgtctaccaggggtccgagacgttcaccttcgggtcgtccacgccggcgaaccagaccggcgtcccgggcatcgccttcggatgcagcaacgcgagcggcggcttcaacacctcgtcggcgtccggcctcgtcgggctgggcagggggagcctgtcgctcgtctcccagctcggcgtccccaagttctcctactgcctcacgccgtaccaggacaccaacagcaccagcacgctcctcctcgggccgtcggcatcgctcaacgacaccggcggcgtcagctccacgcctttcgtcgccagcccttccgatgcgcccatgagcacctactactatctcaacctcaccggcatatccctcggcacgacggcactgtccatcccgaccaccgccttgtcgctgaaggcggacggcaccggcgggttcatcatcgactctggcaccaccatcacattgctgggcaacacggcgtaccagcaggtccgcgccgcggtcgtctccctggtgacgctgcccacgacagacggcgggtcggcagccacggggctcgacctgtgcttcgagctgccgtcctcaacgtcggcgccgccgaccatgccgagcatgacgctccacttcgacggcgcggacatggtgctcccggcggacagctatatgatgttggactccaacttgtggtgcctggccatgcagaaccagaccgatggcggggtaagcattctcggcaactaccagcagcagaacatgcacatcctctacgacgttgggcaggagacattgacgtttgctccggccaagtgcagcacgctctgatcagagctttacagaattgcaaatatgtgtgtgcatatataggttatatatgtgtatataataatgggctgtcgatcgagaaatctattcaaaatctgttccaattcaaatctgaaattcgaactagactaccacaaggaatatagatacataagcattgactcgtc

SEQ ID NO: 2443 - DNA, 1767 bp, Hordeum vulgare
gacgctcatccgccaccgctctgaccatactcgcacgcaccacacccaatccccgcctccctccctccggaacactcgctttcctccaccagttttccacgcccgccctcagccaaaacccccacaacacacgcccagtccaaattcgccaccggccgcccgcccgcccgcagcgaccgcaagcctccctccccgccggcttcccctccctctccggtgaaagtctagatggctcctttggtccttggaatgtgaattccagaaaagaacaactgttgaccatttagtactgcatgatgaacggatcaactggttccccagggaatcatgtgaatggaaagcaagtgcaaagtgttgaccctcctggtctttcaagttttaacagtggaccaagacaccgtccgttgactgtgttgagacgctgtcgcggtgtattatgtttggtgattatgccggtgactgcatgcatgatgatggtttacctagcccctatgactaccttcgttgtacggttgttcagtgtccattacagcagaaagtggacgtgcttcctttttgggatgtggttagctatgtttccttttttgtttgagaaaattaacaggaccagatttgttttctctggtgaaaaggtgcccccaaaagagtgtgtcttgctgtttgctaaccacagaactgaggtagactggatgtacctgtgggatcttgctttgaggaaaggccgtttgcagtctatcaagtacatcctgaagaaaagtttgatgaagttgcctattttcaactgggcatttcacatcattgagtttattccagtagagcggaattgggaggttgacgaaccactaatcagaagaaggctgtctgaattgaagaaccccaaggatcccctttggcttgcagtttttccagaaggcactgactatactgagaagaaatgcatcaaaagtcaagagtatgcggcggaacatggtttgcctattctgaaaaatgtcctcctcccaaagataaagggtttcaactgctgcctgcaagagctgaggagtaacttggatgctgtttacgacatcacgatcgcatacaagcatcgcctcccaacgttcatggacaacgtgtacggtgtcgacccttccgaggtccacgtccacaccaagatcatccaggtctccgacatacccaccgcagaggacgaagtatctgactggctgaccgagaggttcaggctgaaggatgagctcctgtctgacttctcgacacgaggccacttccccaacgaaggcaccgaggaggagctgccgacgctcaagtgcgtcgcgaacttcgcggcggtgatgggcatgacgggcgtgttcatctacctgaccctgttctcgtccgtgtggttcagggtcttcgccgcgtgcagcgcctctttcctcacgtttgctaccctctactctgtgcacgcgccgcagatcgtgtgtttgccggaggctggggtgcatgccaagaaagcttgagcttggcgttgtaagctggcgctggaagctgttcgcgtgtgtcagcacgcagtacaaagatgtttagcatgtacacgcagtttgtggcgtcattcttttgtgtgtgtgtatgagcagttgcatctacggttgggttacaaagtggatggagccaaatcgctcgccataaggtaatcgaaacttaaaagaccagtcatataacttgctaaagaatatgcttcttacagcgatgagtgatcaacgctgagtttgaccaaaaaaaaaaaaaaaa

SEQ ID NO: 2444 - DNA, 1581 bp, Triticum aestivum
ggtgaaagtctagatggctcctttggtgctgggaatgtgaattgcagaaaagaacaactgtttacattttggtactgcatgatgaacggttcaacgggttccctaggggatcatgtgaacggaaagcaagtgcaaagtgttgaccctcctggtctttcaagtttcaacaatggaccaagacaccgtccgttgaatgcattgagacgctgccgtggtgtattgtgcttggtgattatgccggtgacagcatgcatgatgatggtttacctagcccctgtgacaaccttcgtcgtacggttgttcagtgtgcattacagcagaaagtggacgtgctttctgtttgggatgtggttagccatgtttccctttttgtttgagaagatcaacaggacaaggtttgttttctctggtgaaaaggtgcccccaaaagagtgtgtcttgctgtttgctaaccacagaactgaggtagattggatgtacctgtgggatcttgcattgaggaaaggccgtttgcagtctatcaagtacatcctcaagaaaagtttgatgaagttgcctattttcaactgggcatttcacattattgagtttattccagtagagcggaattgggaggttgacgaaccactaatccgaagaaggctttctgaactgaagtaccccaaggatcccctttggctcgcagtttttccagaaggcactgattatactgagaagaaatgcatcaaaagtcaagagtatgcggcagagcatggtttgcctattctgaaaaatgtcctccttcccaagataaagggtttcaattgctgcctgcaagagctgaggagtaacttggatgctgtttacgacatcacgatcgcatacaagcatcggctcccgacgttcatggacaacgtgtacggcgtcgacccctctgaggtccacgtccacaccaagatcatccaggtctgtgacataccaacagcagaggacgaagtatccagctggctcacggagaggttcagactgaaggacgagctcctgtctgattttttggcacaaggccacttccccaatgaaggaaccgaagaagacctgtccacgctcaagtgcgtcgcgaatttccttgcggtgatcggcatgacggccttcttcatctacctgaccctgttctcgtccgtgtggttcagggtcttcgcggcgtgcagcgcctctttcctcacgtttgccaccgtgtactctgtacacgcgccccagatcgtgtgtttgccggaggccggcgcccacgccaagaaagcttgagcttggtgttgtaagctggagctggaagctgtgtatgtgtgtccgcatgcggtagaaacatgtttactgcgtatacgcagcctgtggtgtcattcttttgtatgtgtgtatggtgagtggcatctacagttgggggtagaacttctaactccactcttgactcttttttggagcaaaatacgaagactgcattacaaaagtgggcggagccgaaatcggtcgccacgtatcttcgtctatacttgaaacttgaaagcagccatagctttgctaaagaatgtgccactctatttcaagttt

SEQ ID NO: 2445 - DNA, 1488 bp, Brachypodium distachyon
gccacacaggactctcctcctcccaactccaatccactcgctttcctccacagtccacggcccccgcccccggagccgataccccgtccctatcgccgccggccactcgtcgttccccgccggcctcccgtctcggataccattcctcccatcacaggtgaagtttagatggagctggggatgtgaatttcagaaaggataagtttttcacatttaataccacatgatgaatggttccactggttcccggaatcatgtgaatggaaagcaggcgcaaagtgttgattctcctcgtccttccatgctgaacaatggaccaaaacaccgtccattgactacattcagacgctgccgcggtgtattgtgcttggtgattatgctgttaacagcatttatgatgatggtttacctggcccctgtcactactttccttctgcggtttttcagtgtgcattatagcagaaagtggacatgctttatgttcgggatgtggttagccatgtttccttttttgtttgagaaaattaacagaaccaggtttgttttctctggtgaaagtgtacccccaaaagagtgtgtcttgctgtttgctaaccacagaactgaggtcgactggatgtacttgtgggatcttgcattgaggaaaggccgtttgcagtctatcaagtacatcctcaagaaaagtttgatgaagttgcctgttttcaactgggcatttcacattattgagttcatcccagttgagcggaattgggagattgatgaaccattaatccgaagcaggctttcgggattgaggaaccccaaggaccccctttggctggcagtttttcctgaaggcacagattacactgagaagaaatgtctgaaaagtcaagagtatgcggcagaacatggtttgcctatactgaaaaatgtcctccttcccaagataaagggtttcaattgctgcctgcaagagctgaggagttccttagatgctgtttatgatatcacaattgcatataaacatcggcttcccacttttcttgacaacctatatggtgtcgatccttccgaagtccacatccatgctgaaatcattcaagtctccgacatacccacatcggaagacgaagtatctgactggctcacggagaggtttagactgaaggacgaacttctgtccgactttttgaaactaggccacttccctaacgaaggaactgaagaagatctatccacattcaagtgcctcgcgaattttgtagcagtgattagcatgtcaagcttcttcatgtatttaaccctgttttcgtccgtgtggttcaaggttttcgtagtgtgcagcgcttcttttcttacgcttgccacctgctactctattcatatgccccagctcatatgtttacctgaggttggctcccatgccaagaaatcttgaacttggtgtaacttgtaactggaagctgtgtatcagcatgcagcaaagagatctttacttgccta

SEQ ID NO: 2446 - DNA, 1577 bp, Avena sativa
caaacccccctccccaatctccgccgcgccacccgctccggccgccgcagcaacacccgccggctccccccatcaggtgaagtctagatggctgctttggtgctgtgcatgtgaatttcaggaaagggataagcctttatcgaaagaaaaaggaaagggataagcattcacattttagtactacaggatgaacggttcacccgcttcccaagggaaccatgtgaatggaaagcaagtgcaaagtgccgatcctcccattctttcagtttttaacaatggaccgagacaccgcccattaactgcattgagacgctgccgtggtatattgtgcttggtgattatgccgctgactgcatttatgatgatggtttacctagcccctgtgactaccttcgttgtacggctgttcagtgtgcattacagcagaaagtggacgtgctttctgttcgggatgtggttagccatgtttccatttttgtttgagaagattaacaggaccagatttgttacctctggtgaaaaagtgccgccaaaagagtgtgtcttgctctttgctaaccacagaactgaggtcgactggatgtacttgtgggatcttgcgttgaggaaaggccgtttgcagtctatcaagtatatcctgaagaaaagcttgatgaagttgcctattttcaactgggcatttcacattattgagtttattccagtggagcggaattgggaaattgatgaaccacaaatccggagaaagcttaccggattgaagaacccaaaggatcctctttggctcgcagtttttcctgaaggcactgattattctgagaagaaatgtatgaaaagtcaagagtacgcggcagaacacggtttgcctattctgaaaaatgtcctccttcccaagataaagggtttcaattgctgcctgcaagagctgaggagtaacttagatgctgtctacgacattacgatcgcgtacaagcaccggctgccaacttttatggacaacgtatatggcgtcgacccttccgaagtccacatccacaccgagatcatccaggtctccgacatacctgtaccagaggacgaagtctccgactggctcatggagaggttcaggctaaaggacgagctcctgtccgagttcctgaagctgggccacttccccaacgaaggaaccgaggaagagatgtccacgctcaagtgcgtcgcgaatttcgtggcggtgatcggcatgacgggctcctcagctacctgaccctgttcacgtccgtatggttcaggatctttgtggtgtgcagcgcttccttcctcacgtttgccacattgtacggcgtgcatgttccgcaacttgtgggtgtcccggaggctggcgcccatgccaagaaatcttcctgaatgtcgctgtgtgtaacttttgactggaagctgtgtctcagcgtgcagcagaactatgtttactgaatatacgcagcctgtgtgccatcctcttttgtgtttgagtatgatcgggcttagttgggtactgaggcagctggctgagtgtgcgtggtgtcgcaatgggaactgagacgtgtttgtttctc

SEQ ID NO: 2447 - DNA, 1183 bp, Saccharum officinarum
ggccgtgctgaaggcgcggtcgctgaagcggtccgccgaggcgcgcgcgtggcggctcacggcgttccagcgtctcgacttcgccgtggacgacgtgctggactgcctgaaggaggagaacgtaatcggaaagggcgggtccgggatcgtgtacaagggcgcgatgccgggcggcgccgtggtggccgtgaagcggctgccggccatcgggcgcgcgggcgcggcgcacgacgactacggcttctcagcggagatacagacgctggggcgcatcaggcaccgccacatcgtgcgtctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctgtgctacctgcaccacgactgctcgccgccgatcctgcaccgcgacgtcaagtccaacaacatcctcctcgacgccgacttcgaggcccacgtcgcggacttcggcctcgccaagttcctccgtggcaacgccggtggttccgagtgcatgtctgctatcgccggctcgtacggctacattgctcctgaatacgcctacacgctcaaggtggacgaaaagagcgacgtctatagcttcggcgtcgtgttgctcgagctcatcaccggtcgcaagccagtcggagagttcggagacggcgtggacatcgtgcagtgggtgcggatggtgaccgggtcgagcaaggaaggcgtgatgaagatcgccgacccccggctctcgacggtgcctctgtatgaactaacccatgtcttctatgtcgccatgctatgcgtcgcggagcagagcgtcgagcgccccacgatgcgggaggtggggcagatactggccgacatgcccggctcgacatccacgtccatagacgtgccccttgttatcgagccgaaggaggatgggagcccgggggagcagcagcaggaagggccacatgagtcgccgccacaacaggatcttcttagtatctagaagtgcaattgcaggagttgatcgtactgatagtagtactcactccgtcgattgtgcaactatagaaaatgtgtcgttcaaactgtatcaactttgaccaaatttatagcaaaa

SEQ ID NO: 2448 - DNA, 1192 bp, Saccharum officinarum
ggccgtgctgaaggcgcggtcgctgaagcggtccgccgaggcgcgcgcgtggcggctcacggcgttccagcgtctcgacttcgccgtggacgacgtgctggactgcctgaaggaggagaacgtaatcggaaagggcgggtccgggatcgtgtacaagggcgcgatgccgggcggcgccgtggtggccgtgaagcggctgccggccatcgggcgcgcgggcgcggcgcacgacgactacggcttctcagcggagatacagacgctggggcgcatcaggcaccgccacatcgtgcgtctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctgtgctacctgcaccacgactgctcgccgccgatcctgcaccgcgacgtcaagtccaacaacatcctcctcgacgccgacttcgaggcccacgtcgcggacttcggcctcgccaagttcctccgtggcaacgccggtggttccgagtgcatgtctgctatcgccggctcgtacggctacattgctcctgaatacgcctacacgctcaaggtggacgaaaagagcgacgtctatagcttcggcgtcgtgttgctcgagctcatcaccggtcgcaagccagtcggagagttcggagacggcgtggacatcgtgcagtgggtgcggatggtgaccgggtcgagcaaggaaggcgtgatgaagatcgccgacccccggctctcgacggtgcctctgtatgaactaacccatgtcttctatgtcgccatgctatgcgtcgcggagcagagcgtcgagcgccccacgatgcgggaggtggggcagatactggccgacatgcccggctcgacatccacgtccatagacgtgccccttgttatcgagccgaaggaggatgggagcccgggggagcagcagcaggaagggccacatgagtcgccgccacaacaggatcttcttagtatctagaagtgcaattgcaggagttgatcgtactgatagtagtactcactccgtcgattgtgcaactatagaaaatgtgtcgttcaaactgtatcaactttgaccaaatttatagcaaaagttattacc

SEQ ID NO: 2449 - DNA, 1284 bp, Panicum virgatum
  misc_feature (274)..(274): n is a, c, g, or t
  misc_feature (538)..(538): n is a, c, g, or t
ggccgtgctgaaggcgcggtcgctgaagcggtccgccgaggcgcgcgcgtggcggctgacggcgttccagcggctggacttcgccgtggacgacgtgctcgactgcctcaaggaggagaacgtgatcggcaagggcgggtccgggatcgtgtacaagggcgcgatgccgggcggcgcggtggtggccgtgaagaggctcccggccatcgggcgcgccggcgcggcgcacgacgactacggcttctcggcggagatacagacgctggggcgcatncggcaccggcacatcgtgcggctgctcgggttcgcggccaaccgggagacgaacctgctggtgtacgagtacatgcccaacggcagcctcggcgaggtgctccacggcaagaagggcggccacctgcagtgggcgacccggttcaagatcgccgtggaggcggccaagggcctctgctacctgcaccacgactgctcgccgccgatactgcaccgcgacgtcaagtccaacaacatcctcctcgacgccgacttcgaggcccangtcgccgacttcggcctcgccaagttcctccgcggcaacgccggcggctccgagtgcatgtccgccatcgccggctcgtacggctacatcgctcctgagtacgcctacacgctcaaggtggacgagaagagcgacgtctacagcttcggcgtcgtgctactggagctcatcaccggccgcaagccggtcggggagtttggcgacggcgtcgacatcgtgcagtgggtgcggatggtgaccggctcgagcaaggagggcgtgatgaagatcgccgacacccgcctctccacggtgccgctgtacgagctgacccacgtcttctatgtcgccatgctatgcgtcgccgagcagagcgtcgagcgccccaggatgcgcgaggtcgtgcagatcctggccgacatgcccggcccgacatcctcgtccgtcgacggcccccttgtcatcgagccgaaggaggactcgagcacggagaagccgccgcaggaagggccgcacgactccccgccgcagcaggatcttcttagtatctagaactagaagtggcaccggagggaattgaattggtcgtactagtagtagtactttgtagcatccccagtttttctggtgtctttcttgtgtagtgttgggcgtggagaggggtacgagtgtatgcaagaggtaacgtaacatgtaagcatgttcggttcgtaactagtacaaatctccgtgtcatgtagtatacaaagcaagctgtttgagcttcc

SEQ ID NO: 2450 - DNA, 802 bp, Sorghum bicolor
cgcgccagcgctcgcgcctgccacggcttccgtgcgaccccgcatccaccgccgcgtgtcccgctgcggacacggatgccgaggatggccgcagcgtccctggagccctagcgcccgcgctataaaagcggcagcagccgctcgcccttcttctacccgccgccgccgccatagccgactcgaagctccgcaccctcaccaagcgcctcgaccccgacctcgccccgcgcacctgcaccaccgagctcggtcacgccgtgacgccgtcgatcgccaccacgatgtcgcccgcaactgcgtcgcccgagcgtctcgtcctcggcaccacctcggcactcgcaccgcgccctcgccgagcagcagcagagccgcggccatggcctcgccctgccgacgccgccaagcaccactgcgcccgcctcggccgtgcccctacctctgtgtcaagcttcatcaccacgcgggggtcagccgcggtgccgtcctcgctgcgcagcggcctcgcccggcgacgtcgagcccgctgccctcgccgcgtcgagcttcgaccacggccggccgcgtggacgccacagcccggccgagcctctgcctcgccaccgtgggagtcgccgcggccacgacgccttcagccccggcgcccctccgcgtctacgacggtgtcgaccgcgagcccccgtgctgtcatggagcttacctcgtcgagccgacacgccgtcgacagagccaccgatgccgcgcgccgggcaccagagcaagccccttcgccgagcacccgatgcgccccgttgccgcggccacg

SEQ ID NO: 2451 - DNA, 1501 bp, Setaria italica
ccgatctcccaaacctgagcctaagcctgagcccaatcctcgcacgtttcttggccgagtgggggagaagattccagaaatggccgtcgccgtagccgccgggaccctccgtacctgttccggcgtatttccggcggcgtccgggaaccatccgcttgccgggtggcggccacttgcaccggcagcgcccgctaagctgagattattgtctccagctttgagggttcctagagctgcttcgcctgcagctgttgagaatgggagctctagcaacagtaatacagtccctaccccgaaagttataatagatcaagactcagatccggatgcaactattgttgaagtaaccttgggtgaccgtcttggcgatcttcttgatacaatgaatgccctgaagaacttagggctaaatgttgttaaagctagtgtctgccttgattctacgggcaagcataacaagtttgctataactaaagcgtccactggccgcaaaatcgatgacccagagttgttagaagcagtacgattgacgatcattaacaacatgatacaatatcatccggagtccagcagtcaattggctatgggggcaacatttgggcccgaagcccctgcagaacaggttgatgtggacatagcaacccacatagatatctatgccgatggccctgaaagaagcttacttgtggtggaaacagcggatcgtccagggttactggttgatcttgttaggatcatctctgacatcaacataactgtccaatctggagagtttgatactgaggggctattggcaaaagcaaaattccatgtcagttacaggggcaaacatttgactgaggctttgaaacagattctttctaatagcctgcgctatttcttgagacggccgacaacagaggatgccagtttctagccagataattatgaaggcccccacctgagatgggattcacatgaatctgatagtatcatcaaagttgttgaaataagcacaataaatttttaaaaagatggactgaggaggtatacttgatgtttggcatcacaccaatttaaggttaggcaaggaatctgctgtatgaagtgcagaagactgcgatgcctaaaacatgtaacgcatgattgttttgctacctgggatacattatttggtgataatgagatgggacattgtgggggccatcatccagtgtctggatcaaatgctgtgtttattttgtacatttcatcagattaatgaaattacagacaataatcttctgggtaacaactagatgaaatttctttgagagtgctgaacagtgacttagtccaaagggcaaccgtgggctagcagtcaattgtagttgaaaatgtaatatgtacttcagtacgatctttaaaagcatatttcttgaccattgtaacttcacctattggaaattcttataaaatcagcatggttttaaaaggactttgtatataaatccattgatgtgatttttcatatataaatttg

SEQ ID NO: 2452 - DNA, 1370 bp, Avena sativa
gagagggagagcacgagcccacctcccgtttccaccccctctatcctatggatagagccgccgcgacagccatagatatcatcgtcatgatcccatcagcgccttcgcctttgtagcaccacctcatccccccgtctcttggaccagatttgatctccatcctcgcacgttccttgggatttttttatatcctccaaggggggagaagatggcagaaatggccgtgaccgttgccgccgggaccctccgtccctgctccggcgtgtcgccggcggcgtccgggaatcgccggcttgccggctggcggccacttgcaccggcggcgcccgctaagctgagattgccatctccagctttgagggttcccagagctgcttcgcctgcagctgttgaggacgggagttctagcaacaccgatacagttcctacaccaaaagttataatagatcaagactctgatccggatgcaactattgtggaagtaaccttgggtgaccgtcttggggatcttcttgatactatgagcgccctgaggaatttagggctaaatgttgtgaaagctagcgtctgcctcgattcatctggcaagcacaacaagtttgctataacaaaatcgtcgactggtcgcaaaattgatgatccagagttgttagaagcagtacgactgacaattattaacaacatgctcgaatatcatcctgaagctagcagtcaattggccatgggtgctacttttggaatagagccccctacagaagtggttgatgtggacatagcaactcacatagacatctatgatgatggtcctgaaagaagtttacttgttgtggagtcagccgatcgcccagggttgttggttgaccttgttaagatcatagctgacatcaacatcactgtccaatctggagagtttgacactgaggggctacttgctaaagcaaaattccatgtcagttatcggggcaagccactgatcaaggctttgcaacaggttcttgctaatagcttgcgctatttcttgaggaggccaacaacagaggacgccagtttctaggcagatggttacaaatccccgccttaagataatcagtcagatgataattttatgaatttgacacttatcgtccactttatccttgaaatatgcataattcccaaaagacgggatgtatacatgatcttatggcgcatacaagtctgagctatcttcatttgaagttaggttgatgatgtatgaactgatgtagccttccaagcttacatgctggcatgattcttacgcatgtaacaaatgattattttgctacctgggatgcatgtttgattatatgaaataagatggcagacttgtggggccaatcatctgtttt

SEQ ID NO: 2453 - DNA, 1417 bp, Brachypodium distachyon
gagggagagcagaagaccacctcccgtttccacccccctctatcctatggatagagccgccgcgacagccatagatatcctcgtcatgatcccagcagcgccttcgcctttgtagcaccacctcatctccagtttcttggaccagatttgatcccatcctagcacgtttcttggatttcttttcgccaagaggggagatggtagaaatggccgtgaccgtcgccgccgggacccacaggccctgctcaggcgtctcgccggcggcgtccggcaaccggcggcttgccgggtggcggccacttgcgccggcggcgcccgctaagctgagattgtcctctccagctttgagggttcctagagcagcttcccctgcagctgttgaggatgggagctctagcaacactgatacagttcctaccccgaaagttataatagatcaagactcggatccggatgcaactattgtggaagtaaccttgggtgaccgtcttggggatcttcttgataccatgagtgccctgaggaatttagggctaaatgttgtgaaagctagtgtttgtcttgattcttctggcaaacataacaagtttgctataacaaaatcgtcgactggccgcaaaattgatgatccagagttgttagaagcagtacgactgacaattattaacaacatgcttgagtatcatcctgaaactagcagtcaattagctatgggtgcaacttttgggatagagcccccgacagaggtggttgatgtggacatagcaactcacatagacatctatgatgatggtcctgaaagaagcttacttgttgtggaatcagctgaccgtccagggttgctggttgatcttgttaagatcatcgctgatatcaatatcactgtccaatctggagagtttgatactgaggggctactggctaaagcaaaattccatgtcagttaccggggcaagccactgatcaaggctttgcaacaggtcctcgctaatagcttgcgctatttcttgaggaggccgacaacagaggatgccagtttctagatggatggttacaaatcgcacgtcgagataattcatgagatgatatttgcatgaattttggcactatcatccaagttattcttgaaatatgcataattcccaaaaggtgatatacacgatcttaccgcacatacagatctgagctattttcatttgaaggtagattgatcttgttgctgtatgaactgcggtagccttatgccggcacaattcttaagcatgtaacgcacgattattttgctacctgggaatgggatgcatgtttgatgataaaataagatggcaacttgtgcggccaatcgtctgttgctttggtgaataatatgcttgtgttgttcatttcattgtcagattaataataaaggttatgaact

SEQ ID NO: 2454 - DNA, 1488 bp, Panicum virgatum
gacagccgcagacatcctcgtcatgatcccatcgccttcgcattcgcctttgtagcaccgcctcctcatccgcccgctccctgtttcttggccactcgggttcctgtactggatcggattggatccccgtccgcccgtttcttggaggagagagatggccgaaatggccgtgaccgttgccgccgccgccggtaccctccggccgtgcactggcgtctcggcgcgcggtgccgcggttcttggccggtggcggcctcttgccctggcggcgcctgctaagctgagattgtccttttcagctgtgagggttcctagggctacttcccctgcggctgttgaggatgggagcaacaccgatacagatcctatcccgaaagttataatagatcaagactcagatccggatgcaaccattgtagaagtaaccttgggtgaccgtcttggtgatcttgttgatacaatgagtgccctgaagaacttggggttaaatgttgttaaagctagtgtctgccttgattctaccggcaagcataacaagttttctataactaaatcgtccactggccgcaaaattgatgacccagagttgttagaagcagtacggttgacgatcattaacaacatgatacaatatcatccggagtccagcagtcaattggctatgggagcaacatttgggccagaagtccctgcagaacaggtcgatgtggacatagcaacccatgtagatatctatgatgatggccctgaaagaaacttacttgtggtggaagccgctgatcgtccagggttacttgttgatcttgttaaggccatctccgataccaacgtaactgtccaatctggagagtttgatactgaggggctactggctaaagcaaaattccatgtcagttataggggcaaagctgtgagcaaggctttgcaacaggttctttctaatagcttgcgctatttcttgaggcggccgacaacagaagatgccagcttctagccagatagtatgctgaaatacgcacaataatgccccgcctcagtcatttacctaatttgtgtgatgggattcacatgaatgggatagtatgctgaaatacgcacaataattttttgaagatggatcagaggaggtatacttgatgctatggtgccacaccttatggtatttttccttggaatgaaggggaatctgctgtatgaagtttcaaagattgcgatgcttaaagcatgtaacacatgattatttgctacctggtgataaataagatggaacattgtgggggccatcatccaggtgcacatctggtgataaataagatggaacattttgggggccatcatccaggtgcacatctggtgataaataagatggaacattttgggggccatcatccacatccaatgttgggatagaatgctgtattcgttgtgtacatttaattatcagattaatgaagttacatatgttaatcttctgcttaacgattagac

SEQ ID NO: 2455 - DNA, 1330 bp, Triticum aestivum
gcacgagccaacctcccgtttccacctctctatcctatggatagaaccgccgcgacagccatagatatcctcgctatgatcccatcagcgccctctcctttgtagcaccatctcccctcccccaccccacccccgggtttatttgataagatttgatcccaatcctcgcacgtttcttggccgagtgggggagaagattccagaaatggccgtcgccgtagccgccgggaccctccgtacctgttccggcgtatttccggcggcgtccgggaaccatccacttgccgggtggcggccacttgcaccggcagcgcccgctaagctgagattattgtctccagctttgagggttcctagagctgcttcgcctgcagctgttgagaatgggagctctagcaacagtaatacagtccctacaccaaaagttataatagatcaagactcagatccggatgcaactattgtggaagtaaccttgggtgaccgtcttggagatcttcttgatactatgagtgccttgaggaatttagggctaaatgttgtgaaagctagtgtctgcctcgattcttctggcaagcacaataagttctctataacaaagtcgtcaactggtcgcaaaattgatgacccagagttgttagaagcagtaagactgacaattattaacaacatgcttgagtatcatcctgaagctagcagtcaattggccatgggtgcaacttttgggctagagccccctacggaagtggttgatgtggacatagcaactcacatagagatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcagatgattacaaacccacgccttatcatagctcatgagacatgatatttgtatgaagtttgcactatcatccaaattattcctgaaatatgcataattcccaaaaaagggaggtacacgatatatcatgtactcatagtttcatttgaaggcagcttcatgctgtatgaactgcactagccttccaagttaagttatgagatggcagtataacacatggttattttgctacccgggatgcatgtttgatgataaaataagagggccgcttgtgtggccaatcgtct

SEQ ID NO: 2456 - DNA, 1264 bp, Triticum aestivum
ccaccccacccccgggtttatttgacaagatttgatcccaatcctcgcacgtttcttggccgagtgggggagaagattccagaaatggccgtcgccgtagccgccgggaccctccgtacctgttccggcgtatttccggcggcgtccgggaaccatccgcttgccgggtggcggccacttgcaccggcagcgcccgctaagctgagattattgtctccagctttgagggttcctagagctgcttcgcctgcagctgttgagaatgggagctctagcaacagtaatacagtccctacaccgaaagttataatagatcaagactcagatccagatgcaactattgtggaagtaaccttgggtgaccgtcttggggatctccttgatactatgagtgccttgaggaatttagggctaaatgttgtgaaagctagtgtttgcctcgattcttctggcaaacacaataagttcgctataacaaagtcgtcaactggtcgcaaaattgatgacccagagttgttagaagcagtaagactgacaattataaacaacatgcttgagtatcatcctgaagctagcagtcaattggccatgggtgcaacttttgggctagagccccctacagaagtggttgatgtggacatagcaactcacatagagatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcatatgattacaaacccacgccttatcatagctcatgagacatgatatttgtatgaagttagcactgtcatccaaattattcttgaaatatgcataattccccaaaaagggaggtacacgatatatcatgtactcatagtttcatgtgaaggtagcttcatgttgtatgaattgcattagccttccaagttaagttatgagatggcggtataacacatggttattttgctacccgggatgcatgtttgatgataaaataagagggccgcttgtggggccaatcgtctaaaaaaaaaaaaaaaaaaacctgcccgggcggccgctcgaatcactagtgaattc

SEQ ID NO: 2457 - DNA, 1428 bp, Pseudoroegneria spicata
gagcggagggtgaggtgaggccgcgaggtcgagagggagagcacgagcccacctcccgtttccacctctctatcctatggatagagccgctgcgacagccatagatatcctcgctatgatcccatcagcgccctctcctttgtagcaccatctcccctcccccacccccaccccccggtttatttgacaagatttgatctcaatcctcgcacgtttcttggccgagtgggggagaatattccagaaatggccgtcgccgtagccgccgggaccctccgtacctgctccggcgtatttccggcggcgtccgggaaccatccgcttgccgggtggcggccacttgcaccggcagcgcccgctaagctgagattattgtctccaactttgagggttcctagagctgcttcgcctgcagctattgagaatgggagctctagcaacactgatacagtccctacaccgaaagttataatagatcaagactcagatccggatgcaactattgtggaagtaaccttgggtgaccgtcttggggatcttcttgatactatgagtgccctgaggaatttagggctaaatgttgtgaaagctagtgtttgcctcgattcttctggcaagcacaataagttcgctataacaaagtcgtcaactggtcgcaaaattgatgacccagagttgttagaagcagtaagactgacaattattaacaacatgcttgagtatcatcctgaagctagcagtcaattggccatgggtgcaacttttgggctagagccccctacggaagtggttgatgtggacatagcaactcacatagagatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcagatgattacaaacccacgccttatcatagctcatgagacatgatatttgtatgaagttagcactatcatccaaattattcctgaaatatgcataattcccaaaaaagggaggtacacaatatatcatgtactctagtttcatgtgaaggcagtttcatgctgtatggactgcactagccttccaagttatgagatggcagtataacacatggttattttgctatttgctaccgggatgcatgtttgatgataaaataagagggccgcttgtggggccaatcgtctattgtttggggcgtgttacttcgctggctaatctttccaaaagatacaaaaaaaaaa

SEQ ID NO: 2458 - DNA, 1388 bp, Triticum aestivum
tgtctctgtatatctggagcggagggtgaggtgaagccgcgaggtcgagagggagagcacgagccaacctcccgtttccacctctctatcctatggatagagccgccgcgacagccatagatatcctcgctatgatcccatcagcgccctctcctttgtagcaccatctcccctcccccaccccacccccgggtttatttgacaagatttgatcccaatcctcgcacgtttcttggccgagtgggggagaagattccagaaatggccgtcgccgtagccgccgggaccctccgtacctgttccggcgtatttccggcggcgtccgggaaccatccgcttgccgggtggcggccacttgcaccggcagcgcccgctaagctgagattattgtctccagctttgagggttcctagagctgcttcgcctgcagctgttgagaatgggagctctagcaacagtaatacagtccctacaccgaaagttataatagatcaagactcagatccagatgcaactattgtggaagtaaccttgggtgaccgtcttggggatctccttgatactatgagtgccttgaggaatttagggctaaatgttgtgaaagctagtgtttgcctcgattcttctggcaaacacaataagttcgctataacaaagtcgtcaactggtcgcaaaattgatgacccagagttgttagaagcagtaagactgacaattataaacaacatgcttgagtatcatcctgaagctagcagtcaattggccatgggtgcaacttttgggctagagccccctacagaagtggttgatgtggacatagcaactcacatagagatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcatatgattacaaacccacgccttatcatagctcatgagacatgatatttgtatgaagttagcactgtcatccaaattattcttgaaatatgcataattccccaaaaagggaggtacacgatatatcatgtactcatagtttcatgtgaaggtagcttcatgttgtatgaattgcattagccttccaagttaagttatgagatggcggtataacacatggttattttgctacccgggatgcatgtttgatgataaaataagagggccgcttgtggggccaatcgtctat

SEQ ID NO: 2459 - DNA, 1489 bp, Leymus cinereus x Leymus triticoides
  misc_feature (172)..(172): n is a, c, g, or t
  misc_feature (221)..(221): n is a, c, g, or t
  misc_feature (817)..(817): n is a, c, g, or t
ctcagaaagggacatcattgagagagaagagaggagtgtctctgcgtgcgtgtatatctggagcggagggtgaggtgaggccgcgaggtcgagagggagagcacgagcccacctcccgtttccacctctctatcctatggatagagccgccgcgacagccatagatatcctngttatgatcccatcagcgccttctcctttgtagcaccatctcccctccnccacccccacccccggtttatttgacaagatttgatctcaatcctcgcacgtttcttggccgagtgggggagaagattccagaaatggccgtctccgtcgccgccgggaccctccgtacctgccccggcgtatttccggcggcgtccgggaaccatccgcttgccgggtggcggccacttgcaccggcagcgcccgctaagctgagattgttgtctccagctttgggggttcctagagctgcttcgcctgcagctgttgagaatgggagctctagcaacactgatacagtccctacaccgaaagttataatagatcaagactcagatccggacgcaactattgtggaagtaaccttgggtgaccgtcttggggatcttcttgatactatgagtgccctgaggaatttagggttaaatgttgtgaaagctagtgtttgcctcgattcttccggcaagcacaataagttcgctataacaaagtcgtcaactggtcgcaaaattgatgacccagagttgttagaagcagtaagactgacaattattaacaacatgcttgagtatcatcctgaagctagcagtcaattggccatgggtgnaacttttgggctagagccccctacggaagtggttgatgtggacatagcaactcacatagacatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttacaggggcaagccattaatcaaggctttgcaacaggttctcgctaatagtttgcgttatttcttgaggaggccgacaacagaggatgccagtttctaggcagatgattacaaatccacgccttatcatagctcatgagacatgatatttgtatgaagctggcactatcatccaaattattcctgaaatatgcataattcccaaaaaagggaggtacacgatatatcatgtagtttcatgtgaaggcagtttcatgctgtatgaactgcactagccttccaagttaagttatgagctggctggattcttaagtatgtataacacatggttattttgctacccgggatgcatgtttgatgataaaataagagggccgcttgtggggccaatcgtctattgtttggggcgcgctactcctccgctggctaatctttttcaaaaaaaaa

SEQ ID NO: 2460 - DNA, 1988 bp, Hordeum vulgare
tcggcacggggctcccctcatcctccatttttacttacttctccaacccctcggaaagggacatcaccgagggagaagagaggagtgtctctgcgtgcgtgtatatctgcatcggagggtgaggtgaggccgcgaggtggagaggaagagcacgagcccacctcccgtttccacctctctatcctatggatagagcctccgcgacaaccatagatatcctcgttatgatcccatcagcgccttctcctttgtagcaccatctcccctcccccacccaccccccggtttatttgacaagatttgatctcaatcttcgcacgcttcttggccgagtgggggagaagattccagaaatggccgtcgccgtagccgcagggaccctccgtacctgctccggcgtatttccgccggcgtccgggaaccatcagcttgcccggtggcggccacttgcaccggcagcgcctgctaagctgagattattgtctccagctttgaggattaccagtgctgcttcgcctgcagctgttgagaatgggagctctagcaacactgatacagtccctacaccgaaagttataatagatcaagactcagatcctgatgcaactattgtggaagtaaccttgggtgaccgtcttggggatcttcttgatactatgagtgccctgaggaatttagggttaaatgttgtgaaagctagtgtttgccttgattcttccggcaagcacaataagtttgctataacaaagtcgtcaactggtcgcaaaattgatgacccggagttgttagaagcagtaagactgacaattatcaacaacatgcttgaatatcatcctgaagctagcagtcaattggccatgggtgcaacttttgggctagagccccctacggaagtggttgatgtggacatagcaactcacatagaaatctatgacgatggtcctgaaagaagtttacttgttgtggaatcagctgaccgtccagggttgttggttgatctagttaagatcattgctgacatcaatatcactgtccaatctggagaatttgacaccgaggggctactggccaaggcaaaattccatgtcagttaccggggcaagccattaatcaaggctttgcaacaggttcttgctaatagcttgcgttatttcttgaggaggccgacgacagaggatgccagtttctaggcagatggttacaaatccacactttatgatagttcatgatacatgatatttgcctgaagctggaactatcgtccaaattattcccgaaatatctgtaattacccaaaaaaagtgatgtacatgatatatcatccagtttcacgtgaagacaggttcgtgttgtatgatttgcgctattcttccaatttaaattatgagctggctggattcaagtatgtataacacatggttattttgctactcgggatgcatgtttgatgataaaacaagagggcgcttgtggggccaatcatttaaaagatggggctgcaataacgcccacacgtttgacaggagcaacaacaacccagaggcctaatagtcacaggttgtgacatgtcattgcatgcatgtacaagtgacggaattaatgacgtcattcgaatttttttgtctttttagttttaaaaatgttttatttcttaatcaaaaaatctaattggaaaattgtttttatcattaaatccgtcacagttgagatgtttgaaactagatctcatgtcgatatgtttcgacgactttttttattaaaagttgtcacgttcattgcgcataaattgccatcgtaattatactaaagttgtcatgatatgtttcaactactttttttatgtttaaagtaaactttgacttgttataaaaaggaaattaacaaattaaacttggcatgatgaattactgagatttttcatgatccatgaaataattttgacatggttcaaagtaaaaaaagaaatatgccgttaattagtttaaaaa

SEQ ID NO: 2461 - DNA, 2078 bp, Hordeum vulgare
tcggcacggggctcccctcatcctccatttttacttacttctccaacccctcggaaagggacatcaccgagggagaagagaggagtgtctctgcgtgcgtgtatatctgcatcggagggtgaggtgaggccgcgaggtggagaggaagagcacgagcccacctcccgtttccacctctctatcctatggatagagcctccgcgacaaccatagatatcctcgttatgatcccatcagcgccttctcctttgtagcaccatctcccctcccccacccaccccccggtttatttgacaagatttgatctcaatcttcgcacgcttcttggccgagtgggggagaagattccagaaatggccgtcgccgtagccgcagggaccctccgtacctgctccggcgtatttccgccggcgtccgggaaccatcagcttgcccggtggcggccacttgcaccggcagcgcctgctaagctgagattattgtctccagctttgaggattaccagtgctgcttcgcctgcagctgttgagaatgggagctctagcaacactgatacagtccctacaccgaaagttataatagatcaagactcagatcctgatgcaactattgtggaagtaaccttgggtgaccgtcttggggatcttcttgatactatgagtgccctgaggaatttagggttaaatgttgtgaaagctagtgtttgccttgattcttccggcaagcacaataagtttgctataacaaagtcgtcaactggtcgcaaaattgatgacccggagttgttagaagcagtaagactgacaattatcaacaacatgcttgaatatcatcctgaagctagcagtcaattggccatgggtgcaacttttgggctagagccccctacggaagtggttgatgtggacatagcaactcacatagaaatctatgacgatggtcctgaaagaagtttacttgttgtggaatcagctgaccgtccagggttgttggttgatctagttaagatcattgctgacatcaatatcactgtccaatctggagaatttgacaccgaggggctactggccaaggcaaaattccatgtcagttaccggggcaagccattaatcaaggctttgcaacaggttcttgctaatagcttgcgttatttcttgaggaggccgacgacagaggatgccagtttctaggcagatggttacaaatccacactttatgatagttcatgatacatgatatttgcctgaagctggaactatcgtccaaattattcccgaaatatctgtaattacccaaaaaaagtgatgtacatgatatatcatccagtttcacgtgaagacaggttcgtgttgtatgatttgcgctattcttccaatttaaattatgagctggctggattcaagtatgtataacacatggttattttgctactcgggatgcatgtttgatgataaaacaagagggcgcttgtggggccaatcatttaaaagatggggctgcaataacgcccacacgtttgacaggagcaacaacaacccagaggcctaatagtcacaggttgtgacatgtcattgcatgcatgtacaagtgacggaattaatgacgtcattcgaatttttttgtctttttagttttaaaaatgttttatttcttaatcaaaaaatctaattggaaaattgtttttatcattaaatccgtcacagttgagatgtttgaaactagatctcatgtcgatatgtttcgacgactttttttattaaaagttgtcacgttcattgcgcataaattgccatcgtaattatactaaagttgtcatgatatgtttcaactactttttttatgtttaaagtaaactttgacttgttataaaaaggaaattaacaaattaaacttggcatgatgaattactgagatttttcatgatccatgaaataattttgacatggttcaaagtaaaaaaagaaatatgccgttaattagtttaaaaattcatgatcactggttcaaatttgtcatgaaccataaatttcgtcatggtgaattacttaaattgccatgatacatgcactaatatctat

SEQ ID NO: 2462 - DNA, 1113 bp, Pennisetum glaucum
ggtgcgcagtgctgcggttcttggccggtggcggcctcttgccccggcggcacccgctaagctgagattgtcctctccagctgtgagggttcctagggctgcttcccctgcggctgttgaggatgggagcaacactgatacagtccctatcccgaaagttataatagatcaagactcagatccggatgcaactattgttgaagtaaccttgggtgaccgtcttggcgatctactcgatacaatggatgccctgaagaacttagggctaaatgttgtcaaagctagtgtctcccttgattccacgggcaagcataacaagttttctataactaaaacgtctaccggccgcaaaattgatgacccagagttgttagaagcagtacgattgacgatcattaacaacatgatacaatatcatccggagtccagcagtcaattggctatgggggcaacatttgggcccgaagcccctgcagaacaggttgatgtggacatagcaacccacatagatatctatgccgatggccctgaaagaagcttacttgtggtggaagcagcggatcgtccagggttactggttgatcttgttaggatcatctctgacatcaacataactgtccaatctggagagtttgatactgaggggctattggcaaaagcaaaattccatgtcagttataggggcaaatctttgactgaggctttgaaacaggttctttctaatagcctgtgctattccttgagacggccgtcaacagaggatgccagtttctagccagataattatgaaggcccccacctgagatgggaatcacatgaatctgatagtattatcgaagttgttgaaatacgcacaataatttttaaaaagatggactgaggaggtatacttgatgttatggcatcacaccaatttatagttaggcaaggaatctgctatatgaagagcagaagactgcgattccaaaaacatgtaacacacgattatttcacctgtgatgcattatttggagataataagatggaacattgtgggggccatcatccagtttctggatcaaatgctgtgtttattttgtacatttcatcagattaacgaaattacaaacaata

SEQ ID NO: 2463 - DNA, 1801 bp, Zea mays
gagagagagagagagggagaagaaaatcacaagaggaaagagagggagaagaaaatcacaagaggagggaaacagcgagtaagccactttagcgttcaatctcattgcttggtgtgttaggtttgttttctctctctacgtactgttggcattttccttgagaagacaaaatatgttctttaggggaccagagcaacagcaccatcatcatcaccctctttctctctctagattagagcaatctttctctctcaaaaaaaactgcaatgatcaactttaccacaccctcctcttcctttgatgatccttgccgcctttgcccccctctttgccctttattccctgcctctagttgctttgcttgccgctaacgaactgctttccattgctaggtcctagccccctcttccagcaacacgcaatgcccgcagccatagctgcacctgctagcctagccatgaaggagttctcgtacgaggaggtggaggcggcgacgggcgggttcgcggccaagaacctggtgggaaagggcagccacggcagcgtgtacagggccaggctgaaggaagaaggcggcaggacggccgtcgtcgccgtgaagcggccgtcgcacgcgcagggggaggccaagctcggcaacgagatcgccgtgctctcggccgccccgcgccacccgggggtgatcggcatcgtcggggtttcgtcgtcccccgccggcgccgccgcgccggggcctcggctgcctccgctgctcgtcatggagttcatgcccaacgggtcgctgcacgacctgctgcaccggtcgccgaggccgccgccgtggccgcgccgcgtggagatcgcgctggacgtggcgcgcgccgtgcgggcgctgcacgccgcggcgccgcgcgtcatccaccgggacgtgaagtccgccaacgtcctcctcggccgcgacggccgcgcccggctcgcggacttcagcctcgccgtcagcgtccaggacgacgacgaaggagaaggctcggcgtcggcggggccagcgccagcgccagccccggcgggcacgatcgggtacctggacccctgctacacggaggccgggcggctgggccccgcgagcgacgtgttcagcttcggcgtggtgctcctggagctggtgagcgggcgcagggtgatggacgtggactcgtgcccgtcgtccatcgtgtcctgggccgcgccgctgatcggcgccgggcgcgcgcgggaggtgctggacggcagggtggccgcgccgcccacggcgtgcgcggaccgcgtcctcgccgtggcggcgcggtgcgtgtcggacagcgcggagctgcggccggccatggacgaggtggtgtccgagctgcgcggcgcgctcgagagcgccgggtggcggcgccaccgcgacggcggcgtggtggagcgggtgtgcaggcgcgtcgcgtcgtggggccagcgcgcgcggcggaggagcaagaggagggtgcgggccacggccaccaaggtcgagtgcgccgagcactccggcggcggcgtagcactagcagtagcacccgatcgcgacggctcgtcgcggaacaacggcatggtgagcggcgcggcggcacactcgaaagcagaagaggacgcgttggctcgattcgagagcgaattggatctcgttttcaggtagttgattggtaaaacctttggacggatgtttactgttgcttgctactgttactgtcacagcgcgcagttaggagactgactgactgactaatctacggctgtttaatttgatcgttgttcacctcgtgcaagagac

SEQ ID NO: 2464 - DNA, 1617 bp, Zea mays
ttgagaagacaaaatatgttctttaggggaccagagcaacagcaccatcatcatcaccctctttctctctctagattagagcaatctttctctctcaaaaaaaactgcaatgatcaactttaccacaccctcctcttcctttgatgatccttgccgcctttgcccccctctttgccctttattccctgcctctagttgctttgcttgccgctaacgaactgctttccattgctaggtcctagccccctcttccagcaacacgcaatgcccgcagccatagctgcacctgctagcctagccatgaaggagttctcgtacgaggaggtggaggcggcgacgggcgggttcgcggccaagaacctggtgggaaagggcagccacggcagcgtgtacagggccaggctgaaggaagaaggcggcaggacggccgtcgtcgccgtgaagcggccgtcgcacgcgcagggggaggccaagctcggcaacgagatcgccgtgctctcggccgccccgcgccacccgggggtgatcggcatcgtcggggtttcgtcgtcccccgccggcgccgccgcgccggggcctcggctgcctccgctgctcgtcatggagttcatgcccaacgggtcgctgcacgacctgctgcaccggtcgccgaggccgccgccgtggccgcgccgcgtggagatcgcgctggacgtggcgcgcgccgtgcgggcgctgcacgccgcggcgccgcgcgtcatccaccgggacgtgaagtccgccaacgtcctcctcggccgcgacggccgcgcccggctcgcggacttcagcctcgccgtcagcgtccaggacgacgacgaaggagaaggctcggcgtcggcggggccagcgccagcgccagccccggcgggcacgatcgggtacctggacccctgctacacggaggccgggcggctgggccccgcgagcgacgtgttcagcttcggcgtggtgctcctggagctggtgagcgggcgcagggtgatggacgtggactcgtgcccgtcgtccatcgtgtcctgggccgcgccgctgatcggcgccgggcgcgcgcgggaggtgctggacggcagggtggccgcgccgcccacggcgtgcgcggaccgcgtcctcgccgtggcggcgcggtgcgtgtcggacagcgcggagctgcggccggccatggacgaggtggtgtccgagctgcgcggcgcgctcgagagcgccgggtggcggcgccaccgcgacggcggcgtggtggagcgggtgtgcaggcgcgtcgcgtcgtggggccagcgcgcgcggcggaggagcaagaggagggtgcgggccacggccaccaaggtcgagtgcgccgagcactccggcggcggcgtagcactagcagtagcacccgatcgcgacggctcgtcgcggaacaacggcatggtgagcggcgcggcggcacactcgaaagcagaagaggacgcgttggctcgattcgagagcgaattggatctcgttttcaggtagttgattggtaaaacctttggacggatgtttactgttgcttgctactgttactgtcacagcgcgcagttaggagactgactgactgactaatctacggctgtttaattt

SEQ ID NO: 2465 - DNA, 2852 bp, Zea mays
gcagccatggcgactcgcgccggacgactgcccaccactccggcgcccgctcttctgctcctcctcgccttcccgtttctgctgcagggagttcttccgtcgcgagccggggacaccgtcgccgccggccgcccgctgtccggcggacagagcctcgtgtccaagcgtggcaagttcaggctcggattcttccgcccaggtgcaacagacaactcgagccagcgctggtacctgggcatctggtacaaccagctctcggtgcacaccacggtgtgggtggcgaaccgggggacgcccatctccgacccggagtcctcgcagctatctatctccaaggacggcaacatggtcgtcctcgaccacagcaggtcgtctaccgccgtctggtccaccaacgtcaccaccggcgtctcctccacgtccacggtcggcgtcatccgcgacaacggcaacctcgtcctggcggacgcgtccaacacttccgcggtgctgtggcagagcttcgaccactcgggcgacacgtggctccccggcgggaagctgggccggaacaagcgcacgggcgaggtcacgcgcctcgtggcgtggaaggggcgcgacgacccgacgccgagcctgttcgcgctggagctggacccgcgcggctccagccagtacctgctcaactggaacgacagcgagcggtactggaccagcggcaactggacggggacggcgttcgctgccgtgccggagatgacgtccaccggcgcgtcgcccgtgtccgactacaccttcggctacgtcgacggcgccaacgagagctacttcacctacgacgtcgcggacgagtcggtggtgacgcggttccaggtggacgtgacggggcagatccagttcctcacgtgggtggcggccgccgcccagtgggtgctcttctggtcggagcccaagcggcagtgcgacgtgtacgcggtgtgcgggcccttcggcctgtgcaccgagaacgcgctgccgtcctgcacctgcccccgggggttccgggagcgcgacctggccgagtggatgcaggacgaccacaccgcgggatgcgccaggaacaccgcactccagccttgcggcgccggcgccgccgctcgagacgggcagaagcgccgcagggacgacgataggttctacacgatgcccgacgtgaggctgccgagcgacgcgcggagcgcggcggccgcgagcgctcacgactgcgagctcgcgtgcctccgcaactgctcttgcaccgcttactcctacagcggcggctgctcgctgtggtatggggacctcatcaaccttcaggacacgacgagcgctggcagtggcaccggaggcggcagcatctcgatccgcctcgctgcctccgagttctctagcaacgggaacaccaagaaactggtcatcgggctcgtcgtcgcgggctcctccttcgtcgccgcagtcaccgccatcgttctggctaccgtcctcgttctaaggaaccgaaggatcaagtcgttgaggacggtccaaggatccctggtggcgttcacgtaccgcgacctgcagctggtgaccaacaacttctcggagaagctcggcggcggcgccttcgggtccgtgttcaaaggggtgctgcctgacgcaacgctcgtggcggtcaagaagctggaaggcgttcggcagggggagaaacagttccgcgccgaggtgagcacgatcggcacgatccagcacgtgaacctgatcaggctgctcgggttctgctccgaggggtcgaggcggctcctcgtctacgagcacatgccaagcggctctctggacaggcatctgttcgatcgggaccagcagccgggtgtcctgagctgggacgccaggtaccagatcgctctcggggtcgcgagggggctggactacctgcacgagaaatgcagggactgcatcatccactgtgacatcaagcccgagaacatcctcctggacgacgcgttcgtccccagagtcgccgacttcgggctcgccaagctcatgggtcgcgacttcagccgcgtgctcaccaccatgcggggcacggtggggtacctggcgcccgagtggatcgccggcacggccgtcaccaccaaggcggacgtgttcagctacggcatgatgctgttcgagatcatctcgggccggaggaatgtcggccagcgggcggacggcacggtggacttcttcccgtccacggccgtcaaccggctcctcgacggcgacgtgaggagcgcggtggacagccagctcggcggcaacgcggacgtggccgaggtggagcgggcctgcaaggtggcgtgctggtgcgtgcaggacgcggagagcttgcgcccgagtatggggatggtggtgcaggttctggaggggctggtcgacgtcaatgccccgcccgtcccgaggtcgctcatggtgctcgccgatccgtccaagtacgccgttgagttcttctcaggtttgccgtcgacctgagattgggccgctgcctctgcctgttaggggcatcaactttgatcagtagtgcatggtgtatatacgagctaatgagttcgtcaagaacttactcgtgccacgaaccctgtggcggtatagaacttctgcacgtagccaagaagatttcggatctgttagggcttgttcggttacctctcaatccatgtggattgagagtgggattagatggttttaatcccaaacaagtcaaacttcttctcaattttttccaatctcatccaatccatgtgtattaggaataaccgaacaagcccttaaggtgccaaaaaacgtcacatatttcttgccacacgtgcatgaggttatatgctttggagaat

SEQ ID NO: 2466 - DNA, 2849 bp, Zea mays
cggccagcagccatggcgactcgcgccggacgactgcccaccactccggcgcccgctcttctgctcctcctcgccttcccgtttctgctgcagggagttcttccgtcgcgagccggggacaccgtcgccgccggccgcccgctgtccggcggacagagcctcgtgtccaagcgtggcaagttcaggctcggattcttccgcccagacaactcgagccagcgctggtacctgggcatctggtacaaccagctctcggtgcacaccacggtgtgggtggcgaaccgggggacgcccatctccgacccggagtcctcgcagctatctatctccaaggacggcaacatggtcgtcctcgaccacagcaggtcgtctaccgccgtctggtccaccaacgtcaccaccggcgtctcctccacgtccacggtcggcgtcatccgcgacaacggcaacctcgtcctggcggacgcgtccaacacttccgcggtgctgtggcagagcttcgaccactcgggcgacacgtggctccccggcgggaagctgggccggaacaagcgcacgggcgaggtcacgcgcctcgtggcgtggaaggggcgcgacgacccgacgccgagcctgttcgcgctggagctggacccgcgcggctccagccagtacctgctcaactggaacgacagcgagcggtactggaccagcggcaactggacggggacggcgttcgctgccgtgccggagatgacgtccaccggcgcgtcgcccgtgtccgactacaccttcggctacgtcgacggcgccaacgagagctacttcacctacgacgtcgcggacgagtcggtggtgacgcggttccaggtggacgtgacggggcagatccagttcctcacgtgggtggcggccgccgcccagtgggtgctcttctggtcggagcccaagcggcagtgcgacgtgtacgcggtgtgcgggcccttcggcctgtgcaccgagaacgcgctgccgtcctgcacctgcccccgggggttccgggagcgcgacctggccgagtggatgcaggacgaccacaccgcgggatgcgccaggaacaccgcactccagccttgcggcgccggcgccgccgctcgagacgggcagaagcgccgcagggacgacgataggttctacacgatgcccgacgtgaggctgccgagcgacgcgcggagcgcggcggccgcgagcgctcacgactgcgagctcgcgtgcctccgcaactgctcttgcaccgcttactcctacagcggcggctgctcgctgtggtatggggacctcatcaaccttcaggacacgacgagcgctggcagtggcaccggaggcggcagcatctcgatccgcctcgctgcctccgagttctctagcaacgggaacaccaagaaactggtcatcgggctcgtcgtcgcgggctcctccttcgtcgccgcagtcaccgccatcgttctggctaccgtcctcgttctaaggaaccgaaggatcaagtcgttgaggacggtccaaggatccctggtggcgttcacgtaccgcgacctgcagctggtgaccaacaacttctcggagaagctcggcggcggcgccttcgggtccgtgttcaaaggggtgctgcctgacgcaacgctcgtggcggtcaagaagctggaaggcgttcggcagggggagaaacagttccgcgccgaggtgagcacgatcggcacgatccagcacgtgaacctgatcaggctgctcgggttctgctccgaggggtcgaggcggctcctcgtctacgagcacatgccaagcggctctctggacaggcatctgttcgatcgggaccagcagccgggtgtcctgagctgggacgccaggtaccagatcgctctcggggtcgcgagggggctggactacctgcacgagaaatgcagggactgcatcatccactgtgacatcaagcccgagaacatcctcctggacgacgcgttcgtccccagagtcgccgacttcgggctcgccaagctcatgggtcgcgacttcagccgcgtgctcaccaccatgcggggcacggtggggtacctggcgcccgagtggatcgccggcacggccgtcaccaccaaggcggacgtgttcagctacggcatgatgctgttcgagatcatctcgggccggaggaatgtcggccagcgggcggacggcacggtggacttcttcccgtccacggccgtcaaccggctcctcgacggcgacgtgaggagcgcggtggacagccagctcggcggcaacgcggacgtggccgaggtggagcgggcctgcaaggtggcgtgctggtgcgtgcaggacgcggagagcttgcgcccgagtatggggatggtggtgcaggttctggaggggctggtcgacgtcaatgccccgcccgtcccgaggtcgctcatggtgctcgccgatccgtccaagtacgccgttgagttcttctcaggtttgccgtcgacctgagattgggccgctgcctctgcctgttaggggcatcaactttgatcagtagtgcatggtgtatatacgagctaatgagttcgtcaagaacttactcgtgccacgaaccctgtggcggtatagaacttctgcacgtagccaagaagatttcggatctgttagggcttgttcggttacctctcaatccatgtggattgagagtgggattagatggttttaatcccaaacaagtcaaacttcttctcaattttttccaatctcatccaatccatgtgtattaggaataaccgaacaagcccttaaggtgccaaaaaacgtcacatatttcttgccacacgtgcatgaggttatatgctttggagaat

SEQ ID NO: 2467 - DNA, 4082 bp, Oryza sativa
gagagagagagagagccacttgcgtgctggcctctctcactgttgtgattggtgccacctcctcctcctctgcctctctcctctcctcttctcccccaatccctcctcctcctccaccatcgctgctgctctgctgctactactctcttcctcctcctccgctatctactgctccctcctctcttgtttttcttttctctcctccttttccacccaccgcaccacctcgctcgctttcctcctctcgatcgatctcctccaatcccgcagagtcaaagatttgctccaagaacggcggatgacaaggcttccggggatgtagcttcttgcggcggcggatggatgagatgagctgcggcggcggaggtggtggagcgaggtggaagagggcgcgggtggcggggatgggcgaggggaaggcgggaggaggtggtggcgcggcgttcttggggctggagagggtggggatggtggtgcggatgctgccggtgccggagaaggtgtcggcgagggcgcgggtggtgagggggagcctggtggcgcacttccgggggtggagggtggtgcgggagacgtggtggtgggtgctgctgctgtggatcctcgccggctccctcggctccttctacctcttcctcttcatgaacgcccagtccctcgacaagcgccgcgactccctcgccagcatgtgcgacgagcgcgcccgcatgctccaggaccagttcaacgtcagcatgaaccacctccaggccctcgccatcctcgtctccaccttccaccactccaagaccccctccgccatcgaccagatgacgttcgcgaggtacgcggagaggacggcgttcgagcggccgctgacgagcggggtggcgtacgcggtgcgggtgacgcacggcgagcgggagcagttcgagcggcagcaagggtgggcgatcaagaagatgtactcctcctccaacaagaagcagtcgtcgccggggcccgggcccggcgacgccgccgtcgcggagatccgggagcccgccgaggagtacgccccggtcatcttcgcccaggacgcctacaagcacgtcatctccttcgacatgctctccgggaatgaggatcgggataacatattacgggctaggaaatctggcaagggtgtcctgactgctcctttcaagctactgaataatcgcctcggagtgatcttgacgtacactgtttataagtatgagctccctgcatatgccaggccacatgaacgcatccaagccgcgattggctatttgggcggcatatttgacatacaagcactcgtcgagaagttgctcaaacaactcgcgagccaggaatccatcatggtgaatgtgtatgatacgaccaacgagagcccgatcagtatgtacggtgatgatactgggagtggcatgtgccatgtcagcgtgctcaactttggtgatccgtcgagaaagcatgagatgcattgcaggtttgaaaaaaagccaccatggccatggctggcaataacgtcatcgtttggaactcttgtgattgctttactgactggtcacatatttcaagctactgtccatcggattgctaaagttgaagatgatttccacaagatgagcgaactcaagaagcgtgcagaagatgcagacgtcgcaaagtcacagttcttggctactgtttcacatgagatcagaactccaatgaatggtgttctagggatgctccaaatgctcatggatactgatttggacacgacgcagcaggactatgttagaactgcccaagctagtggaaaagctttggtctctctcatcaatgaggttcttgatcaggcaaagattgagtctggtaaacttgagctcgagacggtgccctttgatcttagaacagtttgtgacgacattttatctctgttttgtgggaaagctcaggagaaaggactggagttagcagtgtatgtctcggatcaagttccacagatacttattggcgatcctggcaggataagacaaatcattacgaatcttgtcgggaactccataaagttcacagagagagggcatatatacctgacagttcatgtagttgaagaggtcatgagttgtttggaggtagagacaggaattcagaacacaaacactttaagtggctatccagtagccaacagaagatgtagctgggagagcattcggcttttcaacagagaattacactcatctgagaagtcttttgcgcccatcgcatctgattcaataagcttggttatatctgttgaagatactggcgtcggcatcccatttgaagcccaatcccgtgtgttcacccctttcatgcaggtaggtccatccattgcccgcatccatgggggcactggcattggattaagcatcagcaagtgcttggttggtctcatgaagggagaaatcggttttgcaagtaagccccatgttggttctactttcaccttcaccgcggtgcttatgagggcacactgcaaaggaaatgacatcaaatcatcagaatttaaagggatcaatgcattggttgttgatcataggccagtccgtgcaaaggttaccaagtatcacttgcaaagacttggagttaagaccgaactgacagctgagctaaatcagttcatttctaaattaaactctggatcactgactgcaaagctagtgctaatagacaaggaaacctggcttaaggaatcccattgcacgcctcttctggttaacaaattgaggaataatgacaagccagactctcctaagttatttcttttggggagctctgcaagttctcccaagggcggttcagatacatccagggaacataacttgaatgtaataatgaagccgcttcgtgcaagcatgcttcaggtctcactacgacgagcactaggtggggtcgataaggtgcactgcaggaatggagtagttggcaattcaacattgggcagccttcttcacaagaagcaaatcattgttgtcgacgacaatatcgttaacctgaaggtggctgctggtgctcttaagaagtatggtgccgaagttacttgtgcagacagcgggaaaaaagcaatcacattgctaaaacccccgcacaattttgatgcttgtttcatggacatacagatgccagaaatggatgggtttgaagccactagaaggattagagtgatggaaagagatctaaatgagcgaatagaacgcggagaggcgccaccagaatgtgctagtattcagaggtggcgaactcctatattggcgatgacggcagatgttatacaggcaacacacgaggagtgcctgaaaagcgaaatggatggctatgtctccaagccatttgaaggggagcagctgtacagcgaagtagcgcggtttttccaaaatcatgaccaagttgaataggaaggtttatatggaatgtaaattggtggaggatgttgccacgcaccgatcacatgccatggcacagaattttgtccaagatgctgtgttcccaagagaatgaagcacaaaaggtgtcgagatggaaccgcccatgttctgatctgtagtacaccatctgacctagaggcaaaattaactgcgcaattacatgagaacaagatacatgtgcagcaaaggtactcaaacaatttcttgaagtcaaggcgtgtgaaaatggcagctgcatattcactaactgcagaagaagcagaagtcgttctcgtagatgccctctgcctttgtaatataaacgtagggagagaaaatttttcctgtcttctttttttttcctcgggaattttacggtgtacatattaggtgttggtgatatgtgcaggcaattccttggtatatttggatgtgttttttttttctgcaaggtttgtggaagctgtaaatgacacaattcaaaggtgaagcctttggtttcttccattgacatttttgacaagaatattgatgccgtcggctctcggctgttcttttgcatgtccttatcgccctgaagtttctaattaactttctcctaatctcttatgtaacacctatcattattccactgaatgctgcctgatgttctggttttttgtg

SEQ ID NO: 2468 - DNA, 4131 bp, Brachypodium distachyon
ctcctcctccttctccttttccgcctccacttcaaacctcacctcacctcacctgctttctctctcgttctctctctctgctccaatcaacccaatccctttcccccattccttcctgtagtctgttcctgttgctgttgctgctcttctcccttcgcttcgctcctctcgggctctcgcctctctgcaggttgttggtcaaacgcgcgcaggatcgctcgcggggattttggttgtttggtggctgcgcgcgctccttccttcatcgcaggtgcgccgcgggacgggcgccgagaagaggaagcggaggaggacagcgcgctcgagcgtgttggctggctggctcccttttggctttggggcattcgattccaaggacggtgaggccttccaggggcggcgctgctgctgctgctgattcgtcctcgtcgtgctgctgcttgcttgcgcatacatgcgctgcggcggcggagcgggagcgtggcgggaggggagcgtggtgctcgctgtcgctggtggcgatgtagccgaatgaccggcgctcggttggcgagaggcggcggcggggcggccgggacgacgacgatggaggcggagaaggggggcggagcggggattggggtgggcttcctggggatggggctctacaggctgcggctgctgccgctgccgccgctgccggagaagctgtcatcggccaagacgctgcggagccacgtgtacgccaactacctgggctcccgccccgtgcgggagcgctggtggcgctggctgctgctgctctgggtcctcggctggacgctcgcttcctgctggatcttctactacgagaactcccaggccgtcgagaagcgccgggagtccctcgccagcatgtgcgacgagcgcgcccgcatgctccaggaccagttcaacgtcagcatgaaccacctccaggcactcgccatcctcgtctccaccttccaccacgcccagactccctccgccatcaaccaggcgacgttcgcgaggtacgcggagaggacggctttcgagcggccgctgacgagcggggtggcgtacgcggtgcgggtgacgcacggcgagcgggaccagttcgagcggcagcaagggtggagcatcaagaagatgtactcgtccaagaagaagtcgccggggccggggccgggggacgccgccaccgcggagatccgcgagccggccgaggagtatgcccccgtcatcttcgcgcaggacgcctacaagcacgtcctctccttcgatatgctctccggcgatgatgatcgtgaaaacatactaagagctagagaatctggaaagggtgtcctaactgcacctttcaagctactgaataatcgcctcggtgtgatctcgacatacacggtgtacaagtctgagtttcctgcatatgcgaggccgcaggagcgcatccaagctgccatagggtatttaggtggcatatttgatatagaagcacttgttgataagttgcttcatcaacttgcgggcaagcaatccatcatggtgaacgtgtatgatactacaaatgagaagccaatcagtatgtatggttcaaatgatactggcggtggcatgtaccataacagcacactcaacttcggagatccatctagaaggcacgagatgcattgcaggttcatgcaaaagccaccattgccatggcttgcaataacatcatcactaggaactcttgtgattgctttacttactggttatatatttcacgctaccgtgcatcgtatcgcaaaagttgaagatgattatcaaaatatgatggagctcaagaagcgtgcggaagctgcagatattgccaagtcacagttcttggccacagtttcacatgagatcaggactccaatgaatggtgttctaggaatgctccaaatgctcatggatactgatttggacacaacacaacaagactttgtcagaaccgcccaagcaagtggaaaagctttagtatccctgataaacgaggttcttgatcaggcaaagattgaatctggcaaactcgagcttgaggcagtgccatttgatcttagaatagtttgtgatgacattttgtctctcttctgtggaaaagctcaggagaaagggctggagttggcggtttatgtctcggatcaagttccgcaaacactcattggcgatccgggcaggatgaggcaaatcattacaaatctcatgtcgaactccataaaattcacagaaagaggacatatctacttgacagttcatgttgttgaagaggtcatgggctgtttagaggtcaagacgggaactcactacacaaacaccttaagtggctacccagtagctaacaggaggcgtagttgggagagctttcgactttttgatatggatttacactcatctgagatgccttttactcctgtcacacctgacacaataaggttgataatatcagtcgaagacaccggtgccggcatcccttttgaagcccaataccgcatattcaccccttacatgcaggttggtccgtccattgcgcgcatccatgggggcactggcattggattgagcattagcaagtgcctggttcatctcatgaaaggagagatcgggtttgtaagcaaaccccatgttggttctactttctcattcactgctgttctcacgagggcacagtccaatggaaatttgaacaaatcgtcagggtttaaagggatcaatgcattggtagttgatcacagaccggtccgtgccaaggttgccaagtaccatttgcaaaggcttggagtccaaacagaattgaccactgacgtcaatcaaattattcctaaattgaactgtggaccattggctgcaaagttggtgctagttgacaaggaaacctggctgaaggaatcacattccatgcctcatttggttagcaaattgaggaacaaggatcaggcagaccctccaaagttctttcttctggagaaccctacaagttctataaagagcagttcacatatatccagcgagcataacttgaatgttatcaagaagccacttcgtgcaagcatgctccaggtctcactaaggcaggctttgggtggagtagataaggtgcattgcaagaatggagtggtcggcaattcaacgttgggtagccttcttcacaagaaacaaatcattgtggttgatgacaatgctgtgaaccttaaagtggcggctggtgctctcaagaagtatggcgcagtagtaacttgtgcagacagtgggaagaaggctattgcgtatttaagcccacctcacatctttgatgcttgtttcatggatatacagatgccagaaatggatggatttcaagcaaccaaggagatcagaaagatggaaagtaaactcaatgagaaaatagaaagtggagatgtaccaccagaatgtgttaatgttcggaggtggcgaactccaatattggccatgacagcagatgttatccaggcaacatatgaggagtgcctgaaatgtgaaatggatggctatgtctctaagccatttgaaggagagcagttgtacagagaagtaactcgttttttccaaaatcatgaccaagttcaataggtaggtctatatggagtgtaaattaatggaggatgtcccaacacagttgacgcgtcatggcgccgagaatttttttgaagctgcagttctccaagagtatgggctcaaaaacctggagttggaaccagccaagttctgtttcttggtacatcatctcaccaagaggcaaaaggagcataaaactcttaaatcgagaggcatgtgtagcattttattcagcaacttcttggagacagttcgcgtgaagggccaactgcattcactaactgcagatttcaaattgacaaatgtcctctgcctttgtattgtaaatgtagggagagaaaattttccttcatctttcttccccggggattttataggtgtaaatactaggtcttggtggttgtgcaggcatttcttttttttgcatttgaatgtgtttttttgcgcagtgtgtcgaaagctgtaaatcacacattcaaagctgaagcctttcattttcttgatctcccagctgtgatatttgctgtccttgtcaggttctcaacctgaagtttc

SEQ ID NO: 2469 - DNA, 3332 bp, Pennisetum glaucum
acgaggaccgcgaaaacgtactccgagcgagagaatctgggaagggtgttcttactgcaccctttaagctgctcaataatcgcctcggcgtgatctccacctacaccgtgtacaagacggagcttcccccgaatgccagcccgcaagagcgcattcaggctgctataggctatttgggcggcatttttgacattgaagcacttgttgataagttgcttcaccagctcgcaggcaagcagtccatcatggtgaacgtttatgatactactaacgagagcccgatcagtatgtacggttccaatgacactgccagtgacatgtgccatgtcagcacactgaactttggcgatccgtcaaggaagcatgagatgcactgcaggttcatgcagaagccaccggtggcgtggctggcaataacgtcatcatttggaagtcttgtgattgctttactggttggatacatatttcatgctactgtcaaacggattgtcaaagttgaagacgactatcaacggatgatagagctcaagaaacgcgcagaggctgcagatgttgccaaatcacagttcttggctacagtttctcatgagatcagaactccaatgaatggcgttctagggatgctccaaatgctcatggatactgatttggacacgacgcaacaggattatgttaggactgcacaagctagtggaaaggctttggtctcactcataaacgaggttcttgatcaggcaaagatcgagtctggtaaactcgagcttgagatggtgcccttcgatcttagaacagtttgtgatgatattttgtctctcttttgtgggaaagcccaggagaaagggctagagctggcagtgtatgtttctagccgagttccagaaacactaatcggtgatcctggcagaatgaggcagatcattactaatctcgttgggaactccataaaattcacagagaggggtcatatctacttgacagttcatctcgttgaagaggtcatgcattgtttggaggttgagacaggaactcagaatgcaagtactttaagtggctatccggtggtgaacagaaaacgcagttgggaaaactttcgactttttaatatggagctgaactcatctgaagtgccttttgcacctgttggatctgactcagtaagcttggtaatatctgttgaagatactggtgttggtattccgttcgaagctcagtcccgtgtcttcacccctttcatgcaagtaggtccatctatttctcgcatccatgggggcactggtattggattaagcatcagcaaatgcttggttggtctcatgaagggagagatcggatttgcaagtaaacctcaagttggttctactttcaccttcactgcagtgcttacgaaggcttattccagcggaattgagaataagtcatcagaatttaaagagataaacgccttggtggttgaccatagacttgtccgagccaaggttaccaagtaccatttgcagagactgggagttcagactgaattgacagctgacctggatcaatatatttctaaagtaaatagtggattacggattgcaaagcttgtgctgattgacaaagaaacctggctgaaggaatcccattccattcctctgctagttagtaaattgagcaacaaagatcaaccagactctacaaagttatttcttttagagaaccctaaaaattctcttaggaccaaatcacatatatccagagaatgcaacttgactgtaattatgaagccgcttcgtgcaagcatgcttcaggcctcactacagagagcgttgggcgggatagataaagtgcattgcaggaatggagtagttgggaattcaacattgggaagccttcttcacaagaagcaaataattgtggttgacgacaatattgtaaatctcaaggttgctgctggtgctttgaagaagtatggtgcagaagtaacttgtgctgacagtgggaaaaaagcaattgcactgctgaaacctcctcacaattttgatgcttgtttcatggacatacagatgccagagatggatgggtttgaagccacaagaaggattagattgatggaaagtgatctaaatgagcaaatagaacgtggacaggtcccaccagagtgtgcaaacatccggcggtggagaactccaatattggccatgaccgcggatgtcatccaagcaacacatgaacattgcttgaaatgtgaaatggatggttatgtttccaagccatttgagggtgagcaactgtacagtgaagtagcccgtttttttctaaatcaagaccaagttctgtaggtaggttcatatggaatgtaaaatagtggaggatatcgccaacagtacaaccgtcgatgcagagagttctgtcaaagatcccatgttctgaagagtgggcagcagtttgcagagttaggggccctattaaaacgctagaatgctgggatgtggctgcagttaggtggaacatttcaggctggagatggaaccacaaatgttcaattccttggtgcaccatcttagggctgcaaacctgaatgtgcaatttcttgaaggcgtgtgaaaaagtcgagcagcattcaccgactgcagatgtcctctgccactgtaatatagacatagaaggagatttttgttccgctcttagcccgggaacttacagctgtacatattaggtcttggttgtttgtgcaggcatttttgtatgcatcttcttcgccgtgtacatgggtggaagctgtaaattgtaaatgacacattcaaagatggaagttttgtttttcgatagcaaaagcaacgagttttcttctgactcaattggagtagcaaaactttcaataaggtgcaaaagacaggtaatgtaaccaacggcccccaacagtactcaatattggaaacaagtactttgccttaacggcaggacaccagacagcacaaaataacacctaaaatccagtatggaaatgactcgcacaagtccaaccacaggaagaaaaaaggagcaatactgtcatgtgccaataacctctggaaacaccacacacacaattgcaaactgtagaacgtttgtctttcaaaagttaggagataatgctttcagtcagtgttaacgcagcaagctgactggtcgggtgtttggattctgctgatgggctacattgcggagaacatccatcgcctcatcaaccttggacttgagagcctcaggggactcgagcaggtggagaacctcagtctgatccatctccagaagcattccggtgaccttggccgcttggtttggttccagttgctcaaccagtgggtataggtttt

SEQ ID NO: 2470 - DNA, 4067 bp, Zea mays
ttatgcctgtatcttagcaatgtatttattgttgagactgaggatcctcatttgtttctcaagggtatgcaagtagctgccgctagagcattctcagcattgtgtttcattgcatataaggcccaacctcagttgatggaaaatgccagctttacaagtgatgtttctgagatacggagattggaatcaaatatatcctgcattctagatgaggatgataaaaataatgattgtttggttgtggctgtattcaaccttttgacatctgctgctcgttatcaggtgttacaattcacatgtgaattaacctggtatatttgttttttgcagcctgcttttcttatttccttgatagagcagagtacgaagtcaactgatcataatgcttccaccaatgatcgtgacaatagagttttggttacttcaaaaagtaatgctagacttgttgaccaaatcttggactatattgataggtccattgagctcatgaatagatctcccttggtgttactcagtattctggacttgttgaaggcactatgggaaagtggtatacgatttttgtttattttagagaagctaagaagctctgtaacattctgggataacttatcacggtgtattcgtgctacacttgatatctcccctattgacaatattgatgccattgacgagaaattttcgttaaggtaccattgtcagggtaaaatatttgagatcatgtcacacgagttatttttgcaaggaaaattgcttacagagacttctaatactgtccaagatgatccaaaggggcaaaaagagcataaaagtgggccttgtcgtatcagtgtagtcttgaaatggttcgataatgctattttggccgatctggtcagtaatttgtcaagtaatgcatacaaaaaggaacttcatcatgcaaaggtagctgcctgcctatgtatcatccatttaataacaaagttgtcaaccggtgatactgggagcttgtctttctcattcatgaagaaaattcagatcatatcaacaaaagtaaggcatctatgagactttgatgttggtttgttggcatcaccttgtttacactgtcttgcttctgtttgttttctagaaaagtacttcacctccaatgttttttggtgtcagttgtatggaaaaattagactaggacatgttgttgcagcaccatgcatttttagctctcctgtcacagtattccctgcatggatacaggtaaccttcttagttttcggtgaacaagaacttaataatttggttctcaatgatctttattaccttatacgtggagaactcgaaggacgtcagattagctctggcccttttcaggagttgctcagttttcttcttgggtttagaatttttgaacacaatcccttggagcaactacaaaacacatacctgatggcaaatgacaaatttttatttgatgtggagcacatacatgacgagcttggagttgatctctggactgattcagacaagaggtctaaagaagtagctaaaaaaatgctggatattatgagtaaagcaaatttaatgaagtattatgctgatgcaaaactttctgcattgatgtccttcttgaaatttttatctgtctacaaaggagcgatttctaacaaaaacttggacttacctgatggaggcatatcagtagcggccacacaatcagcaattaaatgtgcatgtaaatcatttgagtcaactgttgattcactgctgcctcaagctcatacagatgaggttttgtttcccctcttgtccgggcaagtggaattattgcttactttggcccgaatattgtttcatcaagcaaagaacaagaaatcaagccatctctgtccagatattgtacttctaatgaaaacttcaggtgccagcacttgtttgtttgttgatctcatgccatctgctcatgctcttaagcaaccagtgaagacacttcttgttctgcttttgtcgtcatatgagttcatgtacagcaaggttgacataaaagacctaccaaatgatattaacatttttggcgaattagcccttttaagtgtgagcttgctacctatactgtgcaaattggcagagaatagggaatgctctgatcttgctgttgcatcaatggacctaatattgaagggatctgtaccttctaatttatggatgcctattctgcaaaagcattttcatctccagactatactgcataaatgccagaatggtgatttattatctactcaagttatacttaatttcctcttgaccttggggcgaacaaaggatggtgctaaagttcttcagtctgccaatatttttgcattcttaaagttacttttgagtcagttgtctctggatgactcctgtttgagaaattccttgagcgcccaagtgaaggatgtgaacctatggggcttgggtctcggtattgttgcgtccctgaaccattgtttggatgatgacatttctcataacaatgtcgtgagcaacactatcagcttcctttcaggacatgtgcctttggtgtcatcatatctgtctacacagagtgctactactcatcagagcaagaaacgggcattgtcgcagaagtcacagacatcgctttcagcccttagtcttactgagaatattctcatacttctatgcatcttggcaaaataccattttccacgggacactggaaagaaggaagtagattcagaactaagagagattattatccacctgctagcatttataagcaaaggaagtgtaaagactggcaatgcctctaaatggaactcatcgtttttctgccctgctgttatcaaagaggaagtagcgcttaatgagaaaccaccactcatttgtagcaagtatgggtggttcagatttgcagcaagttgtactttgtcaactgcaggtgtttcagtttctcccagtgcagctttatcagtggtgagacgggacaagacttcaggagattctgattctataaggcagactcgttttactgagatattagctgttcagatatacaggattgcttttcttatcatgaagtttctctgtagtcaagcaaaagaagcagtaaaaagggcagaagaactggagtttcttgacctcgcccattttcctgagcttcccatgccagatattcttcatggtttacaggatcaagtggtttgtattgtcactgaaatattcgaggcaaatgggtcaagcactctaaatcccgagacagagaaggtatgccagctcctattggtgacacttgaaacgtcactttacatggaactatgtgtatcccaatcatgtggcatcaggccagtacttggtcggcttgaagatttctgcaaaggaattaaggctatgcttcaagctatagagaagcactccagttttgaaccttttgtcaggtcgctaactgaaattacttctcttttgtatcccgggcttttgcataataaccttctcatgtgactcttgtaaattgtcactgttaaagagatgtgttgttggctaactttgaattgagccacatatggacttgcatactcagttgacgtcacccgaggaagcttcgttttcgcacgttactgtcaccaaagtaaagtgggttccagcggctacgaagcaaattcgcagagccagggcaccaaatcaaactgaaggcgacgacgcccgaggaagcttcgttttcgcatcacctttgttcggtttcacagccgaggctcccaaagtggccagagaatcttggtggacttgcctttccgggactccacactgccgaccacgcttattcacccgtgtaaattatgctgggattctcctttgctggctcgtctggccgatgtgcgtcccatcatcacagagaactagaaacaaatgatacatatgtagatgctatgcgttcttgatcaatcagacacgcattttttttctgtagaggaatacatgttcggcgcgttgcatctttacactaccatttgtttgccttctccatcctgtttaagccctgtttcaaaacgctaccatgcaaattaaccctaagggataatttgggagccgta

SEQ ID NO: 2471 - DNA, 2964 bp, Saccharum officinarum
  misc_feature (362)..(362): n is a, c, g, or t
  misc_feature (698)..(698): n is a, c, g, or t
  misc_feature (944)..(944): n is a, c, g, or t
  misc_feature (1203)..(1203): n is a, c, g, or t
  misc_feature (1625)..(1625): n is a, c, g, or t
atgtcacatgagttattcttgcaaggaaaattgcttgctgagacttctaatactgtccaagatgatccaaaggggcaaaaagagcataaaagtgggccttgtcatagcagtgtagtcttgaaatggtttgataatgctattttggacgatctgatcagtaatttgtcaagtaatgcatacaaaaaggaacttcttcatcatgcaaaggtagctgcctgcctatgtatcatccatttaataacaaagttgtcaactggtgatactgggagcttgtctttctcattcgtgaagaaaattcagatcatatcaacaaaattgtcacagcaccatgcattcttagctctcctgtcgcagtattcccngcatggatacagtggtgaacaagaacttaataatttggttatcaatgatctttattatcatatacgtggagaactcgaaggtcggcagattagctctggccctttccaggagttgctcggttttcttctggagtttaaactttttgaacacaatcccttggagcaactacaaaatacatacctgatgccaaatgacaaatttgtatttgatgtggagcacatacatgacgagcttggagttgatctctggactgattcagacaggaagaggtctaaagaagtagctaaaaaaatgctggatattatgcgtaaagcaaatttaatgaagtgttatgntgatgcaaagctttctgcattgaggtccttcttgacatttttatctgtctacacaggagcggtttctaacaaaaacttggacttacctgatggaggcatatcagtagcggccacacaatcggcaattagatatgcatgtaaatcattcaagtcagctgttgattcactgcttcctcaagctgacacaaatgaggttttgtttcctctcttgtccggacaagtggaattattgctaactcttgcccnaatattattttatcaagcaaagaagaacaagaaatcaagccatctctgcccagatattgtacttctaatgaaaacttcaggtgccagcacttcttttcttgttgatctcatgccatctgctcatgctcttaagaaaccagtgaaggcacttcttgttctgcttttgttgtcatatgagttcatgtacagcaaggttcacataaaagacctaccaaatgatgttaacatgtttggcgaattagcccttttaagtgtgagnttgctacctatactgtgcaaattggcagagaatagggaatgctctgatcttgctgttgcatcaatggatctaatattgaagggatttataccttctaatgtatgggtgcctattctgcaaaagcattttcatctccaggctatactgcataaatgccagaatggtgatttgttatctactcaagttatacttaatttcctcttgaccttggggcgaacaaaggatggtgctaaagttcttcagtctgccaatatttttgcattcttaaaggtacttttgagtcagttgtctctggatgactcctgtttgagaaattccttgagcgcccaagtgaaggatgtgaacctatggggcttgggtctcggtattgttgcgtccctgaaccattgtttggatgatgacatttctcataacaatgtcgngaacagtactatcagcttcctttcaggacaggtgcctttgatgtcatcatatctgtctgcacagagtgctgctactcatcagagcaagaaacgggcattgtcgcagaagtcacagacatcactttcagcccttagtcttactgagaatattctcatacttctatgtatcttggcaaaatatcattttccacgggacactggaaagaaggaagtagattcagaactaagagagattattatccacctgctagcatttataagcaaaggaagtgtaaagactggtgatgcctctaactggaactcatcgtttttctgccctgctgttatcaaagaggaagtagcgctcaatgagaaaccaccactcatttgtagtaagtatggatggttcaaatttgctgcaagttgtactttgtcaactgcagctgtttcagtttctcccagtgcagctttatcggtggtgagaagggacaagagttcaggagattctgattctataaggcaaactcgttatactgagatattagctgttcagatttacaggattgcttttcttattatgaagtttctctgtagtcaagcaaaagaagcagtaaaaagggcagaagaactggagtttcttgaccttgcccattttcctgagcttcccatgccagatattcttcatggtttacaggatcaagtggtttgtattgtcactgaagtatttgaggcaaatgggtcaagcactctaattcccgagacagagaaggtatgccagctcctattggtgacacttgaaacgtcactttacatggaactatgtgtatcccaatcatgtggcatcaggccagtacttggtcggctcgaagatttctgcaagggaatgaaggctatgcttcaagctatagagaagcactccagttttaaaccatttgtcaggtcgctaactgaaattactacacttctgtaccccgggcttttgcatagtaaccttctcatgtgactcttgtaaattgtctctttgttaaagaaatgtgttggctactccactaaccataaaatccaacacaataacaaccccataatcctaatcggtcgcgcgtccacacacgcacacatctttagcccctccacatccccgcaaatccacatcaacaaacatacacctcaactcccaaggtagtaccaaagccatattacaacaagggtgtcacctattagccttacgacacaaactcaacagacaataccagtaccacctcctaacccaccatacgcaaccacgcaacaaaccctcaaaactccaacctcacactgtatcaagatctacatctacggacacaaccacaaacacgataaa

SEQ ID NO: 2472 - DNA, 3861 bp, Zea mays
ttatgcctgtatcttagcaatgtatttattgttgagactgaggatcctcatttgtttctcaagggtatgcaagtagctgccgctagagcattctcagcattgtgtttcattgcatataaggcccaacctcagttgatggaaaatgccagctttacaagtgatgtttctgagatacggagattggaatcaaatatatcctgcattctagatgaggatgataaaaataatgattgtttggttgtggctgtattcaaccttttgacatctgctgctcgttatcagcctgcttttcttatttccttgatagagcagagtacgaagtcaactgatcataatgcttccaccaatgatcgtgacaatagagttttggttacttcaaaaagtaatgctagacttgttgaccaaatcttggactatattgataggtccattgagctcatgaatagatctcccttggtgttactcagtattctggacttgttgaaggcactatgggaaagtggtatacgatttttgtttattttagagaagctaagaagctctgtaacattctgggataacttatcacggtgtattcgtgctacacttgatatctcccctattgacaatattgatgccattgacgagaaattttcgttaaggtaccattgtcagggtaaaatatttgagatcatgtcacacgagttatttttgcaaggaaaattgcttacagagacttctaatactgtccaagatgatccaaaggggcaaaaagagcataaaagtgggccttgtcgtatcagtgtagtcttgaaatggttcgataatgctattttggccgatctggtcagtaatttgtcaagtaatgcatacaaaaaggaacttcatcatgcaaaggtagctgcctgcctatgtatcatccatttaataacaaagttgtcaaccggtgatactgggagcttgtctttctcattcatgaagaaaattcagatcatatcaacaaaattgttgcagcaccatgcatttttagctctcctgtcacagtattccctgcatggatacagcggtgaacaagaacttaataatttggttctcaatgatctttattaccttatacgtggagaactcgaaggacgtcagattagctctggcccttttcaggagttgctcagttttcttcttgggtttagaatttttgaacacaatcccttggagcaactacaaaacacatacctgatggcaaatgacaaatttttatttgatgtggagcacatacatgacgagcttggagttgatctctggactgattcagacaagaggtctaaagaagtagctaaaaaaatgctggatattatgagtaaagcaaatttaatgaagtattatgctgatgcaaaactttctgcattgatgtccttcttgaaatttttatctgtctacaaaggagcgatttctaacaaaaacttggacttacctgatggaggcatatcagtagcggccacacaatcagcaattaaatgtgcatgtaaatcatttgagtcaactgttgattcactgctgcctcaagctcatacagatgaggttttgtttcccctcttgtccgggcaagtggaattattgcttactttggcccgaatattgtttcatcaagcaaagaacaagaaatcaagccatctctgtccagatattgtacttctaatgaaaacttcaggtgccagcacttgtttgtttgttgatctcatgccatctgctcatgctcttaagcaaccagtgaagacacttcttgttctgcttttgtcgtcatatgagttcatgtacagcaaggttgacataaaagacctaccaaatgatattaacatttttggcgaattagcccttttaagtgtgagcttgctacctatactgtgcaaattggcagagaatagggaatgctctgatcttgctgttgcatcaatggacctaatattgaagggatctgtaccttctaatttatggatgcctattctgcaaaagcattttcatctccagactatactgcataaatgccagaatggtgatttattatctactcaagttatacttaatttcctcttgaccttggggcgaacaaaggatggtgctaaagttcttcagtctgccaatatttttgcattcttaaagttacttttgagtcagttgtctctggatgactcctgtttgagaaattccttgagcgcccaagtgaaggatgtgaacctatggggcttgggtctcggtattgttgcgtccctgaaccattgtttggatgatgacatttctcataacaatgtcgtgagcaacactatcagcttcctttcaggacatgtgcctttggtgtcatcatatctgtctacacagagtgctactactcatcagagcaagaaacgggcattgtcgcagaagtcacagacatcgctttcagcccttagtcttactgagaatattctcatacttctatgcatcttggcaaaataccattttccacgggacactggaaagaaggaagtagattcagaactaagagagattattatccacctgctagcatttataagcaaaggaagtgtaaagactggcaatgcctctaaatggaactcatcgtttttctgccctgctgttatcaaagaggaagtagcgcttaatgagaaaccaccactcatttgtagcaagtatgggtggttcagatttgcagcaagttgtactttgtcaactgcaggtgtttcagtttctcccagtgcagctttatcagtggtgagacgggacaagacttcaggagattctgattctataaggcagactcgttttactgagatattagctgttcagatatacaggattgcttttcttatcatgaagtttctctgtagtcaagcaaaagaagcagtaaaaagggcagaagaactggagtttcttgacctcgcccattttcctgagcttcccatgccagatattcttcatggtttacaggatcaagtggtttgtattgtcactgaaatattcgaggcaaatgggtcaagcactctaaatcccgagacagagaaggtatgccagctcctattggtgacacttgaaacgtcactttacatggaactatgtgtatcccaatcatgtggcatcaggccagtacttggtcggcttgaagatttctgcaaaggaattaaggctatgcttcaagctatagagaagcactccagttttgaaccttttgtcaggtcgctaactgaaattacttctcttttgtatcccgggcttttgcataataaccttctcatgtgactcttgtaaattgtcactgttaaagagatgtgttgttggctaactttgaattgagccacatatggacttgcatactcagttgacgtcacccgaggaagcttcgttttcgcacgttactgtcaccaaagtaaagtgggttccagcggctacgaagcaaattcgcagagccagggcaccaaatcaaactgaaggcgacgacgcccgaggaagcttcgttttcgcatcacctttgttcggtttcacagccgaggctcccaaagtggccagagaatcttggtggacttgcctttccgggactccacactgccgaccacgcttattcacccgtgtaaattatgctgggattctcctttgctggctcgtctggccgatgtgcgtcccatcatcacagagaactagaaacaaatgatacatatgtagatgctatgcgttcttgatcaatcagacacgcatttttttttctgtagaggaatacatgttcggcgcgttgcatctttacactaccatttgtttgccttctccatcctgtttaagccctgtttcaaaacgctaccatgcaaattaaccctaagggataatttgggagccgta

SEQ ID NO: 2473 - DNA, 2998 bp, Pennisetum glaucum
ggtccactgagcccataaatagatcgccttccgtgctacttagtattctgacttactcaaggccctatgggaaagcggtattcaatttttatgtgtattggagaagctgagaagctctgtaacattctgggataatttatcaaggtgcattcgtgctacacttgatatctgcccagttgactgcattgctgctgttgatgagaatttttcattaaggtaccactgtcagggtaaaattttcgaaattatgtcacatgagttgttcttgcaaggaaaattgcttgcagagacttctaatcctaccccaaatggttcgaagggacaagagcacggcgcaccttgtcgaagcagtgtagtcttgaaatggtttgatactgctattttggatgatctgatcaatcatttgtcaagtaatgcatacaataaagaacttcttcatcgtgctaaggtggttgcctgcctttgtaccattcatctgataacgaagctgtcaactggtgatactggaagcttgtctttctcagtggttaagaagattcagatcatatcagcaaaattgtcacagcaccattcattctcagctctcctgtcgcaatattctcagcatggatacagtggtgaacaagaacttaataatttgattatcaatgatctttactatcacattcgtggagaacttgaaggtcgtcagattagctctggcccttttcaggagctgcttagcttccttcttgagtttaaactttttgaacatgatcccttggagcaatgcgcagtggcaaatgccaaccttttgttcaacgttgaacacatacatgacgagattggggttgatctttggattaattctgaccgtaagactttaagagtagctcaagaatgctggatattatgcataaatcaatctgatgaaatgttatgctgatgcaaagctttctacattgagatccttcttgacatttttatctgtctacacaggagcgagctccaacaaaaacttggacttgcccaatggagggatttcagtaccagccacacaatcggcagttaagtgtgcatgcaaatcattccagtcaaccgttgattcactacttcctcaagttgatacaaatgaggttttgtttcccctcttatctgggcaagtggaattattgcttactcttgcccggatattatttgatcaagcaaagaaaaataagaaatcaagccatctctatccagatattgtacttgtaatgaaaacttcaggtgcgagcacttcgttcttggttgatctcttgtcatccactcatgctcttaagcaatcagtgaaggctctccttgctctgcttttgtcttcatatgagttcatgtacagcaaggttggcataaaagacctaccagacaatgttaacatgtttggtgaattagccgttttaagtgtgagtttgcttcctgtgctgtgcaaattggcagagaatggggaattctctgatcttgctgttgcatcaatggacttaatattgaagggatttgtaccttctgaagtatgtgtgcctattcttcaaaagcattttcatctccaggctatattgcataaatgccaacatggtggtttattgtctactcaagttatactgaatttccttttgaccttggggcgaacaaaggatggtgctacagttcttctgtctgccaatatttttaccttcttaaaagtacttttaagtcagttgtctctggatgactcctgtttgagatattccttgagcgcccaagtgaaggatgtggatcagtggggtttgggtcttgctattgttgcgtcactgaaccattgtttggatgatgatatttctcgtaacaatgttgcaagcagtactatcagcttcctttccggacaggtgcctttgatgtcatcatatctatccgcacagagtgttacggctcaccagaacaagaaacgggcattgtcgcagaagtcacagacatcactttcagccctcagtcttactgagaatattctcatacttctctgtattttggcaaaatatcattttccacgggacactggaaaaaaggaagtagattcagaactaagagagattattatccacctgctagcatttgtaagcaaaggaagtgtaaaggctggcaattcctctaattggaactcgtcttttttctgccctgatgctgccaaggaggaactagtacttaatgagaaaccaccacatattcgtagcaagcatggatggttcaaatttgctgcaagttgtactttgtcagtcgcaggtgcttcagtttctgccagtacagcattacctctagtgatcagagacaagagttcaggagattctgattctataaggcaaactcgttttactgaaatgatagctgttcagatttataggattgcttttctcatcatgaagttcctctgcagtcaagcaaaagaagcagtaaaaagggcagaagagctggagtttcttgaccttgctcattttcctgaacttcccatgccagatattcttcacggactacaggatcaagtggtttctattgtcactgaagtgtttgaggcaaaggagtctaacactctaaatcctgagacagaaagagtatgccacctcctcttggtaacacttgaaatgtcactttacatggaactatgtgtatctcaatcttgtggtatcaggccagtgcttggtcggtttgaagatttctgcaagggaattaaggctatgcttcaagctatagagaagcactccagttttaaagtactggtcaggtcgcttactcaaattactactcttctgtatcccgggctcatgcaaactaaccttctcatgtaattcttgtaaattgtatctttgttaacgtgttatagttcaatcactgttgttatctttttctagcatggttaagctgtcttgcagatccatgttacgtgagcaaaacacatgtttcgcaaggcgagccctttgtactaaagaaaaaccgtttgtatatgtatatatgg

SEQ ID NO: 2474 - DNA, 4597 bp, Sorghum bicolor
aatgccgaagacaatgagtacccatctggagtagcaccttctttggagtttctaattacatcaaaggatattactggatctggtgcatcctcgactttgctcattttcaacaatgagaggggattctcatcgaccaatatagattccatttgtcgtgtcgggaaatcaacaaagaagggaagcagacaccatggttacattggagagaaaggtattgggttcaagagtgttttcttgatatcaagccagccccatatatttagtaatggttaccagatcaagttcaatgagaaaccctgtgctgaatgcaatattgggtacattgtccctgagtgggtggaatctggacctacactttcagatatcaaagccatatatggatgctccaaaatcctacctacaaccacaatcatcttgccgttgaagagcgagaaggttgatgcagtgaagaaacagctgtcaagcttgcatcctgaaatgctactgttcctatcaaaaatcagaaagctttctgtccaggagcataactctgatccaaagagtatcactgttagcgagatctcaatttccagtgaaaagaactaccaagccagaaagaacatgcatgctgagtcttatacactccatttatcatctgaagagagtggaaaaggagaagaagaatgtggttattatatgtggaagcagaaattcccagtcaagccagagtatagagttgataaacgtgctgaaatcgacgaatgggtgataaccctggcctttccacatggtcagcgtctgtcccgtgggaagcaactatcacctggagtctatgctttcctccctactgaaatggtaacaaatttccccttcatcatccaggctgacttcctccttgcatcgtcaagggaggcaatactgttcgacagtctatggaacaagggaattctcgagtgtgttccaagtgctttcatgaatgctcttgtaacacttgtgaagtccagagctgatgcacctgcaatgtgtctgccatcaatgttcaatttcctacctgtcaattcttcattgattccactgcttgagccagttaggtctagcatcaaatacaaggttctcgccgaggatatagttccatgtgaatcttatgcttcacagaagatattctgcaagcccagtgaagttgcacggttgaagccagccttttggactatccttggcaaagcacgggaatctggtgtagatttgaagagtctgtcaactcatggaacctacattcttagttcccattttgacaatagtagatacaacagtgtgcttgagtttcttggtatcaaaagcgtgagcactgaatggtacgcaaaatgcattgaagggtctaatcttgtcaaggaggtacatgaggagctttacctggaaattttacactttgtcgcgagtaattggggaaactatttttctggtacaaatatgatgtctgttcccctactgaaatatgcctgtcattgcttttgcacacgttctgtaccactcatttaagatgaattacatagagaagtactgcttatcagaactcttccgttacatgcccgtaattgacagcggtggctgtgttgtgaaggaaagaaaaagcattatagttccggctaaggggagcaaatgggctgatttgctgggttcaaacccatggaggaatatagggtacattgagttgctagcgtcaggaggccactttgctgggaactacacatctaaggatcagctgttggaatttctcaagatacatctgcatgcctcagatgtgccattcatacgcccaccaaatgcaaggttccatactgtctcatcgcctctcacagtggacaatgcattcttgctactggaatggatacggaatatcaagtcagatggtgtaagtttaccagatcgattcctggcttgtgtaaaagaagggaattggctaaagacatcggttggatacaagccaccaaatgaatcatttctgtccagtgctaactggggaagtcttttgcaaagtggaacttcattcattgatataccaatgattgaccaacaattctatcgaaacaagctgcatatgtacaaacaggaactcaaggcaattggggtgagatttgaatttcaggaggcatcatcttatattggaagccgcctcatgtctatggctgcaagcaacgtgttagccagagactgtgtgtactccttgcttcggctcattcggttcctacgagagaaggttctatctccaagtcaattgattgacagtgcgtcttctgattgtatcatcaaagattcagaatgggcagtggcatcttgtatcagtgaccaaccattccttgatgtcaagttctatggagagggcatcctttcatataaatcagagctggagttgcttggtgttattgttgggttcaaaaacaattaccatcttgttattgataacttcaagttcagatcctctgctattacttctgagtctactgtattaatcctcaaatgcatccgttatgttagttcatgtcaagatttcataaagaagcttagagatttgaaatgggtgaagactaatgtgggattttgtgctccaaatgtctcttttcttgtggattctgaatgggagtgccttgtgcagatcttcaaagaagttccaataattgatttaggattttatgggagtgtgatcagttcatacaaagaagagttgaagaaggccggtttgatcacacgatttgaggaggcatcgatagctatagccaatgttttcaatcgcatggtatctgagtcatcacttacgaaggctaatgtcctagctctactactagcttatcggcagctgagaacacacaggccacttcctgttgagcttttcaactgcatgcgcacagagaagtggatacacacatcactagggtttcaatctccgtcaaatacaatcctatttgataatgcatggcaatatctatctcccatagcaatactaccgttcattgatgatggtgacacttgtaatggtttggggaccgatatatacggttataaagatgagcttagggagttgggtgttactgttgaagtgaaatttggtgccagatttgtccttgctggcctcagcattcctcatgatccttccattatgtccaaagctaccattttgtcgtttctggagtgtatcaagaactactttgcctctgcaactgaacctccgaagggctttaaagaccagatttccaagaagtggttgaagacatccttgggctaccaatgtcctgctgaatgtattctctttgatgcaaaacaatgttttctacagatggaagatggccctttcattgatgaagcattctatggttcagacatagcttcattcaaacatccccttgcgatgattggagtgactgtggatgttaattgtgcacaagatcttattgcccggtatatgaggaacaaaaaagatacaaatactatttcccggatctacatgtatctgaagaaatgtaactggaagcctgacaaaaataacaacagaaaatggatttggataccaaaggaaacagagggtggagactgggtgagctcaaaaagttgtgttctgcatgataagaacaatctatttggcctgcagctgcatgttctggacaaatattatgacagaaagctgcttgacttcttttcacttgctttcagtgtcaggcatggaccttgttctgaagactattgcaaactatgggccacatgggagagttcagtccatgagctagccatatccgattgctttgctttctggaaattcattgcaacgaactggaccaagaaaacagaggaacttctttctggttgtgtcaaggttccagtatgtactgatggcaagatcattttaataaacaaggagaatgtgttcattcctgatgatctactgcttgcagatttgttcagtgagcatcctcagcaatcgctcttcatctggtatgcttcttctgctgtaccttccatgtctcgagcaaggttcaactgcatatatggtagtatcggtgtcaagacaatctcaaaagcagtcaccaagaatgattccttcccttcagctaatagccgtttcaaaacagtggttctgagtaaggtgatcaagtttgggttgctccaaatagtcctcgcattcctttcgaatcctgcttttgacattcctgctgaagataggcacaagatggtttcttgcctcctgaatgtgactatcgaagagaccgatgaaccgatcacaatggcatacagtgtgagtttgtcctctggagaggtggtggaggtgaaggccagacgaatgcttcgctgggaaagggagaattcaaagctgtacatgcagagaactggtggcgcatccagctacaaagacaagattgaatttgcaacctactttgcacatgagatatctcatgggttgctgtttcagatgcccgatcagatatcttcgctcgctgaactcataaaaattggtagcttactaaacttccagcaggctgctgttgcgttcttgctgaagtccaaaaatctgcagctgttccctgaagatgaagatttcctgtttcgttcaaaaaagatgaagatttcctga

SEQ ID NO: 2475 - DNA, 1057 bp, Sorghum bicolor
atgttccatactagatttaggatgataaagcatctcttcctgtgcatcgccaatgctctgagtgaatggtctccctatttcactctaagagcagattgtgcaaatcgccaagggctctcgcctcttcagaagtgcacatcgaaaattcgcttgcttgcatatggcacgcctgctgatggccttgatgagtacctgaagattgggaagagcacgacaagtttgtacaaggtgtgattgaggtgttctcaggggagtatatgcatgctcccacagttgatgatgtgcaacgtctacttcaggtcaatgagtctcgtggctttccaggcatgttgggaagcattgattgcatgcattggaggtggaaaaattgtcctacagcttggaagggacaatttacccgtggtgactacggagtcccaacgatcaccctagaagcagttgcttcacatgatcttagaatatggcatgctttctttggtgtgcctggtcctaataatgatattaatgtgctgaatcaatccccattattcattgaagcattgaaaggtcaagcacctcaagttcagttttctgttaatgggaggcaatataacacaggctactaccttgctgatggaatatatccagaatgggcaaccttcgtgaagtcgattaaagcacctcagatggagaaacacaagctgtatgcattgaagcaagaagggcgcaggaaagatattgaacgtgcttttggagttttgcagtcacgttttaatatcgtgcatcgtccatcacggctgtggaaaaggaagagtattgggagaataatgaaagcttgtgtcatactccacaatatgatagtcgaagatgagaaagagatggtggaagttcctattgacttgaatgagcaaggtggatcatcaattgctctacctccggaagtacaaaagggtggtggcccaattttctctaaaattttacgtagaagagcagatatccatcatcaaccaacacataagcaactgaaaaagacttaattgagcatatttggcaaaagtttgccaatagaagaaataat

SEQ ID NO: 2476 - DNA, 1290 bp, Triticum aestivum
ggacgcgtgggccgcacaccacacccgcccgccccaacaacagagacggacccggccatggtctacggcggagaggaggcgctgaggcggcagtactccatcggcgacgagatcgggcacggccggttcgggaccgtccgccgctgccactccaacgccacgggggaggcgctggcgttgaagaccacgcccaaggcgccgctgcgtgaccctctcgacctggccctcgcggagcaggagcccaagctgcacctcctcgcctcctccccgccctgcagcccgcacctggtcgccctccacgccgccttcgacgacgccgacgccgtccacctcgtcgtcgacctctgcgccggcggggacctcctctccctcctctccgcccgcggcggccgcctccccgagcgcgaggcggcggggctcgccgcgcagatcgcctccgcgctcgccgcgtgccaccgccgcggggtcgcccaccgggacgtcaagcccgacaacctcctcttcgacgccgccaccggcgcgctcaagctcgccgacttcggctccgcggagtggttcggggacgggcgccgcatgtccgggatcgtcggcacgccctactacgtcgcccccgaggtggtcgccggcagggagtacggcgagaaggtggacgtgtggagcgccggggtcgtgctctacatgacgctgtcggggtccgtgccgttctacggcgccaccgcaccggagatcttcgaggcggtgctccgcggcaacgtccgcttcccgccgcgcgccttcgccggcgtctcccccgaggccaaggacctgatgcgccgcatgctctgcaaggacgtctcccgcaggttctccgccgaacaagtcctgaggcatccgtggatcgcgagctgcggaggggatgcggttgcgggctgaagaaatcgatgggccaacatgcggcacgcgctccatccgcctgtagatagaagatgtctccacggacgacggctctgctctgtttctccggcaaatcggcgatggacagaagcagcggcggtgccggagttgagtccagtcagtagaactagcggtggttccttccgtgatcctgtaggtctagatatgggtctctggtgaagctggaattgcagaagctttcaccagagttagcctgaatgtgtgtttgttctctgaatctctgtactagtccttgtacatagtcttgttcagttctagctgaagaggaagagagggtttagtagtacttagtggtacttagtaggcaggcttgttcagaagaatgaaaatggagcg

SEQ ID NO: 2477 - DNA, 963 bp, Brachypodium distachyon
gatagcaatgagcaccggcggcgaggaggcgctgaggctgcagtacgtggtgggcgacgagatcgggcgcggccgcttcggcaccgtccgccgctgccactccgccgccacgggggaggccttcgccgtcaagtccacggccaaggcgcctctgctggacccgctagacctggcgctcgccgagcaggagcccaaggtgcacctcctggtctcctccccgccgtgcagccgccacgtggtcgcgctccacgccgccttcgaggacgcccacgccgtgcacctcgtgctcgacctctgcgcgggcggggacctcctctccctcctctccgcgcgcggcggccgcctcccggagcgcgaggcggcggggctcgccgcgcagctggccgcggcgctcgccgcctgccaccgccgcggggtcgcgcaccgcgacgtcaagccggacaacctcctcttcgacgcggccggcgcgctgaagctcgccgacttcgggtccgcggagtggttcggggacgggcgggccatgacggggctggtggggacgccctactacgtggcgcccgaggtggtggccgggagggagtacggcgagaaggtggacgtgtggagcgccggggtggtgctctacgtgatgctctccgggacggtgcccttctacggcgccacggcaccggagatcttcgagtccgtgctccggggcaacctgcgcttcccgccgcgcgccttcgcctccgtctcgcccgaggccaaagacctcatgcgccgcatgctctgcaaggacgtctccagaagattctccgccgaccaagtcctgaggcatccatggattgcgagccgtgggggggacgcggtggctgactgaagtcaatctgagacatggctgctgcatgcactcctccatccatctgtagatagatcttcttcagttccagttcagagacgacgacccttctgctgtcaaatcct

SEQ ID NO: 2478 - DNA, 1324 bp, Oryza sativa
aggcgaggcggccgcggcgtcggagaccagcggagacagaagaaggggggagaagagaatcgcggagatagcatgagcagcggcggcgagctcgcgctgaggcaggagtacgtcatcggcgacgagatcgggcgcggccgcttcggcaccgtccgccgctgctacgccgtcgccacgggggaggcgttcgcggtcaagtccacgcccaaggcgccgctgcgggaggcggaggcggcggacgcgctcgacctcgcgctcgcggagcaggagcccaaggtgcacctcgtcgcgtcggcgccggggcccggggccagcccgcacgtcgtcgcgctccacgccgccttcgaggacgacgccgcggtgcacctcgtggtcgacctctgcgcgggcggggacctcctctccctcgtctcctcccgcggccgcctcccggagcacgaggccgcggacctcgtggcgcaactggcctccgcgctcgcgtcctgccaccgccgcggggtagcgcaccgcgacgtgaagcccgacaacctcctgttcgacggcggcggcgtgctcaagctcggcgacttcgggtcggcggggtggttcggggacgggaggccgatgacggggctggtcgggacgccctactacgtggcgccggaggtggtggccgggagggagtacggcgagaaggtggacgtgtggagcgccggggtggtgctctacatgatgctctccgggaccctgcccttctacggcgccaccgccgcggaggtcttccagtgcgtgctccgcggcaacctccgcttcccgccgcgcgcgttcgcctccgtctcgccggaggccaaggacctgatgcgccgcatgctctgcaaggacgtctccagaaggttctccgccgaccaagtcctgaggcatccttggatcgtgagccgtgggggagccgcggtgatgggctagttcgttcgatcgaggatgatgatgaactccatccatgtgtagatagcttttcttcaggcgaaggactcgtctgctagctgtgaattttggcttggattagtggcagggttcagtggtagtagcgtattattagtgtttgtgtccagtaggagttaggaccatgacgagctctggtgaattggctggaatttgggagctagctatatctttctacccgagtttgtccgatgtacatacagtgatcagttgatcaccttttggctgaactgaagaagagggtagtctctcttagtgcgtagcaggcttgttcagatgaaaattgaatccaaaaacatgagaaaatttctgtgaattgctgcagttcacctatgcatatttccat

SEQ ID NO: 2479 - DNA, 1459 bp, Triticum aestivum
  misc_feature (265)..(266): n is a, c, g, or t
  misc_feature (268)..(268): n is a, c, g, or t
  misc_feature (270)..(271): n is a, c, g, or t
  misc_feature (273)..(274): n is a, c, g, or t
  misc_feature (277)..(278): n is a, c, g, or t
  misc_feature (280)..(281): n is a, c, g, or t
tatggagaacaaccgagaaacaggttagatttgtatatacccaaagataatagaagaccctgtcccgtggtggcctttgtaactggtggggcctggattattggttacaaggcatggggtgcccttcttggcaggcggttggctgagagaggaatcatagttgcttgcattgattacagaaattttcctcaaggaacaataagtgacatggttagcgatgcttctcaggggatctcattcgtgtgtaacaacattgctagttatnnangnnannctnntnngatctacttgatgggtcagtcagcaggagcacatatttcagcatgtgccctaatggaacaggcagtaaaagagtctagcggacagcccatttcttggagtgttacacaaatcaaggcatactttggtttatctggaggatacaacatccataatttggtcgaccatttccatcagcgtggtctgaaccgttcaatatttctcagtataatggagggagaagaagcattgtcacgttattctcctgaaattgttgtcaaggagtcgagtacccggaccatagctctacttcctcgtatctttcttatgcatggaacagatgattattcaataccatcgtctgccagtcgaacttttgtagacgtccttcaacaagttggtgcccaggccacattattattgtacgaagggaaaacacatacagatatatttatacaggatcctcttaggggtggaagggatcctttggttgaagatgtcttttctgttatttatgccgatgatgcaactcgccaaaatgcagcttctgcgccaactccaaggcgcctggtttttgagtggcaattgcagttggcccgttggattagtcccttctagaagacgacaccgcggagatgatgattcttagggtctcggcgattggcgtttgtgttactgtatttgccaatcgaacccaaacaaacacacgtaaaatgggggaaagcagtgaaacatcaagcaagataagatgaagcagatggcagaactacacgtcttatttgtaatattcgtcccatggattgcacacacactgtcagcgcctgtcgaggcatgatcgacatcatgggagacagaggaagggaaaggcgggattcatatataattcatagcaccatgaagatagcatgcaagctccatttcttctgctgccgttgtcagttttttgctgctgctggcttggagctcttcacctgcctcttcttaggctcccgtggctttgactcagccttcttgatgccgcccttggcggctgctggcttggtcgccgtggcactgagctttgcaggccccttggtggcactaaccttggtaggctccttggcctgcccttcaagtccggttggcttcacggccttcagggatgccattcttatatgctgctctgttccggcactggaaggctcagaagcttaagctgtcg

SEQ ID NO: 2480 - DNA, 565 bp, Triticum aestivum
ttgaggggggtataggatcatgtaggcgaattggtaccgggccccccctttttttttggcagaactacacgtcttatttgtaatattcgtcacatggattgcgcacacactgtcagcgcctgtcgaggcatgatcgacatcatgggagacagaggaagggaaaggcgggattcatatataattcatagcaccatgaagatagcatgcaagctccatttcttctgctgccgttgtcagttttttgctgctgctggcttggagctcttcacctgcctcttcttaggctcccgtggctttgactcagccttcttgatgccacccttggcggctgctggcttggtcgccgtggcactgagctttgcaggccccttggtggcactaaccttggtaggctccttggcctgcccttcaagtccggttggcttcacggccttcagggatgccattcttatatgctgctctgttccggcactggaaggcttagaaacttaagctgtcgtgtgcttgatgaactggggaatggatggaccatggtattataggccgcttcttgggtctcccaagt

SEQ ID NO: 2481 - DNA, 1296 bp, Triticum aestivum
attattattgtacgaagggaaaacacatacagatatatttatacaggatcctcttaggggtggaagggatcctttggttgaagatgtcttctctattatttacgccgatgatgcaactcgccgaatacagcttctgcgccaactccaaggcgcctggtttttgagtggcaattgcagttagccggggggattagtcccttctaatagatgacacggcggagatgttacttcttaggatctcctgcgattggtgttcatgttattgtatttgccaaccgaacccgaacaaacgcacgtaaaatgggagagtgcagtgaaacatcaagcaggataagatgaagcagatggcagaactacacgtcttatttgtaatattctcacatggattgtgagtacaccctgtctaggcgtgatcgacatcatgggagacagaggaagggaaaggtgggattcatatataagtcatagcaccatggagatagctacgcaagctccatttctcctgctgccgttgtcagttttttgctgctgctggcttggtgctcttcacctgcctcttcttaggctcccgtggctttgactcagccttcttgatgccacccttggcggctgctggcttggtcgccgtggcactgagctttgcaggtcccttggtggcactaaccttggtaggctccttggccttcccgtcaagtccggttggcttcacggccttcagggatgccattcttatatgctgctctgttccggcactggaaggcttagaaacttaagctgtcgtgtgcttgatgaactggggaatggatggaccaaggtatttataggccgcttcttgggtctcccaagtgtgcagagtacaaatcctacatgaagcaagaataaaggcgtcctgaattattgtagcaagtgattgatggcacggtgcagttggatgctttcttacagaattggatgccttgtagcctggtaggaggtgcaactcaccggacgtgaagttttccattcgaaatgtttgaggtatattattccctgagtcattaacgcataatggcaccaggaagcttccgaaagaataaatcttgtacaagaaggtttgctgcctggtttctgttggtgtctggatgatctccccctccgacgtaggggactcggtatagcttgtgttgcgtttggcaagttgctatgatgtcttttttgttttttgctggttctatgggatttgtaataatttagttgcatgtgtccttgagaagggtggtttgtgctctgtttcgtactctttccgtcccataatgt

SEQ ID NO: 2482 - DNA, 559 bp, Triticum aestivum
ctcgtgccgaattcggcacgaggacagttctaagccttccagtgccggaacagagcagcatataagaatggcatccctgaaggccgtgaagccaaccggacttgaagggcaggccaaggagcctaccaaggttagtgccgccaaggggcctgcgaagctcagtgccacggcgaccaagccagcagccgccaagggtggcatcaagaaggccgagtcaaagccacgggagcctaagaagaggcaggtgaagagctccaagccagcagcagcaaaaaactgacaacggcagcagaagaaatggagcttgcatgctatcttcatggtgctatgaattatatatgaatcccgcctttcccttcctctgtctcccatgatgtcgatcatgcctcgacaggcgctgacagtgtgtgcgcaatccatgtgacgaatattacaaataagacgtgtagttctgccatctgcttcatcttatcctgcttgatgtttcactgctttctcccattttacgtgtgtttgtttggccttgattggcaaatacaataacacaaacaccaatcac

SEQ ID NO: 2483 - DNA, 1826 bp, Brachypodium distachyon
  misc_feature (636)..(637): n is a, c, g, or t
  misc_feature (639)..(640): n is a, c, g, or t
  misc_feature (643)..(644): n is a, c, g, or t
  misc_feature (646)..(647): n is a, c, g, or t
tcttcgccactcaatgcagcctccttcctccggcggcgacgcgcgcgaggcggacgcgctcctcgcgcggagcgactccgcgggccgccgccgccgcgcgtcgcctgtgcagtccgcgtccccggcgccccaaggctggggtggccccaggaggcagtcgtcgttccgcgatgacgttggccacgccgcctccgagacgtacctcgtgacgcgcctcaccttcaccctactccagtacctcgggttaggttaccgatggatgacacaacttcttgcccttgcagtatatgcgattttacttatgccaggttttttgcaagttggatattattatttcttttcaagtcaggttcgtagaagtatagtttatggagaacaaccaagaaataggttggatttgtatatacccaaagataacactagaccctgtccagtgatggcctttgtaaccggtggggcttggattattggttacaaagcatggggtgcccttcttggcaggcggttggctgagagaggaatcatagttgcttgcattgattacagaaattttccccaaggaacaataagcgacatggttgctgatgcttctcagggaatttcatttgtgtgtaacaacatcgctagttatggagnnannctnntnngatctacttgatgggtcagtcagcaggagcacatattgcagcatgtgccctcatggagcaggcagtaaaagagtctagtggacagcccatttcttggagtgttacacaaatcaaagcatacttcggtttatctggaggatacaacatctataatttggtcgaccatttccatcagcgtggtctttatcgttcaatatttctcagcataatggatggagaggaatcgttgtcacgttattctcctgaaattgttgtcaaggagtctagtcctcagactatagctttactgcctcctattgttcttatgcatgggactgacgattattcaataccatcatctgccagtcaaacttttgtagacgtccttcaacaagttggtgctcaagcaaggttactgttgtacgaaggcaaaacacatactgatatctttttacaggatcctcttaggggtggaaaggatcctttggttgaagatgtcttgtctgttattcacactgatgatgcaacacgccgaaatatagcttcagcacccactccaaggcgcctggtttttgagtggcaattgcagttggcccgtcgaattagtcccttctagaagacgacaccgcggagatgatgattcttagggtctcggcgattggcgtttgtgttactgtatttgccaatcgaacccaaacaaacacacgtaaaatgggggaaagcagtgaaacatcaaagcaggaaaagatgaagctgatggtacaactatacatcttatttgtaatatcatcacatggggttaagcacaccatcaaggcctgtctaggcaggataatgacatcataggagacagaggaagggaaagatgggattcatatatattcatagcatcatggaaatcactatgcaagttccatttctcttgctgccgttgtcagtttttgactgctgccggcttgctgctcttcacctgcctcttcttaggctcccgaggtttcgactcagccttcttgatgccgcccttggcggctgctggctttttcgcggtggcactgagctttgcaggctccttggtggcactaagcttggcaggctccttggcctgagctgctggcccggtgggcttcacggccttcacggatgccattcttataatgctactctgttccggcactcgggaaagctcggaagcttaagctg

SEQ ID NO: 2484 - DNA, 2240 bp, Triticum aestivum
agcgagacccaaatcaattctactcccggagcaattccgccccccgcctcgcctcggaaggggaagtaaatcatggcgactggtcaaattttctcgaaaaccacccaagcgctattctataattataagcaacttcctatccagcggatgcttgattttgacttcctctgtgggagagaaacaccttctgttgctggaatcatcaatcctggttctgatgggttccagaagcttttttttggacaagaagaaattgctattccagttcatcctacaattgaagctgcttgcaatgcacacccaactgcggatgtttttatcaactttgcatccttccggagtgcggctgcttcttcaatgtcagctttgaagcagccaactctccgagttgtagccataatagcggagggagttcctgaatcagacgcaaagcagctaattagttatgcacgtgctaacaacaaggtcatcattggacctgcaacagtcggaggagttcaggctggtgctttcaagattggtgatacagctggaaccattgataacataattcaatgcaagctgtacaggcccggatcagttggttttgtgtctaaatcgggtggcatgtcaaatgagctgtacaacaccattgcaagagtgactgatggtatttatgaaggaattgcaattgggggagatgttttccctggctcaactctttcagatcacattctgcgttttaataacatacctcaggttaaaatgatggttgttcttggagagcttggaggaagtgatgagtattcgctcgtcgaagccttgaaacaaggaaaggttcagaaacctgttgttgcttgggttagtgggacatgcgcacgtctattcaaatctgaggtccagtttggccatgctggtgcaaagagcggtggtgagttggaatccgcacaagctaagaatcaggcactaagggatgctggtgcagttgtccctacttcatttgaagctcttgaaagtgtgattaaggagacatttgagaagctggttgaggaaggaaatattcctcctgtccctgaggttacacctccccccattcccgaggatcttaacactgccattaaaagtgggaaggtccgagctcccacacacattatctccactatctctgatgatagaggtgaggaaccttgctacgctggtgtgcccatgtctacaattattgaaaggggttatggagttggtgatgttatttctcttttgtggttcaagcgtagtcttcctcgttattgtactcaatttattgagatatgcgtcatgctttgtgctgatcatggtccttgtgtatccggtgctcacaattctatagttactgctagggctggaaaggaccttgtatccagcttggtatctggattattgacaattggcccccgatttggtggtgcaattgatgacgccgctcggtacttcaaagatgcatatgatagggatcttacgccttatgaatttgttgagggcatgaaaaagaagggaatccgtgtccctgggattggtcacaggatcaaaagcagagacaacagggacaagagagtgcagcttttacagaaatatgctcacgcacacttcccttcagtcaagtacatggagtacgctgttcaggttgagacctacaccctgtcaaaggccaacaatttggttatgaatgttgacggtgcgattggctcgctcttcttggaccttctttctgggagtggaatgttcagcaagcaagagatcgacgagattgtagagattgggtatcttaatggactctttgtgcttgcacgttcaattggcctaattgggcacacctttgatcagaagaggctcaagcaaccactctaccgtcacccttgggaggatgtcctctacaccaaatgaggcagcatattggtcttccacctatgtgtacaccataaatataaaatcgagcataactgcatagaattcaaaattccgactgttgatggaactaggagaggagggatacaagaccgttacagatgaaagtttgtttcatttttttttcattcaagcatgaaagcattatggcatcagatatttgaaaggatacttgatagttgtttcatattatcatcaattgattgtcaaatttatttcagacatttggggaatattgtaatggttgtgatgctagttcccgtcacaaactctggaatatctatggtcatttatggtgataaaaaaaaaaaaaaaaaggg

SEQ ID NO: 2485 - DNA, 2424 bp, Triticum aestivum
cccacgcgtccgggggcgtgcgccccctacttctcaccttccatctcctacccgccactataaattcttctactacttgtcttgcccctcagctccgtcttccccgagcgagacccagatcaatctccgtctcagagcaattctgcctccgcttcgccttgccctgcctcgcctcggaaggggaagtaaatcatggcgacgggtcaaattttctcgaaaaccacccaagcattattctataattataagcaactccctatccaacggatgcttgattttgacttcctctgtgggagagaaacaccttctgttgctggaataatcaatcctggttctgatgggttccagaaacttttctttggacaagaagaaattgctattccggttcatcctacaattgaagctgcttgcaatgcacacccaactgcggatgtatttatcaactttgcatctttccggagtgcggctgcttcttccatgtcagctttgaagcagccaactgtccgagttgtagccattatagcagagggtgttcctgaatcagacgcaaagcagctaattagctatgcacgtgctaacaacaaggtcatcattggacctgcaacagtcggaggagttcaagctggtgctttcaagattggtgatactgctggaaccattgataacataattcaatgcaagctgtacaggcctgggtcagttggttttgtgtctaaatcgggtggcatgtcaaatgagctgtacaacacgattgcaagagtgactgatggtatttatgaaggaattgcaattggtggggatgttttccctggctcaactctttcagatcacattctgcgttttaacaacataccccaggttaaaatgatggttgttcttggggagcttggaggaagcgatgagtattcactcgtcgaagccttgaaacaaggaaaggttcagaaacctgttgttgcttgggttagtgggacatgtgcacgcctattcaaatctgaggtccagtttggccatgctggtgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcctgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttattgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgacgctgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcaattggcctaattggccacacctttgatcagaagaggctcaagcaaccactctaccgtcatccttgggaggatgtcctctacaccaagtgaggccgactcagcacggcatcatatggatcttccacttgtgtgtacaccataaaatcgagcataattgcatagaattcaaagttctgattgtcaactaggcgaggagggagagaagaccgttacagatgagcattggctgtgtgtatgtcttgtgggactggtgtgttttttataagctccaacgtaagtcttttttttttgttcaagcatgaaagctttagggcatcagatatttgaaaggatacttgataattgtttcatgttatcatcattaagtgaccgccaatttttcttcagacatttcagacatttggggagtgttgtaatgtttgtgatgctagttccccatcacaaaaaatccgaattctgtactgtcaaattatgtggtacgagtaataaaataga

SEQ ID NO: 2486 - DNA, 2332 bp, Triticum aestivum
cttgtcttgcccctcagctccgtcttccccgagcgagacccagatcaatctccgtcccagagcaattctgcctccgcttcgccttgccctgcctcgcctcggaaggggaagtaaatcatggcaacgggtcaaattttctcgaaaaccacccaagcattattctataattataagcaactccctatccaacggatgcttgattttgacttcctctgtgggagagaaacaccttctgttgctggaataatcaatcctggttctgatgggttccagaaacttttctttggacaagaagaaattgctattccggttcatcctacaattgaagctgcttgcaatgcacacccaaccgcggatgtatttatcaactttgcatctttccggagtgcggctgcttcttcaatgtcagctttgaagcagccaactgtccgagttgtagccattatagcagagggtgttcctgaatcagacgcaaagcagctaattagctatgcacgtgctaacaacaaggtcatcattggacctgcaacagtcggaggagttcaagctggtgctttcaagattggtgatactgctggaaccattgataacataattcaatgcaagctgtacaggcctggatcagttggttttgtgtctaaatcgggtggcatgtcaaatgagctgtacaacacgattgcaagagtgactgatggtatttatgaaggaattgcaattggtggggatgttttccctggctcaactctttcagatcacattctgcgttttaacaacataccccaggttaaaatgatggttgttcttggggagcttggaggaagcgatgagtattcactcgtcgaagccttgaaacaaggaaaggttcagaaacctgttgttgcttgggttagtgggacatgtgcacgcctattcaaatctgaggtccagtttggccatgctggtgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcctgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttattgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgacgctgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcaattggcctaattggccacacctttgatcagaagaggctcaagcaaccactctaccgtcacccttgggaggatgtcctctacaccaagtgaggccgactcagcatggcatcatatggatcttccagttgtgtgtacaccataaaatcaagcataattgcatagaattcgaagttctgattgtcaactaggcgaggagggagagaggaccgttacagatgagcactggctgtatgtcttgtgggactgttttttttataagctccaaagtaagtctttttttttgttcaagcatgaaagctttagggcatcagatatttgagaggatacttgataattgtttcatgttatcatcaattaagtgaccgccaaatttggggagtgttgtaatgtttgtgatgctagttccccatcacaaaaaatccgaattctgtaatgtcaaattatgtggtacgagtaataaaatagaatatgcacgtct

SEQ ID NO: 2487 - DNA, 2312 bp, Triticum aestivum
ccgagcgagacccagatcaatctccgtcccagagcaattctgcctccgcttcgccttgccctgcctcgcctcggaaggggaagtaaatcatggcaacgggtcaaattttctcgaaaaccacccaagcattattctataattataagcaactccctatccaacggatgcttgattttgacttcctctgtgggagagaaacaccttctgttgctggaataatcaatcctggttctgatgggttccagaaacttttctttggacaagaagaaattgctattccggttcatcctacaattgaagctgcttgcaatgcacacccaaccgcggatgtatttatcaactttgcatctttccggagtgcggctgcttcttcaatgtcagctttgaagcagccaactgtccgagttgtagccattatagcagagggtgttcctgaatcagacgcaaagcagctaattagctatgcacgtgctaacaacaaggtcatcattggacctgcaacagtcggaggagttcaagctggtgctttcaagattggtgatactgctggaaccattgataacataattcaatgcaagctgtacaggcctggatcagttggttttgtgtctaaatcgggtggcatgtcaaatgagctgtacaacacgattgcaagagtgactgatggtatttatgaaggaattgcaattggtggggatgttttccctggctcaactctttcagatcacattctgcgttttaacaacataccccaggttaaaatgatggttgttcttggggagcttggaggaagcgatgagtattcactcgtcgaagccttgaaacaaggaaaggttcagaaacctgttgttgcctgggttagtgggacatgtgcacgcctattcaaatctgaggtccagtttggccatgctggcgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcttgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttatcgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgacgctgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagaaattgatgagattgtagagattggatatcttaatggactctttgtgcttgcacgttcaattggcctaattggccacacctttgatcagaagaggctcaagcaaccactctaccgtcacccttgggaagatgtcctgtacaccaagtgaagccgactcagcacggcatcttatggatcttccacttgtgtgtacaccataaaatcgagcataattgcatagaattcaaagttctgattgtcaactaggcgaggagggagagaagaccgttacagatgagcactggctgtgtgtatgtcttgtgggactggtgtgttttttataagctccaacgtaagtaatttttattgttcaagcatgaaagctttagggcatcaaatatttgagaggatacttgataattgtttcatgttatcatcaattaagtgaccaccaaattttcttcagacatttggggagtgttgtaatgtttgtgatgctagttccccatcacaaaaaatctgaattctgtactgtcaaattatgtggtacgagtaataaaataga

SEQ ID NO: 2488 - DNA, 2299 bp, Triticum aestivum
tcttccccgagcgagacccagatcaatctccgtcccagagcaattctgcctccgcttcgtcttgccctgcctcgcatcggaaggggaagtagatcatggcgacgggtcaaattttctcgaaaaccacccaagcattattctataattataagcaactccctatacaacggatgcttgattttgacttcctctgtgggagagaaacaccttctgttgctggaataatcaatcctggttctgatgggttccagaaacttttctttggacaagaagaaattgctattccggttcatcctacaattgaagctgcttgcaatgcacacccaactgcggatgtatttatcaactttgcatctttccggagtgcggctgcttcttcaatgtcagctttgaagcagccaactgtccgagttgtagccattatagcagagggtgttcctgaatcagacgcaaagcagctaattagctatgcacgtgctaacaacaaggtcatcattggacctgcaacagttggaggagttcaagctggtgctttcaagattggtgatactgctggaaccattgataacataattcaatgcaagctgtacaggcctggatcagttggttttgtgtctaaatcgggtggcatgtcaaatgagctgtacaacacgattgcaagagtgactgatggtatttatgaaggaattgcaattggtggggatgttttccctggctcaactctttcagatcacattctgcgttttaacaacataccccaggttaaaatgatggttgttcttggggagcttggaggaagtgatgagtattcactcgtcgaagccttgaaacaaggaaaggttcagaaacctgttgttgcttgggttagtgggacatgtgcacgcctattcaaatctgaggtccagtttggccatgctggtgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcctgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttattgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgatgccgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcagttggcctaattggccacacctttgatcagaagaggctcaagcaaccactctaccgtcacccttgggaggatgtcctctacaccaagtgaggccgactcagcatggcatcatatggatcttccagttgtgtgtacaccataaaatcaagcataattgcatagaattcgaagttctgattgtcaactaggcgaggagggagagaggaccgttacagatgagcactggctgtgtgtcttgtgggactgttttttttataagctccaaagtaagtcttttttttttgttcaagcatgaaagctttagggcatcagatatttgagaggatacttgataattgtttcatgttatcatcaattaagtgaccgccaaatttggggagtgttgtaatgtttgtgatgctagttccccatcacaaaaaatccgaattctgtaatgtcaaattatgtggtacgagtaataaaataga

SEQ ID NO: 2489 - DNA, 2259 bp, Hordeum vulgare
gcgagacccagatcaatctccgtcccagagcaattcggcctccacttcgccttgcctcgcctcgaaaggggaagtaaatcatggcgacaggtcaaattttctcaaaaaccacccaagcattattctataattataagcaactccccatccaaaggatgcttgattttgacttcctctgtgggagagaaacaccttctgttgctggaataatcaatcctggttctgatgggttccagaaacttttctttggacaagaagaaattgctattccagttcatcctacaattgaagctgcttgcaatgcacacccaactgcggatgtatttatcaactttgcatctttccggagtgcggctgcttcttcaatgtcagctttgaagcagccgactatccgagttgtagccattatagcagagggagttcctgaatcagacgcaaagcagctaattagctatgcacgtgccaacaacaaggtcatcattggacctgcaacagtcggaggagttcaggctggtgctttcaagattggtgatacggctggaaccattgataacatcattcaatgcaagctgtacaggcctggatcagttggttttgtgtctaaatcgggtggcatgtcaaatgagctgtacaataccattgcaagagtgaccgatggtatttatgaaggaattgcaattggtggggacgttttccctggctcaactctttcagatcacattctgcgttttaataacataccccaggttaaaatggtggttgttcttggggagcttggaggaagcgatgagtattcactcgtcgaagccttgaaacaaggaaaggttcagaagcctgttgttgcttgggttagtgggacatgtgcacgcttattcaaatctgaggtccagtttggccatgctggtgcaaagagcggtggtgagttggaatctgcacaagctaagaatcaggcactaagggatgctggggcagtagtccctacttcatttgaagctcttgaaagtgtgattaaggagacatttgagaagctggttgaggacggaaatattcctcctgtccctgaggttacacctccccccattcctgaggatcttaaaactgccattaaaagtgggaaggtccgagctcccacgcacattatctccactatctctgatgatagaggtgaggaaccttgctatgctggtgtgcccatgtctacaatcattgaaaggggttacggagttggtgatgttatttctcttttgtggttcaagcgcagccttcctcgttattgtactcaatttattgagatatgcatcatgctttgtgctgatcatggtccttgtgtatccggtgctcacaattctatagttactgctagggctggaaaggaccttgtttccagcttggtatccggattattgacgattggcccccgatttggtggtgcaattgatgacgccgctcggtacttcaaagatgcatatgataggggtcttacaccttatgaatttgttgagggcatgaaaaagaagggaatccgtgtccctgggattggtcacaggatcaaaagcagagacaacagggacaagagagtgcagcttttacagaaatatgctcacacacacttcccttcagttaagtacatggagtatgctgttcaggttgagacctacaccctgtcaaaggccaacaatttggttatgaacgttgacggtgcaattggctcgcttttcttggatcttctttctgggagtggaatgttcagcaagcaagagattgacgagattgtagagattgggtatcttaatggactctttgtgcttgcacgttcaattggcctaattgggcacacctttgatcagaagaggctcaagcaaccactctaccgtcacccttgggaggatgtcctctacaccaagtgaggcaggcatcatattgatcttccacttgtgtgtacaccataaaatcgagcataattacataggattcaaagttctggttgtgaactaggcaacgagagagagaagaccgtttgcagatgagcattggttgtgtgtatgtcttgttggactgttttttctttataagttccaacgtaagtctttttgttcaagcatgaaagctttacggcatcagatatttgagaggatacttgataattggttcatgttatcatcaattcagtgaccgtcaaattttcttcagacatttggtgagtgttgtaatgattgtgaagcaagttccccatcacaaaaatctgaattttgtactgtc

SEQ ID NO: 2490 - DNA, 2277 bp, Avena sativa
cggctccgtcctccccgagacccaaatcaaattccgtcgccgagcacttccgcctccgcttcgcaccgactgggaaggggaactaaatcatggcgacaggtcaaattttctcaaaaaccacccaagcattattctacaattataagcaactccctatccaacggatgcttgattttgacttcctatgtgggagagaaacaccttctgttgctggaataatcaatcctggttctgatgggttccagaaacttttctttggacaagaagaaattgctattccagttcatcctacaattgaagctgcttgcaatgcacacccaactgctgatgtatttatcaactttgcatccttccggagtgcggctgcttcttcaatgtcagctttgaagcaggcaactatccgagttgtagccattatagcggaaggagttccggaatcagacgcaaagcagctaattagctacgcacgtgcgaacaacaaggtcatcattggacctgcgacagttggaggagttcaggctggtgctttcaagattggtgatactgctggaaccattgacaacataattcaatgcaagctgtacaggcctggatctgttggttttgtttctaaatcgggtggcatgtcaaatgagctgtacaacaccattgcaagagtgacagatggtatttatgaaggaatcgcaattggaggagatgttttccctggttcaactctttcagatcacattctgcgttttaataacattcctcaggttaaaatgatggttgttcttggggagcttggaggaagcgacgagtattcacttgttgaagccttgaaacaaggaaaggttcagaaacctgttgttgcctgggttagtgggacatgtgcacgtctattcaaatctgaggtccagtttggccatgctggtgcgaagagcggtggtgagttggaatcagcacaaggtaagaatcaggcactaagggatgctggggcagttgtccctacttcatttgaagctctcgaaagtgtgattaaggagacatttgagaagctggttgaggaaggaaaagttcctattgtccctgagattacaccccctcccattcctgaggatcttaaaactgcaattaaaagtgggaaggtccgagctcccacgcacattatctccactatctctgatgatagaggtgaggaaccttgctatgctggtgtacccatgtctacaattattgaacggggttatggagttggtgatgttatttcccttttgtggttcaagcgcagccttcctcgttactgcactcagtttattgagatatgcatcatgctttgcgccgatcatggtccttgtgtatctggtgctcacaattctattgttactgctagggctggaaaggacctcgtttccagcttggtatctggattgttgacaatcggcccccgatttggtggtgcaattgatgatgccgctcggtacttcaaagatgcatatgataggggtcttacaccttatgaatttgttgagggcatgaaaaagaagggaatccgtgtccccgggattggtcacaggatcaagagcagagacaacagggacaagagagtgcagcttttacagaaatatgctcacacacacttcccttcagtcaagtatatggaatatgctgttcaggtggaaacctacaccctgtcaaaggccaacaatttggttatgaacgtcgacggtgcaattgggtcacttttcctggatcttctttctgggagtggaatgttcagcaagcaagagatcgacgaaattgtagagattggttatcttaatgggctctttgtgcttgcacgttcaattggcctaattgggcatacctttgaccagaagaggctcaagcaaccactctaccgtcacccgtgggaggatgtcctgtacaccaagtgaggctgacttgttatttcagcacgacatcttattggttgtccacctgtgtacactaaaactgagcacaattgcatagaattcaaagttctggatgtcgatggaactaggagagagagagaagaccgttacaaatgagcactggttgtgtgttttatgtaagctccaaatgtaagtgttcccaattcttcctcagatactggaaaggatacttgataatcgtttcatgttattgccaattaagtgacaatcaaatttagttcagacatctggggactgctgtaatgattttgaggctagttccccaacacaacattctggattctatgttgtcattttctgcaataaaatgtgcacgggttgc

SEQ ID NO: 2491 - DNA, 2350 bp, Brachypodium distachyon
ataaattcttccactcgtcttgcccgtctcagctccgtcctcctgattcgagacccaaaccaaattacgtcccggagcaattccgcctccgcttccgcctcgcctctcctcggaaggggaagtaaatcatggcgacaggtcaaattttctcaaaaaccacccaagcattattctacaattataagcaactacctattcaacggatgcttgattttgactttctttgtgggagagaaacaccttctgttgctggaataatcaatcctggttctgatggatttcagaaacttttctttggacaagaagaaattgctattccagttcatcctacaattgaagctgcttgcaatgcacacccaactgctgatgtatttatcaactttgcgtccttccggagtgcggctgcttcttcaatgtcagctttgaagcagccaacaatcagagtggtagccattattgcagagggagttcctgaatcagatgcgaagcagctaattagctatgcacgtgctaacaacaaggtcatcattggacctgcaacagttggaggagttcaagctggtgctttcaagattggtgatactgctggaactattgacaacataattcaatgcaagctttacaggcctggatctgttggttttgtgtctaaatcgggtggcatgtcaaatgagctgtacagcacaattgccagagtgacagatggtatttatgaaggaattgcaattggaggagatgttttccctggctcaactctttcagatcacattctgcgttttaataacatacctcaggttaaaatgatggttgttcttggggagcttggaggaagcgacgagtattcactggtcgaagccttgaaacaaggaaaggttcagaaacctgttgttgcatgggttagtgggacatgcgcacgtctattcaaatctgaagtacagtttggccacgctggggcgaagagtggtggtgagttggaatcagcgcaagctaagaatcaggcactaagggatgctggagcagttgtccctacttcatttgaagctctcgaaagtgtgattaaggagacatttgacaagctggttgaggcaggaaatattcctcctgtggctgagattacacctccacccattcctgaggatcttaaaactgcaattaagagtgggaaggtccgagctcccacacacattatttccactatctctgatgacagaggtgaggaaccttgctatgctggtgtccccatgtctacaattattgaacggggttatggagttggtgatgttatttctcttctgtggttcaagcgtagccttcctcgttattgcactcagtttattgagatatgcatcatgctttgtgccgatcatggtccttgtgtatccggtgctcacaattcgatagttacggccagggctggaaaggaccttgtttccagcttggtatctggattattgacaattggcccgcgatttggtggcgcaattgatgacgctgctaggtacttcaaagatgcatatgatagaggtcttacaccttatgaatttgttgagggcatgaaaaagaagggaatccgtgtccctggaatcggtcacaggatcaagagcagagacaacagggacaagagagtgcagcttctacagaaatatgctcacacaaacttcccttcggtcaagtatatggaatatgctgtccaggttgagacctacactctttcaaaggccaacaatttggttatgaacgtcgatggtgcgattgggtctcttttcttggatcttctttctgggagtggtatgttcagcaagcaagagattgatgagattatagagattgggtatcttaatggactctttgtgcttgcacgttcaattggcctaattgggcacacctttgatcagaagagactcaagcaaccactgtaccgtcacccatgggaggatgtcctctacaccaagtgagacttgattgttctttgagcacagcattacatttacctaggtcttccacctgtgtgtacactccaagtcgtgcataattgcatagaattgaaagttctgaatgttgatggaactagaggagagaagaacattgcaaacgagggcttggttgtgtttctttatgtaagctccaaaggcaactctgtttcagatttttgctgttgtccagccacgaaagcgttaggaactcggttggttccatgttaccatcaattaagtgactgtcgaaatttagttcagtgtttgaggtgtccgcaagcctgggggttgttgtaatatttgtgatgctagttccccaaatatctctcattcatagtgccatttttggtaataaaatctgcgcttctttctgtttc

SEQ ID NO: 2492 - DNA, 2193 bp, Festuca arundinacea
  misc_feature (1521)..(1521): n is a, c, g, or t
  misc_feature (1623)..(1623): n is a, c, g, or t
  misc_feature (1958)..(1958): n is a, c, g, or t
  misc_feature (1960)..(1960): n is a, c, g, or t
  misc_feature (2017)..(2017): n is a, c, g, or t
  misc_feature (2105)..(2105): n is a, c, g, or t
  misc_feature (2131)..(2131): n is a, c, g, or t
  misc_feature (2159)..(2159): n is a, c, g, or t
ggcacgaggctcctcctcgtccccgagacacaaatcaaatcaaattccgtcgccgaccaattccgcctccgcttcgcaccgcctcggaagaggaagtaaatcatggcgacaggtcaaattttctcaaaaaccacccaagcattattctacaattacaagcaactccctatccaacggatgcttgattttgacttcctctgtgggagagaaacaccttctgttgctggaataatcaatcctggttctgatgggttccagaaacttttctttggacaagaagaaattgctattccagttcatcctacaattgaagctgcttgcaacgcacacccaactgctgatgtatttatcaactttgcatccttccggagtgcggctgcttcttcaatgtcagctttgaagcaggcaactatccgagttgtagccattatagcggaaggagttcctgaatcagacgcaaagcagctaattagctatgcacgtgctaacaataaggtcatcattggacctgcgacagttggaggagttcaggctggtgctttcaagattggtgatactgctggaaccattgacaacataattcaatgcaagctgtacaggcccggatctgttggttttgtgtctaaatcgggtggcatgtcaaatgagatgtacaacaccattgcaagagtgacagatggtatttatgaaggaattgcaattggaggagatgttttccctggttcaactctttcagatcacattctgcgttttaataacatacctcaggttaaaatgatggttgttcttggggagcttggaggaagcgatgagtattcactcgttgaagccttgaaacaaggaaaggttcagaaacctgttgttgcttgggttagcggaacatgtgcaactctattcaaatctgaggtccagtttggccatgctggtgcgaagagtggtggtgagttggaatcagcacaaggtaagaatcaggcgctaagggatgctggcgcagttgtccctacttcatttgaagccctcgaaagcgtgattaaggagacgtttgagaagctggttgaggaaggaaaagttcctctcgtccctgagattacacctccccccattcctgaggatcttaaaactgcaattaaaagtgggaaggttcgagctcccacccacattatctccactatctccgatgatagaggtgaggaaccttgctacgctggtgtacccatgtctacaattattgaacggggttatggagttggtgatgttatttcccttttgtggttcaagcgcagccttcctcgttattgcactcagtttattgagatatgcatcatgctttgcgccgatcatggtccatgtgtatctggtgctcacaattctatagttactgctagggctggaaaggaccttgtttccagcttggtatctggattgttgacaattggcccccgatttggtggtgcaattgatgacgctgctcggtacttcaaagatgcatatgataggggtcttacgccttatgaatttgtngagggcatgaaaaagaagggaatccgtgtccctgggattggtcacaggatcaagagcagagataacagggacaagagagtgcagcttttacagaaatatgcncacacacatttcccttcagtcaagtatatggaatacgctgttcaggtggagacctacaccctgtcaaaggccaacaatttggttatgaacgtcgatggtgcaattgggtcacttttcttggatcttctttctgggagtggaatgttcagcaagcaagagatcgacgagattgtagagattgggtatcttaatggactctttgtgcttgcacgttcaattggcctaattgggcacacctttgaccagaagaggctcaagcaacctctgtaccgtcacccgtgggaggatgtcctatacaccaagtgaggctgacttattctttcagcatggcatcntnttggttgtccacctgtgtgtacactacataaaattgagcataattgcatagaattcnaagttctgaaaatgttgatggaactaggagagatggagagagaagaccgttacaaatgagcactggttgtgtgttttatgtaagctcnaaatgtaagtgttttagattcttcancagattggaaaaggatacttaataattntttcatgttatgtcaatcaagttaactttgaatt

SEQ ID NO: 2493 - DNA, 2142 bp, Pennisetum glaucum
cccaccccggcgacgcaccactgatctccggcgacacccctcctccggccgcgcctcgcttcggaaggtgaagtaaatcatggcgacaggccaacttttctcaaaaactacccaagcattattctacaattacaagcaacttcccatccaacggatgcttgattttgacttcctctgtgggagagaaacaccttctgttgctggaataatcaatcctggttctgatggttttcagaaacttttctttggtcaagaggaaattgctattccagttcatcctacaattgaagctgcctgcaatgcccacccaacagctgatgtatttatcaactttgcatccttccggagtgctgctgcttcttcaatgtcagctttgaagcagccaacgataagagttgtagccattattgctgagggtgttcctgaatcagatgcaaagcagctaattagctatgcacgtgctaataacaaggtcatcattggacctgcaactgttggaggaattcaagctggtgctttcaagattggtgatactgctggaaccattgacaacataattcagtgcaagctttacaggcctggatccgtcggttttgtgtctaaatcgggtggcatgtccaatgagatgtacaacaccattgccagagtgacagatggtatttatgaaggaattgcaattggaggggatgttttccctggatcaactctatcagatcacattctgcgttttaataacataccacaggttaaaatgatggtagttcttggggagcttggtggaaaagatgagtattcacttgttgaagccttgaaacaagggaaggttcagaaaccagttgttgcatgggttagtgggacatgtgctcgtttattcaaatcggaagtgcagtttggacatgctggtgcaaagagtggtggcgagctggaatcagcccaagctaagaatgaggcgctaagggaagctggggcaattgtgcctacttcatatgaagctctcgaaagtgctattaaggagacatttgagaaactggttgaggatggaaagatttctcctgtggctgaaattacacctccccccatcccggaggatcttaaaactgcaatcaagagtgggaaggtccgggctcctacccacatcatctccactatctctgatgacagaggtgaggagccatgttatgcgggtgtacctatgtctacaattattgaacagggttatggagtcggagatgttatctctcttttgtggttcaagcgtagcctgcctcgctattgcactcagtttattgagatatgcgtcatgctttgtgctgaccatggtccctgtgtatccggtgctcataactccatagttaccgctcgggctggaaaggaccttgtttccagcttggtgtccggattattgacaatcggcccccgattcggtggagcaatcgatgatgcagcccgatacttcaaagatgcatttgataggggtctcacaccttatgagtttgttgaaggcatgaaaaagaagggaatccgtgtccctgggattggtcacaggatcaagagcagggataacagggataagcgtgtgcagcttctacaaaaatatgctcacacacatttcccttcagtcaagtacatggaatatgccgttcaggttgagacctacacattgtcgaaagccaataatttggttctgaatgtcgatggtgcaatcgggtcgcttttcttggatcttctatcaggaagtgggatgttctccaaacaggagattgacgagatagttgagattggttatctcaatgggcttttcgtgcttgcacgttcaattggtctgattgggcacactttcgaccagaagaggctcaagcagccactctaccgtcacccatgggaggatgtcctctacaccaagtgagatatgaccaattctttggcctagggcttccagctgtctgtacacttcattaagttgagcacaattgcataaaagttgagagttgtgattgatggggagactaggagagaaaaagagaggaacatcactagtcagcaactagcctgtgtgtttttataagtcgcaaattgaagcctcagttcctgatttttgtcctgccatgaaccgttaatctctgaaaagaagttatccctcga

SEQ ID NO: 2494 - DNA, 2252 bp, Pennisetum glaucum
ggcgacgcaccactgatctccggcgacacccctcctccggccgcgcctcgcttcggaaggtgaagtaaatcatggcgacaggccaacttttctcaaaaactacccaagcattattctacaattacaagcaacttcccatccaacggatgcttgattttgacttcctctgtgggagagaaacaccttctgttgctggaataatcaatcctggttctgatggttttcagaaacttttctttggtcaagaggaaattgctattccagttcatcctacaattgaagctgcctgcaatgcccacccaacagctgatgtatttatcaactttgcatccttccggagtgctgctgcttcttcaatgtcagctttgaagcagccaacgataagagttgtagccattattgctgagggtgttcctgaatcagatgcaaagcagctaattagctatgcacgtgctaataacaaggtcatcattggacctgcaactgttggaggaattcaagctggtgctttcaagattggtgatactgctggaaccattgacaacataattcagtgcaagctttacaggcctggatccgtcggttttgtgtctaaatcgggtggcatgtccaatgagatgtacaacaccattgccagagtgacagatggtatttatgaaggaattgcaattggaggggatgttttccctggatcaactctatcagatcacattctgcgttttaataacataccacaggttaaaatgatggtagttcttggggagcttggtggaaaagatgagtattcacttgttgaagccttgaaacaagggaaggttcagaaaccagttgttgcatgggttagtgggacatgtgctcgtttattcaaatcggaagtgcagtttggacatgctggtgcaaagagtggtggcgagctggaatcagcccaagctaagaatgaggcgctaagggaagctggggcaattgtgcctacttcatatgaagctctcgaaagtgctattaaggagacatttgagaaactggttgaggatggaaagatttctcctgtggctgaaattacacctccccccatcccggaggatcttaaaactgcaatcaagagtgggaaggtccgggctcctacccacatcatctccactatctctgatgacagaggtgaggagccatgttatgcgggtgtacctatgtctacaattattgaacagggttatggagtcggagatgttatctctcttttgtggttcaagcgtagcctgcctcgctattgcactcagtttattgagatatgcgtcatgctttgtgctgaccatggtccctgtgtatccggtgctcataactccatagttaccgctcgggctggaaaggaccttgtttccagcttggtgtccggattattgacaatcggcccccgattcggtggagcaatcgatgatgcagcccgatacttcaaagatgcatttgataggggtctcacaccttatgagtttgttgaaggcatgaaaaagaagggaatccgtgtccctgggattggtcacaggatcaagagcagggataacagggataagcgtgtgcagcttctacaaaaatatgctcacacacatttcccttcagtcaagtacatggaatatgccgttcaggttgagacctacacattgtcgaaagccaataatttggttctgaatgtcgatggtgcaatcgggtcgcttttcttggatcttctatcaggaagtgggatgttctccaaacaggagattgacgagatagttgagattggttatctcaatgggcttttcgtgcttgcacgttcaattggtctgattgggcacactttcgaccagaagaggctcaagcagccactctaccgtcacccatgggaggatgtcctctacaccaagtgagatatgaccaattctttggcctagggcttccagctgtctgtacacttcattaagttgagcacaattgcataaaagttgagagttgtgattgatggggagactaggagagaaaaagagaggaacatcactagtcagcaactagcctgtgtgtttttataagtcgcaaattgaagcctcagttcctgatttttgtcctgccatgaaccgttaatctctgaaaagaagttatccctcaaaatgactcgcttggagctgaagccggttttaagtcttaactctgcgcatgctcatattcatgagattgatacctggttctctgttttgcatctgttacgttctccatgcacactttgc

SEQ ID NO: 2495 - DNA, 2260 bp, Panicum virgatum
cgaaatcccgcctccccctccggccacgcctggcttcttcgcccccctgcttcggaaggtgaagtaaataatggcgacgggccaacttttctcgaaaactacccaagcattattctacaattacaagcaacttccaatccaacggatgcttgattttgacttcctctgtgggagagaaacaccttctgttgctggaataatcaatcctggttctgatggttttcagaaacttttctttggacaagaggaaattgctattccagttcatcctacaattgaagctgcctgcaatgcgcacccaacagctgatgtatttatcaactttgcatccttccggagtgccgctgcttcttcaatgtcagctttaaagcagccaacaataagagttgtagccattattgcggagggtgttcctgaatcagatgcaaagcagctaattagttatgcacgtgctaataacaaggtcatcattggacctgcaacagttggaggaattcaagctggtgctttcaagattggtgatactgctggaaccattgacaacataattcagtgcaagctttacaggcctggatctgtcggttttgtgtctaaatcgggtggtatgtcaaacgagctctacaacaccattgccagagtgacagatggtatttatgaaggaattgcaattggaggagatgttttccctggatcaactctgtctgatcacattctgcgttttaataacataccacaggttaaaatgatggttgttcttggggagcttggtggaaaagacgagtattcacttgttgaagccttgaaacaaggaaaggttcagaaaccagttgttgcatgggttagtggaacgtgcgcacgtctcttcaaatcagaagtgcagtttggccatgctggtgctaagagtggtggtgagttggaatctgcccaagctaagaatcaggcactaagggaagctggggcaattgtgcctacttcatatgaagctctcgaaagtgctattaaggagacatttgacaaactggctgaggaaggaaagatttctcctgtgactgaaattacacctcctcccattcccgaggaccttaaaactgcaatcaagagtgggaaggtccgggctcctacccacatcatctccactatctctgatgacagaggcgaggaaccatgctatgctggtgtccctatgtctacaattattgaacagggttatggtgttggtgatgttatctctctcttgtggttcaagcgcagccttcctcgctattgcactcagtttattgagatatgcatcatgctttgcgctgaccacggtccatgtgtgtccggtgctcataactctatagttactgctagggctggaaaggaccttgtttccagcttggtgtctggattattgacaattggtccccgtttcggtggagcaattgatgatgccgcccgatacttcaaagatgcatatgataggggtctcacgccttacgagtttgttgaaggcatgaaaaagaagggtatccgtgtccctgggattggtcacaggatcaagagcagggacaacagggacaagcgtgtgcagcttctacaaaaatatgctcacacacatttcccttcagtcaagtacatggaatatgctgttcaggttgagacctacaccttgtcgaaagccaataatttggtcctgaatgtcgatggtgcgatcgggtcgcttttcttggatcttctatctggaagtggaatgttcaccaaacaggagatcgatgagattgtcgagattggttatcttaatgggctcttcgtccttgcacgttcaattggtctgattgggcacacttttgaccagaagaggctcaagcagccactctaccgtcacccatgggaggatgtcctctacaccaagtgagatagaatcattctttgtgcacggaattattactgtcacctagggcttccagctatctgtacacttcgtaaactcgagcacagttgcataaaagttggaagttgtgattgatggtgaaactaggagagagaggaacatcactagtcagcgctagcctgtgtgttttatgtgttgcaaattcaagtctctagtcctgatttttgtcgagcaaaatgaaccgttagaggccatatgatattttcgttgttgtttcacgacaaggcctcagcaaagaagttttccctcaaaatgaagtctggtgctagccctctgagttgtttcgtttataaattcattttcgggcaatagaatttggcattttgc

SEQ ID NO: 2496 - DNA, 2403 bp, Oryza sativa
acttcacatccaacccaaccccctacccgccactataaagtcctcctccgctttccgcctccttcctcctcctccccctctcccgtctccgctactccaaacttaattttgatttctcgccggagaattcctcctccgcctcccggctcctcccctccgccctcgcttccgcaggcgaactaaaccatggcgacaggtcaaattttctccaaaaccacccaagcgttattctataattataagcaacttccgatccaacggatgcttgattttgacttcctatgtgggagagaaacaccttctgttgctggaataatcaatcctggttctgatgggtttcagaaacttttctttggacaagaagaaattgccattccagttcatcctacaattgaagctgcctgcaatgcacacccaactgctgatgtatttatcaactttgcatcctttcggagtgctgccgcttcttcaatgtcagctttgaagcagccaacaatcagagttgtagccatcatagcagagggtgttcctgaatcagatacaaaacaacttattagttatgcacgtgccaacaacaaggtaatcattggaccagcaacagttggaggaatccaagctggtgctttcaagattggtgatactgctggaaccattgacaacattattcaatgcaagctttacaggcctggatctgttggctttgtttctaaatcgggtggcatgtcaaatgagatgtacaacaccattgccagagtgacagatggtatttatgaaggaattgcaattggaggggatgttttccctggctcaactctgtcagaccacatcctgcgtttcaacaacatacctcaggtcaaaatgatggttgttcttggggagcttggaggaaaagatgagtattctcttgttgaagccctgaaacaaggaaaggttcagaaacctgttgttgcatgggttagtgggacatgcgctcgtctattcaagtctgaagtgcagtttggccatgctggtgcgaaaagtggtggtgagttggaatcagcacaagctaagaaccaggcactaaaagatgccggggcagttgtccctacttcatatgaagctcttgaaactgcgatcaaggagacatttgagaaactggttgaggacggaaagatctctcctgttactgagattacaccacctcctattccagaggatcttaaaaccgcaattaagagtgggaaggtccgagctcccacacacattatctccactatctcggatgacagaggcgaggaaccctgctatgctggtgtccccatgtctacaattattgaacagggttatggagttggtgacgttatttcgcttttgtggttcaagcgcagtcttcctcgttactgcactcagtttattgagatgtgcatcatgctttgcgctgatcatggtccttgtgtatccggtgctcacaattctatagttactgctagggctggaaaggaccttgtttccagcttggtatctggtttattgacaattggcccccgttttggtggtgcaattgatgatgctgcccggtacttcaaagatgcatatgatagaaatctcacaccttatgagttcgttgagggtatgaaaaagaagggaatccgtgtccctgggattggtcacaggatcaagagcagagacaacagagataagagagtgcagcttctacagaaatatgcccacacacatttcccttctgtcaaatacatggagtatgctgtccaggttgagacctacaccctgtcaaaagccaacaatttggttctgaacgtcgatggtgcgattgggtcgcttttcttggatcttctttctggcagtggaatgttcagcaaacaagaaatcgatgagattgttgagattggttaccttaatggactctttgtgcttgcgcgttcaattggtctcatcgggcacacctttgaccagaagaggctcaagcaaccactctaccgccacccatgggaggatgtcctctacaccaagtgaagactcggttgttcttaatattacctagatattccagctttgtacacacttcaaaaggtcaagcgaaattgcataaaagtgaacgccgatgaaactagggggagaagaatggggtcaccggtgaccgctgttgttgcgtgtttcaagttagttgcaaattgagatctgttcctgatttttgtcaaagcaagaaccattaggacaacatgggggatattggaaatttactgtatcatcgtgtactatcgattctctcaacgaaaaaaaaaatctagtctgatgctaatgtgttcaccggtcgtggagagtgttgtaatgtttgtgattgtcaatgtgccacttcgataggcatcatttttgctattaaaaataaaataaaatttgcatgtc

SEQ ID NO: 2497 - DNA, 2420 bp, Setaria italica
agcgtggggaggcgaagcgaggcgcggccggagggggagggcggcccgcccccgagcgacgcaccactgatctcccggcgacaccccgccctccccctccggccgcgcctcgcttcgcctccccacgcttcggaaggtgaagtaaagtaaatcatggcgacaggccaacttttctcgaaaactacccaagcattattctacaattacaagcaacttcccatccaacggatgcttgattttgacttcctctgtgggagagaaacaccttctgttgctggaataatcaatcctggttctgatggttttcagaaacttttctttggtcaagaggaaattgctattccagttcatcctacagttgaagctgcctgcaatgcccacccaacagccgatgtatttatcaactttgcatccttccggagtgctgctgcttcttcaatgtcagctttgaagcaaccaacgataagagttgtagctattattgctgagggtgttcctgaatcagatgcaaagcagctaattagttttgcacgtgctaataacaaggtcatcattggacctgcaacagttggaggaattcaagctggtgctttcaagattggtgatactgctggaaccattgacaacataattcagtgcaagctttacaggcctggctccgtcggttttgtgtctaaatcgggtggcatgtcaaacgagatgtacaacaccattgccagagtgacagatggtatttatgaaggaattgcaattggaggggatgttttccctggatcaactctatcagatcacattctgcgttttaataacataccgcaggttaaaatgatggtagttcttggggaacttggtggaaaagatgagtattcacttgtcgaagccttgaaacaagggaaggttcagaaaccagttgttgcatgggttagtgggacatgcgctcgtctattcaaatcggaagtgcagtttggccatgctggtgcaaagagtggtggcgagttggaatcagcccaagctaagaatgaggcactaagggaagctggtgcaattgtgcctacttcatatgaagctctggaaagtgctattaaggagacatttgagaaactggttgaggatggaaagatttctcctgtggctgaaattacacctccccccattcccgaggacctcaaaactgcaatcaagagtgggaaggtccgggctcctacccacatcatctccactatctctgatgacagaggcgaggagccatgttatgctggtgtacctatgtctacaattattgaacagggttatggagttggcgatgttatctctcttttgtggttcaagcgtagcctgcctcgctattgcactcagtttattgagatatgcatcatgctttgcgctgaccatggtccctgtgtatccggtgctcataactctatagttactgctcgggctggaaaggaccttgtttccagcttggtgtctggattattgacaattggtccccgtttcggtggagcaattgatgatgcagcccgatacttcaaagatgcatgtgataggggtctcacaccttacgagtttgttgaaggcatgaaaaagaagggaatccgtgtccctgggatcggtcacaggatcaagagcagggacaacagggataagcgtgtgcagcttctacaaaaatatgctcacacacatttcccttccgtcaagtacatggaatatgctgttcaggttgagacctacacattgtcaaaagccaacaatttggttatgaatgtcgatggtgcgatcgggtcgcttttcttggatcttctatcaggaagtggaatgttcaccaaacaggagatcgacgagatagttgagattggttatcttaatgggcttttcgtgcttgcacgttcaattggtctgattgggcacactttcgaccagaagaggctcaagcagccactctaccgtcatccatgggaggatgtcctctacaccaagtgagatagaatcattctttgcgccggaattattatcatcacctagggcttccatctgtctgtacacttcataaagttgagcacaattgcataaaagtttaaagttgtgattgatggtgaaactaggagaggaagaaaacatcactagtcagcactagtctgtgtgttttatacttttatgtgaagctgcaaattcaagtctcaggtcctgatttttgtcctgccatgaaccattaggtcatatgatattggagaggatacttttaattgttgtttcatgacccggtctcagaaaagaagttttcccttaaaatgatgtctcttttgtagctgcagctggttcgagtctgtcactctgcgcatgctcacggtcatgagacatgagttcgatatctgttttgagttgtccttggagaccgcatttttacaccatgtcgccatcta

SEQ ID NO: 2498 - DNA, 2385 bp, Sorghum bicolor
tgcgtcgctcgcctcgcctcgcctactcctcaccggccccccatcctccacccgccactataaattcctctgcttccggccagctctgctccgcccgtcccagcgacgcaccactgatcttccggcgaaatcccgctcccgcgtccccctcctccggccgcgcctcgcttcgcccccgctccgtaaggagcagtaaatcatggcgaccggccaacttttttcgaaaactacccaagcattattctacaactacaagcaacttcccatccaacggatgcttgattttgacttcctctgcgggagagaaacaccttctgttgctggaataatcaaccctggttctgacggttttcagaaacttttctttggacaagaggaaattgctattccagttcatcctacaattgaagctgcctgcaatgctcacccaacagctgatgtgtttatcaactttgcatccttccggagtgctgctgcctcttcaatgtcagccttgaagcagccaacaataagggttgtagccattatcgctgagggtgttcctgaatcagatgcaaagcagctaattagttatgcacgtgctaataacaaggtcatcattggacctgcaacagttggaggaattcaagctggtgctttcaagattggtgataccgctggaaccattgacaacataattcagtgcaagctttacaggcctggatctgttggttttgtgtctaaatcgggtggcatgtcaaatgagatgtacaacaccattgccagagtgacagatggtatttatgaaggaattgcaattggaggggatgttttccctggatcaactctgtcagaccacattctgcgttttaataacataccacaggttaaaatgatggttgttcttggggagcttggtggaaaagacgagtattcacttgtggaagcattgaaacaaggaaaggttcagaaaccagttgttgcatgggttagtgggacatgtgcacgtctattcaaatcagaagtgcagtttggtcatgctggtgccaagagtggtggtgagttggaatcagcacaagctaagaatcaggcactaagggaagctggtgcaattgtgccgacttcatatgaagctctagaaagtgcaattaaggaggcatttgacaaactggttgaggaaggaaaaatttctcctgtgactgaaattacacctcctcccattcctgaggaccttaaaactgcaatcaagagtgggaaggtccgagctcctacccacatcatctccacaatctctgatgacagaggtgaggaaccatgctatgctggtgtccctatgtctacaattattgaacagggttatggagttggtgatgttatctctcttttgtggttcaagcgcagccttcctcgctattgcactcagtttattgagatatgcatcatgctttgtgccgaccatggtccctgtgtatctggtgctcataactctatagttactgctagggctggaaaggaccttgtttccagcttggtgtctggattattgacaattggtccccgcttcggtggggcaattgatgacgcagcccgatacttcaaagatgcatgtgacaggaacctcacgccgtacgagtttgttgaaggcatgaaaaagaagggaatccgtgtgcctgggattggtcacaggattaagagcagagacaacagggataagcgtgtgcagcttctacaaaaatatgctcacacacatttcccttcagtcaagtacatggaatacgctgtccaggttgagacctacaccttgtccaaagccaacaatttggttctgaacgtcgatggtgcgatcgggtcacttttcttggatcttctgtctggaagtggaatgttcaccaaacaggagatcgatgagattgtggaaattggttatcttaatgggctctttgtgcttgcgcgttcaattggcctgatcgggcacaccttcgaccagaagaggcttaagcagccactctaccgtcacccatgggaggatgtcctgtacaccaagtgagataggagccattctttgcaaggcataaagtattgttgtcgcctagggcttccagctgtctgtacacttcataaatcgagcagttccaaaaaaggattgttgatgaaactagggggggagagaggaagaggaacatcactagtcagcactagattgtgtgttttgtgttgagttgcaaattcaattcctgatttttgtcctgccatgaaccgttaggccatattgtatcggaaagaatgcttccattattgtttcaccccagaatagtttcccttcaaaaatctctcttatacagccctctgattttttttcgttgataattgcatttctacattccgctcgtgatggttgcataaacc

SEQ ID NO: 2499 - DNA, 2343 bp, Saccharum officinarum
ctagcggcctggagcagtacggtccggaatcccgggtcgcaccacgcgtccgacattctccacccgccactataaatccctctgcttccgccctgctctgctccgcccgtcccagcgacgcaccactgatctcccggcgaaatcccgctcccgcgtcccccttcctccggccgcacctcgcttcgcccccgctccgtaaggtgcagtaaatcatggcaactggccaacttttttcgaaaactacccaagcactattctacaactacaagcaacttcccatccaacggatgcttgattttgacttcctctgtgggagagagacaccttctgttgctggaataatcaatcctggttctgacggttttcagaaacttttctttggacaagaggaaattgctattccagttcatcctacaattgaagctgcctgcaatgcacacccaacagctgatgtatttatcaactttgcatccttccggagtgctgctgcctcttcaatgtcagctttgaagcagccaacaataagggttgtagccattatcgctgagggtgttcctgaatcagatgcaaagcagctaattagttatgcacgtgctaataacaaggtcatcattggacctgcaacagttggaggaattcaagctggtgctttcaagattggtgataccgctggaaccattgacaacataattcagtgcaagctttacaggcctggatctgttggttttgtgtctaaatcgggtggcatgtcaaatgagatgtacaacaccattgccagagtgaccgatggtatttatgaaggaattgcaattggaggggatgttttccctggatcaactctgtcagaccacattctgcgatttaataacataccacaggttaaaatgatggttgttcttggggagcttggtggaaaagacgagtattcacttgtggaagcattgaaacaaggaaaggttcagaaaccagtcgttgcatgggttagtgggacatgtgcacgtctattcaaatcagaagtgcagtttggtcatgctggtgccaagagtggtggtgagctggaatcagcacaggctaagaatcaggcactaagggaagctggtgcaattgtgcctacttcatatgaagctctagaaagtgcaattaaggaggcatttgacaaactggttgaggaaggaaaaatttctcctgtgactgaaattacacctccttccattcctgaggaccttaaaaccgcaatcaagagtgggaaggtccgagctcctacccacatcatctccactatctctgatgacagaggtgaggaaccatgctatgctggtgtccctatgtctacaattgttgaacagggttatggagttggtgatgttatctctcttttgtggttcaagcgcagccttcctcgctattgcactcagtttattgagatatgcatcatgctttgtgccgaccatggtccctgtgtatctggtgctcataactctatagttactgctagggctggaaaggaccttgtttccagcttggtgtctggattattgacaattggtccccgtttcggtggagcaattgatgatgcggcccgatacttcaaagatgcatgtgacaggaacctcacgccatacgagtttgttgaaggcatgaaaaagaagggaatccgtgtgcctgggatcggtcacaggattaagagcagagacaacagggataagcgtgtgcagcttctacaaaaatatgctcacacacatttcccttcagtcaagtacatggattacgcctgtcaggttgagacctacaccttgtcaaaagccaacaatctggttctgaatgtcgatggtgcgatcgggtcacttttcttggatcttctgtctggaagtggaatgttcaccaaacaggagatcgacgagattgtggaaattggttatcttaatgggctctttgtgcttgcacgttcaattggcctgatcgggcacaccttcgaccagaagaggcttaagcagccgctctaccgtcacccatgggaggatgtcctgtacaccaagtgagagaagccattctttgcgaagcataaagtattgttgtcgcctagggcttcgagttgtctgtacacttcataaatcgagcagttgcaaaaaaaggtccaagttgtgattgttgatgaaactaggggagagagaggaagaggaacatcactagtcagcactagattgtgtgttttgtgttgagttgcaaattcaagtccagatttttgccctgccatgaaccgttaggccatattgtattggaaaggatgcttccattattgtttcaccccagaatagtttcccttaaagtgaaatctcttattct

SEQ ID NO: 2500 - DNA, 2314 bp, Saccharum officinarum
cattctccacccgccactataaatccctctgcttccgccctgctctgctccgcccgtcccagcgacgcaccactgatctcccggcgaaatcccgctcccgcgtcccccttcctccggccgcacctcgcttcgcccccgctccgtaaggtgcagtaaatcatggcaactggccaacttttttcgaaaactacccaagcactattctacaactacaagcaacttcccatccaacggatgcttgattttgacttcctctgtgggagagagacaccttctgttgctggaataatcaatcctggttctgacggttttcagaaacttttctttggacaagaggaaattgctattccagttcatcctacaattgaagctgcctgcaatgcacacccaacagctgatgtatttatcaactttgcatccttccggagtgctgctgcctcttcaatgtcagctttgaagcagccaacaataagggttgtagccattatcgctgagggtgttcctgaatcagatgcaaagcagctaattagttatgcacgtgctaataacaaggtcatcattggacctgcaacagttggaggaattcaagctggtgctttcaagattggtgataccgctggaaccattgacaacataattcagtgcaagctttacaggcctggatctgttggttttgtgtctaaatcgggtggcatgtcaaatgagatgtacaacaccattgccagagtgaccgatggtatttatgaaggaattgcaattggaggggatgttttccctggatcaactctgtcagaccacattctgcgatttaataacataccacaggttaaaatgatggttgttcttggggagcttggtggaaaagacgagtattcacttgtggaagcattgaaacaaggaaaggttcagaaaccagtcgttgcatgggttagtgggacatgtgcacgtctattcaaatcagaagtgcagtttggtcatgctggtgccaagagtggtggtgagctggaatcagcacaggctaagaatcaggcactaagggaagctggtgcaattgtgcctacttcatatgaagctctagaaagtgcaattaaggaggcatttgacaaactggttgaggaaggaaaaatttctcctgtgactgaaattacacctccttccattcctgaggaccttaaaaccgcaatcaagagtgggaaggtccgagctcctacccacatcatctccactatctctgatgacagaggtgaggaaccatgctatgctggtgtccctatgtctacaattgttgaacagggttatggagttggtgatgttatctctcttttgtggttcaagcgcagccttcctcgctattgcactcagtttattgagatatgcatcatgctttgtgccgaccatggtccctgtgtatctggtgctcataactctatagttactgctagggctggaaaggaccttgtttccagcttggtgtctggattattgacaattggtccccgtttcggtggagcaattgatgatgcggcccgatacttcaaagatgcatgtgacaggaacctcacgccatacgagtttgttgaaggcatgaaaaagaagggaatccgtgtgcctgggatcggtcacaggattaagagcagagacaacagggataagcgtgtgcagcttctacaaaaatatgctcacacacatttcccttcagtcaagtacatggattacgcctgtcaggttgagacctacaccttgtcaaaagccaacaatctggttctgaatgtcgatggtgcgatcgggtcacttttcttggatcttctgtctggaagtggaatgttcaccaaacaggagatcgacgagattgtggaaattggttatcttaatgggctctttgtgcttgcacgttcaattggcctgatcgggcacaccttcgaccagaagaggcttaagcagccgctctaccgtcacccatgggaggatgtcctgtacaccaagtgagagaagccattctttgcgaagcataaagtattgttgtcgcctagggcttcgagttgtctgtacacttcataaatcgagcagttgcaaaaaaaggtccaagttgtgattgttgatgaaactaggggagagagaggaagaggaacatcactagtcagcactagattgtgtgttttgtgttgagttgcaaattcaagtccagatttttgccctgccatgaaccgttaggccatattgtattggaaaggatgcttccattattgtttcaccccagaatagtttcccttaaagtgaaatctcttattctaccgggaacttgggaaaatttgtt

SEQ ID NO: 2501 - DNA, 2130 bp, Cajanus cajan
ttccaccagacgagtgaatcagatctatctgtttcttcgtcatggccactggacaactattctcccgtaccacgcaagctttattttacaactacaagcagcttcctatccagcggatgcttgattttgacttcctttgcggcagggaaacaccatcagttgctggaataattaaccctggttctgagggatttcagaaactcttctttggtcaggaggaaattgccatcccagttcattctaccattgaagcagcttgtgctgcacatcctactgctgatgtcttcatcaatttcgcttcattcagaagtgctgcagcatcatcgatggctgctttgaagcagccaaccattagagttgctgctattattgctgaaggagtacccgagtcagacactaagcaattgattgcatatgcccgggcaaacaataaggttgttattggcccagccactgttggaggcattcaagcaggtgcttttaaaattggtgacacagctggaacaattgacaatataattcagtgcaagctctacaggcctggatctgttggatttgtttccaaatccggtgggatgtccaatgaattatacaacaccattgcccgtgtaactgatgggatttatgaaggcattgctattggaggagatgttttccctggttccacactttctgaccatgttttacggtttaacaacattccacaggttaaaatgatggtagtacttggggaacttggtgggcgtgatgagtattctttagtggaagccctaaaacaagggaaagtgcaaaaaccagttgttgcctgggtcagtgggacatgtgcacgactcttcaaatctgaagtacaatttggtcatgcaggagctaaaagtggtggtgagttggaatctgctcaagcaaagaatcaggcactaagggatgctggagctgttgttcccacatcatatgaagctttagaagctgcaattaaggaaacatttgacaaattggttgaagaagggaagatcacatcagtcaaggaaatcacacctccaccaatccctgaggaccttagcactgcaattaagagtggaaaagtccgtgctccaactcatattatttccactatttctgatgacagaggtgaggagccatgctatgctggtgtacccatgtcttccattattgaaaagggttatggtgttggtgatgttatctctcttttatggtttaaacgcagccttcctcgttactgtactcaatttattgagatatgcatcatgctatgtgccgaccatggtccttgtgtctctggtgctcataatactattgtgacagcaagggccgggaaggacctagtttccagtcttgtatcaggtttgcttacaattggtcctcgatttgggggtgccattgatgatgctgctcgctacttcaaggatgctcatgacagggggcttacgccttatgagtttgttgaaggtatgaagaaaaagggtattcgtgttccaggaatagggcacaggatcaagaacagggacaacaaagataaaagagttgagctgttacagaagtttgcacgcacacattttccttctgtgaaatacatggaatatgctgttcaagttgaaacctacaccctctcaaaggcaaataatttagttcttaacgtagatggtgcaattggatctcttttcttggatctgcttgctggtagtggaatgttcaccaagccagagattgatgaaattgtggagattggttatttgaatggcctctttgtgctggcacgctccattggtctgattgggcacacctttgaccaaaagcgattgaagcaaccactttaccgtcacccatgggaggatgttctctacacaaagtgagaaagttatgtgtgactgtaagaactttgcaatgcatcaaattatcaatcttttgggaaatcatgcatctgaaatatgctggagtggttttgtagctgttagactagtgttgtacgatctattggtgaaaagtcatctttcatccgtaacttgtattaaatttcataaagaaagaactcatagtcattttcaaatttatatttctcttgatgaatattctgatctctgtaccgttgtgacttcaaaaggaatgaacacacaa

SEQ ID NO: 2502 - DNA, 2259 bp, Citrus sinensis
ttcgaatcgtctcatttcttttaccctgtctcgcattgtatcggctgagttcacgaggcagggactccgagtcaggtgtcttcagcgattagtcacgccatggctacaggacagctgttttcaaaaaccacacaagctttgttttacaactataagcagcttccaatccaacggatgcttgattttgatttcctttgcgggagggaaacaccttcagttgccggaattataaatcctggggctgagggatttcagaaattgttttttggacaagaggaaattgccattcctgtgcattcaactgttgaggcagcttgtgctgctcatccaacggctgatgttttcatcaacttttcatcatttagaagtgcggctgcctcatctatggctgccctgaaacagccaaccattcgggtagtggcaattattgccgaaggtgtgcctgaggcagacaccaagcaattgattgcatacgctcggtctaacaacaaggttgttattggcccagcaactgttggaggaattcaagctggagcttttaagataggtgacacagccggaaccattgataacatcattcattgcaaactctacaggcctggatctgttggttttgtctccaaatctggtggcatgtctaatgaactatacaacactattgctcgtgtaacagatggaatctatgaaggtattgcaattggaggagatgtgttccctggctccactctttctgatcacattttgcggtttaacaacatcccacaggttaaaatgatggttgttcttggtgaacttggaggacgggatgagtactcccttgttgaagctctgaaacagggaaaggtaaacaaacctgtggttgcatgggtcagtggaacctgtgctcgactattcaaatcagaagtgcaatttggtcatgctggtgctaaaagtggtggtgagatggagtctgctcaggcaaagaatcaagcactaagggatgctggagctgttgttcctacttcatatgaagcctttgaatctgcaattaaggagacatttgagaaacttgttgaagaggggaagattccaccagtgaaggaagttacaccaccacaaatccctgaggatcttaacactgccattaagagtgggaaagtacgggctccaactcatattatttcaaccatctctgatgacagaggtgaggagccatgctatgctggtgtaccaatgtcttcaattgtagaacaaggttatggtgtgggtgatgttatttcccttttgtggtttaaacgcagccttccccgctactgtacccaatttattgagatatgcataatgttatgcgctgatcatggcccctgtgtttctggtgctcacaacactatagtgacagcaagagctggaaaggatcttgtttccagcctcgtgtcaggtttgctcacaattggtccccgatttggtggcgccattgatgatgctgcccgatatttcaaggatgcttatgaccggggtctttcagcctatgaatttgttgaatcaatgaaaaagaagggcatacgtgtgccaggaattgggcacaggatcaagagaggagataacagagacaaaagagtggagctgctacaaaaatttgcacgcactcatttcccttctgtgaagtatatggaatatgctgttcaagttgaaacctacactctatcaaaagcaaacaacctggttcttaatgtagatggtgcaattgggtcccttttcttggatcttcttgccggcagtggaatgttcagcaagcaagaaatcgatgagatagtggaaattggatatctgaatgggctctttgttctggcacgctccatcggtttgattgggcatacctttgaccagaagagattgaaacaacctctataccgtcacccatgggaagatgttctctacaccaagtaattcacttaccggcaacaggtgggaaatcataatcaacatgctttccaaaacattttcccttttgaagtctttaaatctgtattttgctggaattgttgttgggtttttagattactgtttttgtaatttgaagtaccagccgaaaactttggtctgtaagttgaaagttcatcaagatacgactctcagatcattaattgaacgaagtgatgtttcaaaatctagatgcagagcttgcattgttgtataaggatctctccattcttgaatatttgaataaaatttttagccaccatgattagaaatggacggcttttagtaagaaaaaaaaaa

SEQ ID NO: 2503 - DNA, 2255 bp, Glycine max
agtctctcaccttccaactcgccctcgactcacttccttgtccgattccgccaacgaggccagtgaatcagatctatctgcttcttcgtcatggccaccggacaactattctcccgcactacacaggctttgttttacaactataagcaacttcccatacagcggatgcttgattttgacttcctttgcggcagggaaacaccatcagttgctggaataattaaccctggttctgagggatttcaaaaacttttttttggtcaggaggaaattgccatcccagttcatgccaccattgaagcagcttgtgctgcacatcctactgctgatgtcttcatcaactttgcttcatttagaagtgctgcagcatcatccatggcagctttgaagcagccaacaattagagttgttgctattattgctgaaggagtacccgagtcagacactaagcaattgattgcatatgcccgatcaaacaataaggttgttattggtccagccactgttggaggcattcaagcaggtgcttttaaaattggtgacacagctggaacaattgacaatataattcagtgcaagctctacaggcctggatctgttggatttgtttctaaatctggtgggatgtccaatgaactctacaacactattgcccgtgtaactgatgggatttatgaaggcattgctattggaggagatgttttccctggttccacactttctgaccatgttttacggtttaacaacatgccacaggttaaaatgatggtagtacttggggaacttggtgggcgtgatgagtattccttagtggaggccttaaaacaaggaaaggtatccaaaccggttgttgcctgggtcagtggcacatgtgcacgactcttcaaatctgaagtacaatttggtcatgcaggagccaaaagtggtggtgagttagagtctgctcaagcaaagaatcaggcactaagggacgctggagctgttgttcccacatcatatgaagcttttgaagctgcaattagggaaacatttgataaattggttgaagaagggaagatcacaccaatcaaggaaatcacacctccaccaatccctgaagaccttagtactgcaattaagagtggaaaagtccgtgctccaactcatattatttccaccatttctgatgacagaggagaggagccatgctatgctggtgtacccatgtcttccattatcgaaaaaggttatggtgttggtgatgttatctctcttttgtggtttaaacgaagccttccccgttactgtactcaatttattgagatatgcatcatgctatgtgccgaccatggtccttgtgtctctggtgctcacaatactattgtgacagcaagggcagggaaagacctagtttccagtctcgtatcaggtttgctaacaattggtcctcgatttgggggtgccatcgatgatgctgctcgctacttcaaggatgctcatgacagggcacttactccttatgagtttgttgaaggtatgaaaaagaagggaattcgtgtggcaggaatagggcacaggatcaagaatagggacaacaaagataagagagttgagctgctacagaagtttgcacgaacacattttccttccgtgaaatacatggaatatgctgttcaagttgagacctacacactcacaaaggcaaataatttagttcttaacgtagatggtgcaattggatctcttttcttggatcttcttgctggtagtggaatgttcaccaaacaagagattgatgaaattgtggagattggctatctgaatggcctctttgtgctggcacgctccattggtctgattggacacacctttgaccaaaagcgattgaagcaaccactttaccgtcacccatgggaggatgttctctacacaaagtgaggaagttttgtgcgactgtaagaactttcacatgcttcaaattagcaatcttttgggaaatcatgcatctgatataagctggagtgattttgtagctgttagactagtgttgtacgatctattggtgaaaaagtcatcttccatttgtaactttgattaaatttcataaagaaagaacttggtcattttttaaattacatttctcttgatgaatattctgatctttgtactgttttgacttcaataggaaattatcacataagttcgagcgcatttattctgcggtatggtatatgttcatggaaacaacaattttattgccagtgaatgaaatgctt

SEQ ID NO: 2504 - DNA, 2204 bp, Glycine max
agtctctcaccttccaactcgccctcgactcacttccttgtccgattccgccaacgaggccagtgaatcagatctatctgcttcttcgtcatggccaccggacaactattctcccgcactacacaggctttgttttacaactataagcaacttcccatacagcggatgcttgattttgacttcctttgcggcagggaaacaccatcagttgctggaataattaaccctggttctgagggatttcaaaaacttttttttggtcaggaggaaattgccatcccagttcatgccaccattgaagcagcttgtgctgcacatcctactgctgatgtcttcatcaactttgcttcatttagaagtgctgcagcatcatccatggcagctttgaagcagccaacaattagagttgttgctattattgctgaaggagtacccgagtcagacactaagcaattgattgcatatgcccgatcaaacaataaggttgttattggtccagccactgttggaggcattcaagcaggtgcttttaaaattggtgacacagctggaacaattgacaatataattcagtgcaagctctacaggcctggatctgttggatttgtttctaaatctggtgggatgtccaatgaactctacaacactattgcccgtgtaactgatgggatttatgaaggcattgctattggaggagatgttttccctggttccacactttctgaccatgttttacggtttaacaacatgccacaggttaaaatgatggtagtacttggggaacttggtgggcgtgatgagtattccttagtggaggccttaaaacaaggaaaggtatccaaaccggttgttgcctgggtcagtggcacatgtgcacgactcttcaaatctgaagtacaatttggtcatgcaggagccaaaagtggtggtgagttagagtctgctcaagcaaagaatcaggcactaagggacgctggagctgttgttcccacatcatatgaagcttttgaagctgcaattagggaaacatttgataaattggttgaagaagggaagatcacaccaatcaaggaaatcacacctccaccaatccctgaagaccttagtactgcaattaagagtggaaaagtccgtgctccaactcatattatttccaccatttctgatgacagaggagaggagccatgctatgctggtgtacccatgtcttccattatcgaaaaaggttatggtgttggtgatgttatctctcttttgtggtttaaacgaagccttccccgttactgtactcaatttattgagatatgcatcatgctatgtgccgaccatggtccttgtgtctctggtgctcacaatactattgtgacagcaagggcagggaaagacctagtttccagtctcgtatcaggtttgctaacaattggtcctcgatttgggggtgccatcgatgatgctgctcgctacttcaaggatgctcatgacagggcacttactccttatgagtttgttgaaggtatgaaaaagaagggaattcgtgtggcaggaatagggcacaggatcaagaatagggacaacaaagataagagagttgagctgctacagaagtttgcacgaacacattttccttccgtgaaatacatggaatatgctgttcaagttgagacctacacactcacaaaggcaaataatttagttcttaacgtagatggtgcaattggatctcttttcttggatcttcttgctggtagtggaatgttcaccaaacaagagattgatgaaattgtggagattggctatctgaatggcctctttgtgctggcacgctccattggtctgattggacacacctttgaccaaaagcgattgaagcaaccactttaccgtcacccatgggaggatgttctctacacaaagtgaggaagttttgtgcgactgtaagaactttcacatgcttcaaattagcaatcttttgggaaatcatgcatctgatataagctggagtgattttgtagctgttagactagtgttgtacgatctattggtgaaaaagtcatcttccatttgtaactttgattaaatttcataaagaaagaacttggtcattttttaaattacatttctcttgatgaatattctgatctttgtactgttttgacttcaataggaaattatcacataagttcgagcgcatttattctgcggta

SEQ ID NO: 2505 - DNA, 2448 bp, Theobroma cacao
actccctccattttccctctctttctatataagcccgtatctaccgttccccagttccagcatttttattgttatttctttgccctcctttctctgcctttctttctctcactcgttcccttcttgatttttcacgaggcgggcgagggtgattttcatttcctttcgactctctcttcaggtctctttgagccgtagccatggccactggacagttattttctcgaactacacaagctttgttctacaactacaaacaacttcccattcaacggatgctcgatttcgacttcctttgcgggagggaaacaccatctgttgctggtatcattaatcctggtgctgagggatttcagaaactcttctttggtcaagaggaaatcgcgatccccgtacattctaccattgaggcagcatgtgctgcacatccaacagccgatgtttttattaacttcgcatcgtttcgaagtgctgctgcttcgtccatggctgcgctgaaacagccaaccattcgagttgttgctataattgctgaaggtgttcctgagtcagacaccaagcagttgattgcatatgcccgctccaacaataaggttgttattgggccagctaccgttggaggaattcagggtggagcttttaagataggtgacactgctggaacaattgacaatattattcagtgcaagctgtacaggcctggatctatcggctttgtctccaaatccggtggcatgtcaaatgaaatgtacaacactattgcccgtgttacagatggaatctatgaaggcattgcaattggaggagatgtcttcccaggctccactttatctgaccatatcttgcggtttaacaatattcctcaggtaaagatgatggttgtccttggagaacttggtggacgagatgagtattctttagttgaagccttgaaacagggaaaagtgaacaagccagttgttgcttgggtcagtggaacttgtgcacgactcttcaaatcagaagtacagttcggtcatgctggagctaagagtggtggtgagatggagtctgcacaggggaagaatcaagcactaagggaagctggagctattgttcccacttcatatgaagctttggaagctgcaatcaaggagacatttgagaaactggttgaagaagggaagattacacctgtgaaggaagttaagcctccacaaatcccagaagatcttaacagtgcaattaagagcggaaaagttcgtgctccaactcatattatttcgaccatctctgatgacagaggtgaggagccatgctatgctggtgtgcccatgtcttccattgttgagcaaggttatggtgttggtgatgtcatttctctcttgtggttcaaacgtagccttccccgttactgtactcattttatcgagatatgcatcatgctctgtgccgaccatggtccctgtgtctctggtgctcacaacactatcgtgactgcaagagctgggaaggaccttgtttccagccttgtttcaggtttgcttactattggtcctcgatttggtggtgccattgatgatgctgctcgatactttaaagatgcttatgataggggtcttacaccttatgaatttgttgaaggcatgaaaaagaagggcattcgtgtgccaggaattggccacaggatcaagagaggggacaacagagataagagagtagagctcctccaacggtttgcacgcacacatttcccatctgtgaagtacatggaatatgccgttcaagttgaaacctatactctctcaaaggctaacaaccttgtcctcaatgtggatggtgccatcgggtctcttttcttggatcttcttgctggaagtggaatgttcagcaaacaagagattgatgagatagttgagattggttacctgaatgggctttttgtgctagcacgatctattggtttgattgggcacacttttgaccagaagagattgaagcagccactgtaccgtcacccatgggaggatgttctctacaccaagtgagagattcattcgcagcaggtgcaacaaccacctgcgctcctcgagcattttcttggagttcttgtgtctgcattttgatggggtaatggtttgtttggttcttaggttagtgttcgtaacgctagatggtgggcctcccatagtttaatttttattcgaagttggcaaggagagaaagtcttctgccaatttattaaacaaagtgatgtttgcttgattagattttgttcgtaggtaccagttccccggacaaataagagatgtcaggttgtatcttgtatgtgcgaaacggtacattgtatgagaatcccttcattctgaagtaatgtaggcagttcaaaaataagcttttctaattgtgaatcatatgaattgtgtaaaagaatgagattgaatatttaaatattcatataattttcaa

SEQ ID NO: 2506 - DNA, 2210 bp, Manihot esculenta
tctacaacaacatggccactggacaactcttttctcgaactacacaggctttgttttacaattataagcagcttcccattcaacggatgcttgattttgatttcctttgcgggagagaaactccatctgtggctggaattattaaccctggtgccgagggattccagaaactcttctttggtcaagaggaaattgcaatccctgtacattcaactattgaggcggcttgtgctgctcacccgactgccgatgtatttataaattttgcatcatttagaagtgcggctgcatcatccatgagtgccctgaaacagcccaccattcgagttgtggctataatagctgaaggagttcccgagtcagacaccaaacagttaattgcatatgcacgatctaacaataaggttgtcatcggcccagctactgttggaggcattcaggctggagcattcaagataggtgatactgctggaacaattgacaacataattgcttgcaagctgtacaggcctggatctgttggatttgtttccaaatctggtggtatgtcaaatgagctatataatacaattgcccgtgtgacagacggcatatatgaaggtattgcaataggaggagatgtgtttccaggctccacactttctgatcatgttttgcggtttaacaatatcccacaggttaagatgatggttgtactaggggaacttggtggacgagatgagtactcccttgttgaagccctcaaacagggaaaggttaccaaaccagtagttgcttgggtcagtggaacatgtgctcggctcttcaagtcagaagtgcaatttggtcatgctggtgctaaaagtggtggagagatggagtctgctcaagcaaaaaatcaagcactaaaggatgccggagctgtagttcccacttcatatgaagcttttgagactgcaattaaagagacatttcagaagctggttgaagaagataagattccacctgtaaaggagattaagcctccacaaattccggaggatctcaattcagcaattaagagtggcaaagtccgggctccaactcatattatttccacaatctctgatgaccgaggtgaagaaccatgttacgctggtgtgccaatgtcttccatcgttgaacagggttatggtgttggtgatgtcatctctcttttgtggttcaaacgaagccttcctcgttactgtactcatttcattgagatatgtatcatgctatgtgctgaccatggtccctgtgtctctggtgctcacaacactatagtaacggcaagggcaggaaaggacctagtttccagccttgtctcaggtttgctgacaataggtccccgatttggtggtgctattgatgatgccgctcgatactttaaggatgcttatgacaggggtctaacaccctacgagtttgttgaaggcatgaaaaagaagggtattcgagttcctggtattgggcacaggatcaagagaggggacaacagagataaaagggtagagctattgcagcggtttgctcgcacacatttcccttctgtaaaatacatggagtatgctgttcaagtggaaacctatactctatcgaaagccaataacctggtgcttaatgttgacggtgcaattgggtcccttttcttggatcttcttgctggcagtggaatgtttaccaaacaggagatagatgagattgttgagattggctatttgaatgggctctttgtgttggcacgttccattggtctgattgggcacacattcgaccagaagagactgaaacagccactataccgtcacccatgggaggatgttctgtacaccaagtgagagaatttgcatatggcaggtgctatgctgatatgctctcaactttctacaagcttttcactttccaaatttatctgagtttgcaatttgttgcaatgattagtgttgtactgttgacaggctgagggccttaatttgtaacttgtattaatggtttacaaattgggctcctaccatttattcagagaaatattgcgtagtctttcttcaggtttcaaggagaaataaccgagttatgatgcatgaggcctgggaattcctccatatttctctgtgttggcaaaatttgtttaaacagcatcgtaggcaagcaacttttattatgttttatatttcattagttttaaattttataaaaagataaattttaca

SEQ ID NO: 2507 - DNA, 2021 bp, Gossypium hirsutum
ccctttgagccgaagccatggccactggacagttattttctcggaccactcaagcgttattctacaattacaaacaacttcctattcaacgcatgcttgattttgatttcctttgcgggagggaaacaccatctgttgctggtattattaatcccggtgctgagggatttcagaaactcttctttggtcaagaggaaattgcgatcccagtacattctaccattgaagcagcatgtactgcacacccaactgctgatgtttttatcaactttgcatctttccgaagtgctgctgcttcatccatggctgctctgaaacagccaaccattcgagttgttgctataattgctgaaggtgttcctgagtcagacaccaagcagttgattgcatatgcacgttccaacaataaggttgttattggcccagctaccgtcggaggaattcaggctggagcttttaagattggtgacactgctggaacaattgacaacattgttcaatgcaagctgtacaggcctggatctgttggctttgtctccaaatctggtggtatgtcaaatgaaatgtacaacacaattgcccgtgttacagatggaatctatgaaggtattgcaattggaggagatgtcttccctggctccactttatctgaccatattttgcgatttaacaatattccacaggtaaagatgatggttgtgctcggagagcttggtggacgagatgagtattccttggttgaagccctgaaacagggaaaagtgaacaagccagtggttgcttgggtcagtggaacttgtgcacgactcttcaagtcagaagtacagtttggtcatgctggagctaagagtggtggtgagatggagtctgcccagggaaagaatcaggcactaagggatgctggagctatagttcccacttcatatgaagcttttgaagctgtgatcaaggaaacatttgacaaactggttgaacaagggaagattacacccgtgaaggaagttatgcctccacaaatcccagaagatcttaacaatgcaattaagagcgggaaagttcgtgctccaactcacattatttcaaccatctctgatgacaggggtgaggaaccatgctatgctggtgtgcccatgtcttccattgtcgagcgaggttatggtgttggtgatgtcatttctctcttgtggttcaaacgtagccttcccagatactgtactcattttatcgagatatgcatcatgctctgcgccgaccatggtccatgtgtctctggtgctcacaacaccatagtgactgcaagagctggaaaggacctagtttccagccttgtttcaggtttgctgactatcggtcctcgatttggtggtgccattgatgatgctgctcgatactttaaagatgcttatgaccggggccttacaccttatgaatttgttgaaagcatgaaaaagaagggtattcgtgtgccaggaattggccacaggattaagagaggggacaacagagataaaagagtagagctcctccaacggtttgctcgcacacatttcccgtctgtaaagtacatggaatatgccgttcaagttgaaacatatacgctttccaaggctaacaaccttgtcctcaacgttgatggtgccattgggtctcttttcttggatcttcttgctggaagtggaatgttctccaagcaagagattgatgagatagttgagatcggctaccttaatggactctttgtgttagcaagatccattggtttgattgggcacacattcgaccaaaagagattgaagcagccactataccgtcacccatgggaggatgttctctacaccaagtgagagagagccattcacggcaggtgcgtgcaacggcgacctgcttttcttttttctcgagcattcttgttttcgaagtcattggtgtctgcattttggagggaggggggttattggttgttttgttcttccattagtgtttgtaatgttaattggtgttgtattcaaagattacgagat

SEQ ID NO: 2508 - DNA, 2051 bp, Gossypium hirsutum
  misc_feature (936)..(936): n is a, c, g, or t
  misc_feature (1115)..(1115): n is a, c, g, or t
  misc_feature (1956)..(1956): n is a, c, g, or t
  misc_feature (2026)..(2026): n is a, c, g, or t
tttccttccaactgtctctcttcaggtccctttgagccgaagccatggccactggacagttattttctcggactactcaagcgttgttctacaactacaaacaacttcctattcaacgcatgcttgattttgatttcctttgcgggagggaaacaccatctgttgctggtattattaatcccggtgctgagggatttcagaaactcttctttggtcaagaggaaattgcgatcccagtacattctaccattgaagcagcatgtactgcacacccaactgctgatgtttttatcaactttgcatcattccgaagtgctgctgcttcatccatggctgctctgaaacagccaaccattcgagttgttgctataattgctgaaggtgttcctgagtcagacaccaagcagttgattgcatatgcacgttccaacaataaggttgttattggcccagctactgtcggaggaattcaggctggagcttttaagattggtgacactgctggaacaattgacaacattgttcaatgcaagctgtacaggcctggatctgttggctttgtctccaaatctggtggtatgtcaaatgaaatgtacaacacaattgcccgtgttacagatggaatctatgaaggtattgcaattggaggagatgtcttccctggctccactttatctgaccatattttgcgatttaacaatattccacaggtaaagatgatggttgtgctcggagagcttggtggacgagatgagtattccttggttgaagccctgaaacagggaaaagtgaacaagccagtggttgcttgggtcagtggaacttgtgcacgactcttcaagtcagaagtacagtttggtcatgctggagctaagagtggtggtgagatggagtctgcccaggcaaagaatcaggcactaagggatgctggagctntagttcccacttcatatgaagcttttgaagctgtgatcaaggaaacatttgacaaactggttgaacaagggaagattacacccttgaaggaagttatgcctccacaaatcccagaagatcttaacagtgcaattaagagcgggaaagttcgtgctccaactcacattatttcaaccatntctgatgacaggggtgaggaaccatgctatgctggtgtgcccatgtcttccattgtcgagcgaggttatggtgttggtgatgtcatttctctcttgtggttcaaacgtagccttcccagatactgtactcattttatcgagatatgcatcatgctctgcgccgaccatggtccatgtgtctctggtgctcacaacaccatagtgactgcaagagctggaaaggacctagtttccagccttgtttcaggtttgctgactatcggtcctcgatttggtggtgccattgatgatgctgctcgatactttaaagatgcttatgaccggggccttacaccttatgaatttgttgaaggcatgaaaaagaagggtattcgggtgccaggaattggccacaggattaagagaggggacaacagagataagagagtagagctcctccaacggtttgctcgcacacatttcccgtctgtaaagtacatggaatatgccattcaagttgaaacatatacgctttccaaggctaacaaccttgtcctcaacgttgatggtgccattgggtctcttttcttggatcttcttgctggcagtggaatgttctccaagcaagagattgatgagatagttgagatcggctaccttaatggactcttcgtgttagcaagatccattggtttgattgggcacacatttgaccaaaagagattgaagcagccactataccgtcacccatgggaggatgttctctacaccaagtgagagagagccattcacggcaggtgcgtgcaacggcgacctgcttttcttttttactcgagcattcttgttttcaaagtcattggtntctgcattttggagggaggggggttattggttgttttgttcttccattagtgtttgtaatgctaattggngttgtattcaaagattacgagatga

SEQ ID NO: 2509 - DNA, 2136 bp, Arabidopsis lyrata
agctgagctgatcttatttgtttcttccctcccatttattccattcccttcccttcctcctaactacaaaacaatctactctccacctaacattgctcagtgaccacagttttcttttcgagccaataacatggctacgggacagctattttcacgcaacacacaggcgttgttctacaattataagcagcttcccattcagcggatgcttgattttgatttcctatgtgggcgagaaactccttctgttgctggtatcattaacccaggttccgagggattccaaaagctattttttggtcaggaggagatcgccatccctgtccacgcagccattgaggcagcatgcgctgcgcatcccacagcagatgtattcatcaacttcgcatcgtttagaagtgctgctgcttcctccatggctgctttgaagcagccaactattaaagtagtggccataatagcagaaggtgttccagagtcagacactaagcagttgattgcttatgctcgtgctaacaataaggttattattggaccagctactgttggaggcgttcaagctggagcctttaaaattggtgacactgctggaacaattgacaatatcatccagtgcaagttgtacagacctggatctgttggctttgtctcaaaatctggtggaatgtctaatgaaatgtacaataccattgcccgtgtgacagatgggatctatgaaggcattgctattggtggggatgtgttcccgggctcaactttatctgaccatatcctgcggtttaacaacatcccacagattaagatggtggttgtacttggagagcttggaggaagagatgaatactctctagttgaagccatgaaacagggaaaagtgaccaaaccagtggttgcttgggtcagcgggacttgtgcacgtctcttcaagtccgaagtacaatttggtcatgcaggggccaaaagtggtggagagatggagtctgcacaagccaagaatcaagcgctaaaagacgctggagctactgtacccacttcattcgaagccctagaatctgcaatcaaggaaacttttgacaaattggttgaagagggaaaggtctctcctattaaggaagtcactcctccacaaatccctgaagatctcagctcggcaattaagagtgggaaagtccgggctcctacccacatcatctccaccatttctgatgacagaggggaggaaccatgctatgctggtgtgccaatgtcatccatcattgaacagggttatggcgtgggagatgtcatttctctcctatggttcaaacgtagtcttcctcgttattgtaccaaattcattgagatatgcataatgttgtgcgctgaccacggtccatgcgtctctggcgctcacaacaccatcgtaacagcaagagcaggaaaagatcttgtctcaagtcttgtttcaggtctattaacaattggtcctagatttggtggtgccattgatgatgcagcacgatacttcaaggacgcttgtgacaggaatctcacaccttatgaattcgtggaaggcatgaagaagaagggaatccgtgtccctggcattggtcacaggataaagagcagggacaacagagacaaaagagtggagctgcttcagaaatttgcacggtctaacttccctgcagttaagtacatggaatatgcggtccaagtagagacatacacactgtctaaagccaacaatcttgtaatgaacgttgatggagccattggatctctcttcttagaccttctcgctggaagtgggatgttcactaagcaagagatagacgaaatcgttcagataggttatctcaacggcctcttcgtccttgctcgatccattggtttaatcgggcacacattcgatcagaagagattgaagcagccactgtaccgacacccgtgggaagatgtcttgtacaccaagtaatcatatcattattcacttcttaattattattctctcccattaagttaggatttgttcaattatatagttgttctgacaattatctgttgtgatctctcaatacttataagaataaaagaaagttcaattttagaagaatcataatgttttgtttaaattcttttaaaaagttcaatata

SEQ ID NO: 2510 - DNA, 2128 bp, Glycine max
cccaactcgccctcgactcacatccttgtccgattccgcgaacgagtcgagtgaatcgggttggtaagatctattctgtttcttcgtcatggcaaccggacaactattctcgcgtactacacaggctttgttttacaactacaagcaacttcccatccagcggatgcttgattttgacttcctttgcggcagggaaacaccatcagttgctggaataattaaccctggttctgagggatttcaaaaacttttttttggtcaggaggaaattgccatcccagtgcatgctaccgttgaagcagcttgtgctgcacatcctactgccgatgtcttcatcaactttgcttcatttagaagtgctgcagcatcatccatggctgctttaaaacagccaacaattagagttgttgctattattgctgaaggagtacccgagtcagacactaagcaattgattgcatatgcccgatcaaacaataaggttgttattggcccagccacagttggaggcattcaagcaggtgcttttaaaattggtgacacagctggaacaattgacaatataattcagtgcaagctctacaggcctggatctgttggatttgtttctaaatctggtgggatgtccaatgaactatacaacactattgcccgcgtaactgatgggatttatgaaggcattgctattggaggagatgttttccctggttccacactttctgaccatgttttacggtttaacaacatgccacaggttaaaatgatggtagtacttggggaacttggtgggcgtgatgagtattccttagtggaggccttaaaacaaggaaaagtatccaaaccggttgttgcctgggtcagtgggacatgtgcacgactattcaaatctgaagtacaatttggtcatgcaggagccaaaagtggtggtgagttggagtctgctcaagcaaagaatcaggcactaagggatgctggagctgttgttcccacatcatatgaagcttttgaagtttcaattaaggaaacatttgataaattggttgaagatgggaagatcacaccaatcaaggaaatcacacctccaccaatccctgaggaccttagtactgcaattaagagtggaaaagtccgtgctccaactcatattatttccaccatttctgatgacagaggagaggagccatgctatgctggtgtacccatgtcttccattattgaaaaaggttatggtgttggtgatgttatctctcttttgtggtttaaacgaagccttccccgttactgtactcaatttattgagatatgcatcatgctatgtgccgaccatggtccttgtgtctctggtgctcacaatactattgtgacagcaagggctgggaaggacctagtttctagtcttgtatcaggtttgcttacaattggtcctcgatttgggggtgccattgatgatgctgctcgctacttcaaggatgctcatgacagggcgcttagtccttatgagtttgttgaaagtatgaagaagaagggaattcgtgtgccaggaatagggcacaggatcaagaatagggacaacaaagataagagagttgagctgctacagaagtttgcacgcacacattttccttctgtgaaatacatggaatatgctgttcaagttgagacctacacgctcacaaaggcaaataatttagttcttaacgtagatggtgcaattggatctcttttcttggatcttcttgctggtagtggaatgttcaccaaacaagagattgatgaaattgtggagattggctatctgaatggcctctttgtgctggcacgctccattggtctgattgggcacacctttgaccaaaagcgattgaagcaaccactttaccgtcacccatgggaggatgttctctacacaaagtgagaaagttttgtgcgactgtaagaactttggcatgcttcaaattagcaatcttttgggaaatcatgcacatctgaaatatgctggagtggttttgtagctgttagactagtgttgtacgatctattggtgaaaagtcatcttccatttgtaacttgtattaaatttcataaagagagaacttggtcatttttaaaattatatttctcttgatga

SEQ ID NO: 2511 - DNA, 2191 bp, Vigna unguiculata
  misc_feature (510)..(512): n is a, c, g, or t
  misc_feature (719)..(719): n is a, c, g, or t
  misc_feature (734)..(734): n is a, c, g, or t
  misc_feature (738)..(738): n is a, c, g, or t
  misc_feature (746)..(746): n is a, c, g, or t
  misc_feature (749)..(749): n is a, c, g, or t
  misc_feature (1568)..(1568): n is a, c, g, or t
cgctcttgactcacttcctctccgattccgcgaggcgagtgaatcagttgagatcgatctgtttcttcatcatggccactggacaactattctcccgcactacacaagctttattttacaactacaagcagctgcccatccagcggatgcttgattttgactttctctgtggcagggaaaccccatcagttgctgggataattaatcctggttctgagggatttcaaaaactcttttttggtcaggaggaaattgccatacctgttcattctgccattgaagcagcatgcgctgcacatcctactgccgatgtcttcatcaactttgcttcatttagaagtgctgcagcatcatccatggctgctttgaagcagccaacaattagagttgttgctattattgctgagggggtacctgagtcagacactaagcaattgattgcatatgcccgtgcaaacaataaggttgttattggtccagctaccgttggaggcattcaagctggtgctnnnaaaattggtgacacagctggaacaattgacaatataattcagtgcaagctctacaggcccggatctgttggatttgtttctaaatctggtgggatgtccaatgaactatacaacactattgcccgtgtaactgatgggatttatgaaggcattgccattggaggggatgttttcccaggttccacactttctgaccatgttttacgntttaacaacataccncagnttaaaatnatngtagtacttggggaacttggtgggcgtgatgagtattccttagtggaagctctaaaacaagggaaagtatcaaaaccagttgttgcctgggttagtgggacatgtgcgcgactattcaaatctgaagtacaatttggtcatgcaggagctaaaagtggcggtgagttagaatctgctcaagcaaagaatcaagcactaaaggatgccggagctgttgttcccacatcatttgaagcttttgaagctgcaattaaggaaacatttgacaaattggttgaagaagggaaggtcacaccagtcaaggaaatcactcctccaccaatccctgaagaccttagctctgctattaagagtggaaaagtccgtgctccaactcatattatttccaccatttctgatgacagaggtgaggagccatgctatgctggtgtacccatgtcttccatcattgaaaaaggttttggtgttggtgatgttatatctcttctgtggtttaaacgcagccttccacgatactgtactcaatttattgagatatgcatcatgctatgtgccgaccatggtccttgtgtttctggtgctcacaatactattgtgacagcaagggctgggaaggatctagtttccagtcttgtgtcaggtttgcttactattggtcctcgatttggaggtgccattgatgatgctgctcgctacttcaaggatgctcatgacagggggcttacaccttatgagtttgtcgaaagtatgaagaagaagggaatccgtgtgccaggaatagggcacaggatcaagaatagggacaacaaagataagagngttgagctgctacagaagtttgcgcgcacacattttccttctgttaaatacatggaatatgctgttcaagttgaaacctacaccctcacaaaggcaaataatttagttcttaacgtagatggtgcaattggatctcttttcttggatcttcttgccggtagtgggatgttcagcaaacaagagattgatgaaattgtggagattggctatctgaatgggctctttgtgctggcacgctccattggtctgattgggcacacctttgaccagaagcgattgaagcaacctctttaccgtcacccatgggaggatgttctctacacaaagtgagaaaaaattgcgattgtgagaactttgcattgcattagcaatcttttgggaaatcatgcatctgaaatatggtggagttagactagtgttgtacggtctattggtgaggataaatttcataaagagagaatttgggtcatttatatttttattgatgaacatcgatgtatgtgaattcaataggaaattatcacataaattgaagctcgtgttggccaagttgccgaaatattttgttattaactacaaaagttttaaaacacttggtggactgttttgtcatgcacaaagta

SEQ ID NO: 2512 - DNA, 2251 bp, Lotus japonicus
agtcagatctctctgattctttaacatggcgaccggacaactattctctcgtactacgcaagctttattttacaactacaagcaacttcccattcagcggatgcttgattttgacttcctttgtggtttggaaacaccatctgttgctggaataattaaccctggttctgagggatttcaaaaactcttttttggtcaggaggaaattgccatcccggtccatcctaccattgaagcagcttgtgctgcacatccgaccgctgatgtcttcatcaattttgcatcatttagaagtgctgcagcatcatccatgtctgctttgaagcagccaacaattagagttgctgctattattgctgaaggagtacctgagtcagacactaaggaattgattgcatatgctcgggcaaacaataaggttgttattggccccgccacggttggaggcattcaagctggggcttttaaaattggagatacagctggaaccattgacaatataatccactgcaagctctacaggcccggatctgttggatttgtttcaaaatctggtgggatgtccaatgaattatacaacaccattgcccgtgtaactgatgggatttatgaaggcattgccattggaggagatgttttcccaggttccaccctttctgaccatgttttacggtttaacaacataccacagattaaaatgatagttgtacttggagaacttggtgggcgtgatgaatattccttggtggaagccctaaaacaagggaaagtgacaaagccagttgttgcctgggttagcggaacctgtgcacgactcttcaaatctgaagtacaatttggtcatgctggagctaaaagtggtggtgaaatggagtctgctcaagcaaagaatcaggccctaaaagacgctggagctgctgttcctacttcgtttgaagcttttgaagctgcaattaaagaaacatttgacaaattggttgaagaagggaaggtcacaccagtcaaggaaataactcctccaccaatccctgaggatcttagcactgcaattaagagcggaaaagtgcgtgctccgactcatattatttcaaccatttctgatgatagaggtgaggagccatgctatgcgggtgtacccatgtcttccatcattgaaaagggctatggcgtgggtgatgttatctctcttttgtggtttaaacgcagccttcctcgttactgtactcaatttattgagatatgcattatgttatgcgcggaccatggtccttgtgtctcgggtgctcataatactattgtgaccgcaagggctgggaaggacctagtttctagtcttgtatcaggtttgcttacaatcggtcctcgatttgggggtgccattgatgatgctgctcgctacttcaaggatgctcatgacaggagtcttacaccttacgagtttgtcgaaagtatgaagaagaagggaattcgtgtgccaggaatagggcataggatcaagaacagggacaacaaagacaagagagttgagctgttacagaagtttgcacgaactcattttccttctgtgaaatacatggaatatgctgttcaagttgaaacctacaccctcacgaaggcaaataatttagttcttaatgtagacggcgcaattggttctcttttcttggatcttcttgctggtagcggaatgttcaccaagcaagagattgatgaaattgtggagataggctatctgaatgggctctttgtgctggcacgttccattggtcttatcgggcacacctttgaccaaaagagattgaagcaaccactctaccgtcacccatgggaggatgtactctacacaaagtgaggattttgaacggctggaacaactttgccatatttcagacttgcttggtgaaatcatgcatgagatggggtggaatgatattttttttagctgctagactagtgttgtaagatgtatggttgaaaaaccatcttcagttcgtatgttgtatttaatttccaaagaaataatcatttttaaaattgattttcctgatcaaaattgtgatctctgttctgttgtggctttaataggaattgatcatagtccaagaccaaccatgtattctgtaattttacgaaatgttgtaaaccataagctcgtatcatgtatgtttccatgtttaagggtaacaacaacttcaaattttcaattcctcattcatggaaagattgtgttccaatgaacattcactcaaac

SEQ ID NO: 2513 - DNA, 2276 bp, Gossypium hirsutum
  misc_feature (1551)..(1551): n is a, c, g, or t
  misc_feature (1919)..(1919): n is a, c, g, or t
  misc_feature (2096)..(2096): n is a, c, g, or t
  misc_feature (2204)..(2204): n is a, c, g, or t
aatttccagcttttcttttctatccttttctcgtctcgtcttttcttttcctttcgcgaggcgagcgagccactgtaatcttttcctttccttacaacttactcatcaggtctctttgagtcgaagccatggccaccggacagttgttttctcgaacaactcaagccttattctataactacaaacaacttcctattcaacgcatgcttgatttcgatttcctttgcgggagggaaacaccgtccgtcgctggtatcattaatcctggtgccgagggatttcagaaactcttctttggtcaagaggaaatagcgatcccagtgcattcaaccattgaggcagcatgtgctgcacatccaactgccgatgtttttattaactttgcatcatatcgaagtgctgctgcttcgtccatgtctgctctgaaacaacctaccattcgagttgttgctataattgctgaaggtgttcctgaatcagacaccaaacagttgattgcatatgcacgttccaacaacaaggttgttattggcccagctactgttggaggaattcaagctggagcttttaagataggtgacactgctggaacaattgacaatattgttcactgcaagctgtacaggcctggatctgttggctttgtctccaaatctggtggcatgtcgaatgaaatgtacaacactattgcccgtgttacagatggaatctatgaaggcatagctattggaggagatgtcttcccaggatccaccttatccgaccatattttgagatttaacaacattccacaggtcaagatgatggttgtccttggagaacttggtggacgagatgagtattccttagttgaagccctgaaacagggaaaagtgaacaagccagtggttgcttgggtcagtggaacttgtgcacgactcttcaaatcagaagtacagtttggtcatgctggagctaagagtggtggtgagatggagtctgcacaggcaaagaatcaagcactaagggaagctggagctgttgttcccacttcatatgaagctctggaagctacaatcaaggaaacatttgagaaactggttgaagaagggaagattacaccggtcaaggaagttaagcctccacaaatcccagaagatcttaacagtgctattaagagcgggaaagttcgtgctccaacacatattatttcgaccatctctgatgacagaggggaggaaccatgctatgctggcgtgcccatgtcttccattgttgagcaaggtcttggtgttggtgatgtcatttctctcttgtggttcaaacgtagccttccacgatactgtactaaatttatcgagatatgcatcatgctctgtgctgatcacggtccctgtgtctctggtgcgcacaacactatagtgactgcaagagctgggaaggaccttgtatccagtcttgtgtcaggtttgcttacaattggtcctcgctttggtggtgcaattgatgatgctgcacgatactttaaagatgcttacgataggggtcttacaccttatgaatttgttgaangcatgaaaaagaagggcatccgtgtgcctggaattggtcacaggatcaagagaggggacaacagagataagagagtagagcttctccaactgtttgctcgcacaaatttcccatctgtgaagtacatggaatatgccgttcaagttgaaacctacactctctcaaaggctaacaaccttgtcctcaacgtggatggtgccatcgggtcacttttcttggatcttcttgctggtagtggaatgttcacaaagcaagagattgatgagattgttgagattggctacctaaatgggctctttgtgctagcacgatccattggtttgattgggcacactttcgatcagaagagactgaagcagccactatancgtcacccatgggaagatgttctctacactaagtgagagaacattacgagcagcaggtgcaatctcctcgagcattgttgttacaggagtccttgtttgtgtctgcatttttatggggtatggtggtttggttcttagattattgtttgtaaggtaaggctaaatggtagatcaccntcatttctaagttgtattcaaggtccacataggagagaaaagaaatctcaaaaatgttgcgtgattcgtttttagttttttaccagtttcacggataaataagacatntcgtgcacattgtattgtaatattttatgagaaatttcgaaattaggaatcatctattctcggattatacaa

SEQ ID NO: 2514 - DNA, 2260 bp, Carica papaya
caggttgtgtggagtctcaacatggcaacgggacaactcttctcacgctccactcaagccttgttctacaactacaagcaactccccgtccaacggatgcttgattttgattttctttgcgggagggaaacaccttctgttgctggaataattaatcctggttctgagggatttcagaaactcttttttggtcaagaggaaattgcaatccctgtacattcggctattgagacagcttgtgctgcacatccaactgctgatgtcttcattaactttgcatcatttagaagtgcggctgcctcatcaatggctgctctgaaacagccaaccattagggttgtcgcaataatagctgaaggtgttccagaatctgacaccaagcaattgattgcttatgcccgtgcaaacaataaggttgtcattggccctgctactgttggaggtattcaagcaggagcttttaagattggtgacactgctggaacaattgacaacatcacccaatgcaagctttacaggcctggatctgttggttttgtctcaaaatctggtggtatgtctaacgaaatgtacaacactattgcccgtgtaacagatggtatttatgaaggtattgcaattggaggcgatgtgttccctggctctactctgtcagatcatgttttgcggtttagcaatattccccaagtaaaaatgatggttgtacttggcgaacttggtgggcgagatgaatattctcttgttgaggccctgaaacagggaaaagtgaccaaaccagtggttgcttgggttagtggaacttgtgctcgactcttcaagtcagaagtacagtttggtcatgctggggccaaaagtggtggtgaaatggaatctgcacaagccaagaatcaagccctacgggatgctggagctgttgttcccacttcatatgaagcttttgaagctgcaatcaaggaaacatttgagaagttggttgaagaggggaagattgctcctgtcaaggaagtgaagcctccacaaatccctgaggatcttaactctgcaattaaaagtggcaaagttcgggcacccactcatattatttctaccatctctgatgacaggggtgaggagccatgctatgcgggtgtgccaatgtcttctattgttgaacagggttatggtgtgggtgatgtaatctcacttttgtggtttaaacgtagccttcctcgatattgcaccaaatttattgagatatgtatcatgttatgtgcggaccatggcccctgtgtttctggtgctcacaacactattgtaactgctagggctggcaaggaccttgtttccagccttgtttcaggtttgcttacgattggtcctcgatttggtggtgctattgatgatgctgcacgatacttcaaggatgcatatgacaggggtcttacaccatatgaatttgttgagggcatgaaaaagaagggcatccgtgtgccaggaattggacacaggatcaaacggggagacaacagagataagagagtagagttgctccaattatttgcacggacacatttcccatcagtgaagtatatggaatatgctgttcaagttgaaacttacactctctcaaaggccaataacctggtccttaatgttgatggtgcaattgggtcccttttcttggatctccttgctggtagtggaatgttcagcaagccagagattgatgagattgttgagattggctatctgaacgggctattcgtgctggcacgctccattggtttgattggacacacctttgatcagaagagattgaaacaacccctatatcgccatccatgggaagacgtactgtataccaagtgagagaaatcacctattacaggtgcaagcacctacttgctcttgaggaaacttttttccccttttaactttgatattgctgaatctccaatttgctgaaattatcaatcaattccctaggaatagtcttgattgcttctctaatggcatgttgagtatcttcatttgtaatcatttataaaaggcagtgatgaatccataagatatcctttaacttcctcatccaatgaaaaaagaacaatttactatgcaagggaatctcttcatctccttgtaggcttccagtgtactcaaataaggtccaatgtggacctgatctgtcttttggttaccaaaatatcgcgattttgttgttttttcttgtaatgaaatgttactagtaatagtgctatttgtataacatttttgtgctcta

SEQ ID NO: 2515 - DNA, 2255 bp, Cucumis sativus
ttttaccattttctccttctctatataaaatcccattcccatttctcaacttccagtgttcaatttcccgttaatcccaccaccgccggattcccatccctcactttccgttcagtttcctttgacggtcaccatggctactggacaaatattttctcgtacgacccaagcactgttctataattacaagcaactacccatacagcggatgcttgactttgacttcctttgcggtagggaaacaccatcagttgcgggaatcatcaatccaggtgctgaaggatttcagaaactcttttttggtcaagaggaaattgccatccctgtgcattctacgattgaagcagcttgtgcagcacatcccacagccgatgtcttcatcaactttgcatccttcagaagtgctgctgcatcatcattgtctgccttgaaacagcctaccatcagagttatagctatcatagctgaaggtgttccagagtcagacaccaaacagttgattgcatatgcacgagctaacaataaggtcgttataggtccagctactgttggtggtattcaagctggtgcatttaagatcggtgacactgctggaacaattgacaatatagtacagtgcaagctatacaggcctggatctgtgggctttgtctccaaatcaggtggaatgtctaatgagatgtacaacactattgcccgtgttacagatggaatttacgaaggtattgcaattggaggtgatgtgtttccaggttccactctttcggatcatattttgcggtttaacaacatcccacaggttaagatgatggtcgtactaggagaacttggtggtagggatgagtattctttagttgaagccatgaaacaaggaaaagttaacaagccagtggttgcctgggttagcggtacttgtgcgacattgttcaaatctgaagttcaatttgggcatgctggagcaaaaagtggtggtgagttggagtctgcacaagcgaaaaaccaagctttaagagatgctggagcaatcgttccaacttcatatgaagcccttgaagatgcaattaaggaaacatttggaaaattggtggaagagggtaaaattactccagtaaaggaagtgaagcctccacaaattcctgaagatcttaactcagcaattaagagtggcaaagttcgggcgccaacccacattatttccaccatttctgatgacagaggtgaggagcccagctatgctggaattccaatgtcttccattgtggagcaaggttatggtgttggggatgttatctcactattatggttcaagcgcagccttcctcgatactgtacacattttattgagatatgcatcatgctctgtgctgaccatggtccttgtgtatccggagcacacaacaccatagtaacagctagggctggaaaagacctcgtgtccagccttgtctcaggtttgcttactattggccctcgatttggtggtgccattgacgatgccgctcggtattttaaggatgcatatgacagaaaccttacaccttacgaatttgtcgaaagcatgaagaagaaagggattcgtgtgcctggaattggccacaggatcaagagaggcgacaaccgagataagagagtggagctactgcaacggtttgctcggacgcatttcccatctgtgaagtacatggaatatgctgtgcaagttgaaacttacactctctcaaaggcaaacaacttggttcttaatgtagatggtgcaatcgggtcccttttcttggatcttcttgctggtagtggaatgttcagcaaacaagagattgatgagattgtcgagatcggctatttgaacgggctgttcgtcctggctcgatctattggtctgattggacacacttttgatcagaagagactgaaacaaccactttaccgtcatccttgggaagacgttctctacaccaaatgatgaaatcacaaatagcaagagttacaaatatcaatctcaagtagtacgtttcctttgcaatattgaatttatattattggtgccttctgcttcttctataattttgtggaatgtctctttttcttcttacatttcctccctttagaacaactgtttgtaaggccttagtgttacttcaaatttctcaggttttctagttcataaaaggaagaattgtagttcattttttaaataaacccaaaacaaaatgtcatcaatcactatctttatgtaaaattatgtctttatttgacca

SEQ ID NO: 2516 - DNA, 2020 bp, Ricinus communis
tctctctaatcggcgaattccccgaggctagaagagagtgactccatttctcgcctcagattgcttcagctgcattacattttctcgattcaatttgattcgatttgatttggtttacgttgttctgttccattaagatctggtctcaccatggctactggacaactattctctcgtactactcaagctttattttataattataagcagcttcctattcaacgcatgcttgattttgacttcctttgcggtagagaaacaccatcagtggctggaattattaaccctggatcagagggattccagaaactctttttcggtcaagaggaaattgcaatccctgtacattcagctattgaggcagcttgtgctgcacacccaaccgctgatgtattcattaactttgcatcatttagaagtgcggctgcatcatccatggctgccctgaaacagccaactattcgagttgtcgctataatagctgaaggagttcctgagtcagacaccaaacagttaattgcatatgcacgggcaaacaataaggttgtcattggcccggctactgttggaggcattcaggctggagctttcaagataggtgacactgctggaacaattgataacataattgcttgtaagctgtacaggcctggatctgttggatttgtctccaaatctgggggcatgtcaaacgagctatacaatacaattgcccgtgtaacagatggcatttatgaaggtattgcaatcggaggagatgtgtttccaggctccaccctttctgatcatgttttgcgttttaacaacataccacaggttaagatgattgttgtacttggggaacttggtggacgagatgagtattcccttgttgaagccctcaaacagggaaaggtgaataaaccagtggttgcttgggtcagtggaacttgtgctcgacttttcaaatcagaagtacaatttggtcatgctggtgctaaaagtggaggcgagatggagtctgctcaagcaaaaaatcaagcactaaaggatgctggagctgttgttcccacttcatatgaagcttttgagactgcaattaaggaaacatttcagaagctggttgaagagggtaagattacacctgtgaaggaggttaagcctccacaaatccctgaggatcttaatactgcaattaagagcggcaaagttcgtgctccaactcatattatatccactatctctgatgacagaggtgaggagccatgctatgctggtgtgcccatgtcttccattgttgaacagggttatggtgttggtgatgtcatctcacttttatggttcaaacgtagccttccacgttactgtacccattttattgaggcaaatatgcatcatgctgtgtgctgaccatggtccctgcgtctctggcgctcacaacactatagtaacagcaagggctggaaaggacctagtttctagtcttgtctcaggtttgctcacgattggcccccgatttggtggtgccattgatgatgcggctcgatactttaaggatgcttatgacagaggcctagcaccatacgagtttgttgaaagcatgaaaaagaagggtattcgtgttcctggaattgggcacaggattaagagaggtgacaacagagataaaagagtagagctgttgcaacggtttgcccggacacatttcccttccgtgaagtacatggagtatgccgttgaagttgaaacctacactttatcaaaggccaataacttggtcctaaatgttgatggtgcaattgggtccctgttcttggatcttcttgcgggcagcggaatgtttacaaaacaggaaattgatgagatcgttgagattggttatttgaatgggctctttgtgctggcacgttccattggtctcattggggcacacttttgaccagaagagattgaaacagccactataccgtcacccatgggaagatgttctctataccaagtgagagaattgcagatagcagatttcggtcactgagccatc

SEQ ID NO: 2517 - DNA, 1983 bp, Manihot esculenta
cctacaccatggccactggacaactcttctctcgtactacacaggctttgttttacaattacaagcagcttcccatccagcgcatgcttgattttgatttcctttgcgggagagaaactccatctgtggctggaattattaaccctggtgcagagggattccagaagctcttctttggtcaagaggaaattgccatccctgtacattcaactattgaagcagcttgtgcagctcacccaacggctgatgtatttattaactttgcatcatttagaagtgcagctgcatcatccatggctgccctgaagcagcctaccattcgagttgtggctataatagctgagggagttcctgagtctgacaccaaacatttaattgcatatgcacggtccaacaataaggttgtcattggcccagctactgtcggaggcattcaggctggagcattcaagataggtgacactgctggaacaattgagaacataattgcttgcaagctgtacaggcccggatctgttggatttgtgtccaaatctggtggtatgtcaaatgagctatacaatacaattgcccgtgttacagatggtatatatgaaggtattgcaattggaggagatgtgtttccaggctccactctttctgatcatgttttgcggtttaacaatatcccacaggttaagatgatggttgtacttggggaacttggtggacgagacgagtattcccttgttgaagccctcaaacagggaaaggtgaccaaaccagtagttgcttgggtcagtggaacttgtgctcggctcttcaaatcagaagtgcaatttggccatgctggtgctaaaagtggtggtgagatggagtctgctcaagcaaaaaatcaagcactaaaggatgctggagctgtagttcccacttcatatgaagcttttgagactgcaattaaggaaacatttcagaagctggttgaagagggtaagattgcacctgtaaaggagattaaacctcctcaaatccctgaagatcttaacacagcaattaagagtggcaaagttcgggctccaactcatattatttccacaatatctgatgatagaggtgaagaaccatgctatgctggtgtgccaatgtcttccattgttgaacagggttatggtgttggtgatgtcatctctctgttgtggttcaaacgcagccttccacgatactgtactcatttcattgagatatgcatcatgctatgtgctgaccatggtccttgtgtctctggtgctcacaacactatagtaacagcaagagctggaaaggaccttgtttctagccttgtctcaggtttgctcacaattggtccccgctttggtggtgctattgatgatgctgcgcgatactttaaggatgcttatgacaggggtttatcaccctatgagtttgttgaaggcatgaaaaagaagggtattcgtgtccctggaattgggcacaggattaagagaggtgacaacagggataaaagggtagagctcttacagctgttcgctcgcacacatttcccttctgtaaagtacatggagtatgccgttcaagttgaaacctatactctatcgaaagccaataacctggtgctcaatgttgatggtgcgattgggtctcttttcttggatcttcttgctggcagtggaatgtttaccaaacaggagatagatgagattgttgagatcggttacttgaatgggctcttcgtgttggcacgctccattggtttgatcgggcacacattcgaccagaagagattgaaacagcctctgtaccgtcacccatgggaggatgttctctacaccaagtgagagaattgcagatggcaggctgaggggccataattgtaacatgtatcagaagagtttacaagctaagttctgaccattttattcagagaaatgttgccttggaagtgatttttttttttaaaaagatgcttatgtggaaaagttttac

SEQ ID NO: 2518 - DNA, 2229 bp, Glycyrrhiza uralensis
taatattgcggttttcattcttcccggtcgagtgatcagcagatctatctgtttctttgtcatggcgactggacaactattctcccgtactacacaagctttgttttacaactacaagcaactacccatccagcggatgcttgattttgattttctttgcggtagagaaacaccatcagttgctggtataatcaatcctggttctgagggatttcaaaagctcttttttggtcaggaggaaattgccatcccagttcattctgccatcgaagcagcttgtgcttcacatcctactgctgatgtgttcatcaattttgcatcatttagaagtgcagctgcatcatctatggccgctttgaagcagccaacaattagagttgttgctattattgctgaaggtgtacctgagtcagacactaagcaattgattgcatatgctcgggcaaacaataaggttgttattggcccagccactgttggaggcattcaagctggtgcttttaagataggtgacacagccggaactattgacaatataattcattgcaagctctacaggcctggatctgttggatttgtttctaaatctggtgggatgtccaatgaactatacaacactattgcccgtgtaactgatggaatttatgaaggcattgccattggaggagatgttttcccaggctccacactttctgaccatgttttgaggtttaacaacataccacaggttaaaatgatggtggtacttggggagcttggtggccgtgatgagtattctctagtagaagccctaaaacaagggaaagtgaccaaaccagttgttgcctgggttagtggaacctgtgcacgactcttcaaatctgaagtacaattcggtcatgctggagctaaaagtggtggtgagatggagtctgctcaagcaaagaatcaggcactaagcgaagctggagctgttgttcccacttcatatgaagcttttgaagctgcaataaaggaaacatttgacaagttggttgaagaagggaagatcccaccagtgaaggagtttactcctccacaaatccctgaggaccttaacactgcaattaggagtggaaaagtccgtgcaccaactcatattatttccaccatctccgatgacagaggtgaggaaccatgctatgctggtgtacccatgtcttccattattgaaaatggttatggtgtgggtgatgttatctctcttttgtggttcaaacgcagccttcctcgttactgtactcaatttattgagatatgcatcatgctgtgtgctgatcacggtccttgtgtctctggtgctcacaatgctatagtgacagcaagggctgggaaggaccttgtctccagtcttgtatcaggtttgcttacaattggtcctcggtttgggggtgccatcgatgatgctgctcgctatttcaaggatgcttgtgacaggagtcttacaccttatgaatttgttgaaagtatgaagaagaagggcattcgtgtgccaggaatagggcacagaatcaagaatagggataacaaagataagagagtcgagctgctacagaagtttgcacgtactcattttccttctgtgaaatacatggaatatgctgttgaagttgaaaactacaccctcacaaaggcaaataacctagttctaaacgtagatggtgcaattgggtcacttttcttggatcttcttgccggtagtggaatgtttaccaaacaagagattgatgaaattgtagagattggctatcttaacgggctttttgttctggcacgctccattggtctgattgggcatacctttgaccaaaagagattgaaacaaccactctaccgccacccatgggaggatgttctgtacacaaagtgagggggttctgtatggatataagaacattgccttgcttcaaatcagcaatctttcggggaatcatgcataatgctggaagaatttcttttagctgttatactagtgtacggctatattggtatcaagccatcctccattcgtaagttgtataatttgttaagaattaacttagtcaaatttaaaattattttttctctcgacgaagattatgatctctgctctgttgtggcttcaaaaggaaatgatcattagttggagcacatcaaaagtgttgatcatctcagacttttatggtttatttatgccaagaacgattaaatagacaaaataagataaccccc

SEQ ID NO: 2519 - DNA, 2400 bp, Glycine max
agcgcccatccgaaattcaagcattttccttctcttcactcactccattccacacaaggccactctgattccctctctttcaatctctgatctccgccgcggattccaatcccctcccattctgtgagttaacgttttatccaatgcaatgctccctaataatggtagctgtttggtggtggtttaagactttgtttggtcttcggtctcatttactcactgcattgacaaatttgcttcttcgttttgtttcctttcttttaaagtgcggaattcaatgatgtactttggcatttccttttccgtggttataagagtgagggacgcgtgtggtttttcttcgtaaatgcctttgctgaatgttttgctttcttgtttttcaagtttcagaggtttcacattctgatctatctgtttcttcgtcatggccactggacaactcttctcccgtactacacaagctttgttttacaactacaagcaacttcccatccagcggatgcttgactttgactttctttgtggtagagaaacaccgtctgttgctggaataattaatcctggttctgagggatttcaaaagctcttttttggtcaggtggaaattgccatcccagttcatgctgatattgaagcagcttgtgctgcacaccccactgctgatgtgttcatcaattttgcatcatttagaagtgcagctgcatcatccatggctgctttgaagcagccaacaattagagttgttgctattattgctgaaggtgtaccagagtcagacactaagcaattgatagcgtatgctcgagcaaacaataaggttgttattggcccagccactgttggaggaattcaagctggtgcttttaagataggtgacacagctggaacaattgacaacataattcattgcaagctctacaggcctggatctgttggatttgtttctaaatctggtgggatgtccaatgaattatacaacactattgcccgtgtaactgatggaatttatgaaggaattgccattggtggagatgttttcccaggctccacactttctgaccatgttttgcggtttaacaacataccacaggttaaaatgatggttgtacttggggaacttggtgggcgtgatgagtattctcttgtggaagccctaaaacaagggaaagtgactaaaccagtggttgcttgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagatgcaataaaggaaacatttcacaaattggttgaagaagggaacgtcacacctattaaagagtttactcctccaccaatccctgaggaccttaacacagcaattaggagtggaaaagtgcgtgctccaactcacattatttccaccatctctgatgacagaggtgaggagccatgctatgctggtgtaccaatgtctaccattattgaaaatggttatggtgtgggtgatgtaatctctcttttgtggttcaaacgcagccttccccgttactgtactcaatttattgagatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgttatttcaaggatgcttatgacaggagtcttacgccttatgaatttgttgaaagtatgaagaataagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgatagggcatacctttgaccagaagagattgaaacaaccactctaccgccacccatgggaggatgttctttacacaaagtgaggggattctgtatggcaggaggaaccttgttatgcttcaaattagcatcttttgggaaattatgcatcaacgctagcatgatttagtttttagctgttagactagtatactacgagtctactggtatctagccatcttcagtttgtaag

SEQ ID NO: 2520 - DNA, 2002 bp, Glycine max
ccatcagatctatctgtttcttcgtcatggccactggacaactcttctcccgtactacacaagctttgttttacaactacaagcaacttcccatccagcggatgcttgactttgactttctttgtggtagagaaacaccgtctgttgctggaataattaatcctggttctgagggatttcaaaagctcttttttggtcaggtggaaattgccatcccagttcatgctgatattgaagcagcttgtgctgcacaccccactgctgatgtgttcatcaattttgcatcatttagaagtgcagctgcatcatccatggctgctttgaagcagccaacaattagagttgttgctattattgctgaaggtgtaccagagtcagacactaagcaattgatagcgtatgctcgagcaaacaataaggttgttattggcccagccactgttggaggaattcaagctggtgcttttaagataggtgacacagctggaacaattgacaacataattcattgcaagctctacaggcctggatctgttggatttgtttctaaatctggtgggatgtccaatgaattatacaacactattgcccgtgtaactgatggaatttatgaaggaattgccattggtggagatgttttcccaggctccacactttctgaccatgttttgcggtttaacaacataccacaggttaaaatgatggttgtacttggggaacttggtgggcgtgatgagtattctcttgtggaagccctaaaacaagggaaagtgactaaaccagtggttgcttgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagatgcaataaaggaaacatttcacaaattggttgaagaagggaacgtcacacctattaaagagtttactcctccaccaatccctgaggaccttaacacagcaattaggagtggaaaagtgcgtgctccaactcacattatttccaccatctctgatgacagaggtgaggagccatgctatgctggtgtaccaatgtctaccattattgaaaatggttatggtgtgggtgatgtaatctctcttttgtggttcaaacgcagccttccccgttactgtactcaatttattgagatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgttatttcaaggatgcttatgacaggagtcttacgccttatgaatttgttgaaagtatgaagaataagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgatagggcatacctttgaccagaagagattgaaacaaccactctaccgccacccatgggaggatgttctttacacaaagtgaggggattctgtatggcaggaggaaccttgttatgcttcaaattagcatcttttgggaaattatgcatcaacgctagcatgatttagtttttagctgttagactagtatactacgagtctactggtatctagccatcttcagtttgtaag

SEQ ID NO: 2521 - DNA, 2241 bp, Arabidopsis thaliana
ttaggtgtttctctttgtcaatgtaagatagagaaatcaattttgggtagaaagaagttgtgaactaactacctaccaataagccacatgactgtgagaagcttttgtttccctcccatttctctatattaatggtgcttcctctctaaaccattcctctctctttctctctaccaccatttattctctccttaatcactgactcgactcgggtcgtgaccagttttttctatctgagctatggcaacgggacagcttttttctcgtaccacacaagctttgttctacaactataagcagcttcctgttcaacgaatgctcgatttcgactttctctgtggacgtgaaacgccttctgttgctggaatcataaatcctggttctgaaggttttcaaaagctctttttcgggcaggaggaaatcgctatccctgttcatgccgccattgaggcagcttgtgctgcgcatccaacagcggatgtattcatcaactttgcatcttttaggagtgctgctgcttcatccatggctgctttgaagcagccgactattaaagttgtggcaattatagctgaaggtgttccagaatcagacactaagcagctgattgcgtatgctcgtgcaaacaataaggttgttattggaccggctactgttggaggtattcaagctggagcctttaagattggtgatactgcaggaacaattgataacattatccagtgcaagctatacagacctggatctgttggttttgtctccaaatctggtggaatgtctaatgaaatgtacaatactgttgcccgtgtgactgatgggatctacgaaggcattgctattggtggagacgtgttcccaggatcgactttatctgaccacatccttcggtttaacaacatcccacagataaaaatgatggttgtacttggagagcttggaggaagagatgaatactctcttgttgaagctttgaaagagggaaaagtcaataaacctgtggttgcttgggtcagtggaacttgtgcacgactcttcaagtctgaagtacagtttggtcatgcaggtgccaaaagtggcggcgagatggagtctgcacaagccaagaatcaagctctcatagatgctggagctattgttcccacttcatttgaagctctagaatctgcaatcaaagagacttttgagaaactggttgaagaaggaaaggtctctcctatcaaggaagtcattcctccacaaatccctgaggatctcaattctgcaattaagagtgggaaagtccgggctcctactcacatcatctccaccatatctgatgacagaggggaggaaccatgctatgctggtgttccaatgtcttccatcatcgaacaaggctatggagtgggtgatgtcatttcccttctatggttcaaacgtagtctacctcgttactgtacaaaattcattgagatatgcataatgctgtgtgctgatcacggtccatgcgtctccggcgctcacaacaccattgtaacagcaagagcaggcaaagacctcgtctcaagtcttgtctcaggtttattgaccattggtccccgatttggtggtgccattgatgacgctgctcgatacttcaaagacgcgtgtgacaggaatctcacaccttatgaatttgttgagggaatgaagaaaaagggaatccgagtccccgggattggacacaggatcaagagcagagacaacagagacaaaagagtggagcttcttcagaaatttgctcggtccaacttcccatcagtgaagtacatggagtacgcagtgacagtggagacatacacgctctcaaaggcaaacaacctcgtactcaacgttgatggagccattggatctctcttcttggaccttctagctggaagtgggatgttcactaaacaagagattgacgagattgttcagatcggttatctcaacggtctgtttgttcttgctcgctccatcggtttgatcgggcacacgtttgatcagaagagattgaagcagccactgtatcgtcacccatgggaagatgtgttgtacaccaagtaaaactcatttcaatcctatttttgttattattccaattaattagccttttaaaattcttctgagagatgtttacttaaaaaatgcatatctatatgctcttcttctgtctcttttgttgtcatgtatgtttgttcacttcttcttcttttttcaattatttaaactttctttgtc

SEQ ID NO: 2522 - DNA, 2148 bp, Arabidopsis thaliana
agtggtagctgagctcatcttatttgtttcttccctcccatttaatggtttcctcttaaaccattcccttcccttcctcctaactgcaatctactctccacctaacattgctccgttttgactcgctcgactcggctaagtgaccacagttcctttcgagccaataaaatggctacgggacagctattttcacgcaacacacaagcgttgttctacaattataagcagcttcccattcagcgtatgcttgattttgatttcctctgtgggcgagaaactccttctgttgctggtatcataaacccaggttccgagggattccaaaagctattttttggtcaggaggagatcgccatccctgtccacgcagccattgaggcagcatgcgctgcgcatcccacagcagatgtattcatcaacttcgcatcgtttagaagtgctgctgcttcatccatggctgctttgaagcagccaactattaaagtagtggccattatagcagaaggtgttccggagtcagacactaagcagttgattgcttatgctcgtgctaataataaggttattattggaccagctactgttggaggcgttcaagctggagcctttaaaattggtgacacagctggaactattgacaatatcatccaatgcaagttgtacaggcctggatctgttggctttgtctcaaaatctggtggcatgtctaatgaaatgtacaataccattgcccgtgtgacagatgggatctatgaaggcattgctattggtggggatgtgttcccgggctcaactttatctgaccatatcctgcggtttaacaacatcccacagattaagatggtggttgtacttggagagcttggaggaagagatgaatattctctagttgaagccatgaaacagggaaaagtgaccaaaccagtggttgcttgggtcagcgggacttgtgcacgtctattcaagtccgaagtacaatttggtcatgcaggggccaaaagtggtggagagatggagtctgcacaagccaagaatcaagcgctacaagatgctggagctactgtacccacttcattcgaagccctagaagttgcaatcaaggaaacttttgacaaattggttgaagagggaaaggtctctcctattaaggaagtcactcctccacaaatccctgaagatctcagctctgcaattaagagtgggaaagtccgggctcctactcacatcatctccaccatttctgatgacagaggggaggaaccatgctatgctggtgtgccaatgtcatccatcattgaacagggttatggcgtgggagatgtcatttccctcctatggttcaaacgtagtcttcctcgatattgtaccaaattcatcgagatatgcataatgttgtgcgctgaccacggtccatgcgtctctggcgctcacaacaccatcgtaacagcaagagcaggaaaagaccttgtctcaagtcttgtctcaggtctattaacaatcggtcctagatttggtggtgccattgatgatgcagcacgatacttcaaggacgcttgtgacaggaatctcacaccttatgaattcgtggaaggcatgaagaagaaaggaatccgtgtccctggcattggtcacaggataaagagcagagacaacagagacaaaagagtggagctgcttcagaaatttgcacggtctaacttccctgcagtgaagtacatggaatacgcagtccaagtagagacatacacactgtctaaagccaacaacctggtactcaacgtcgatggagccattggatctctcttcttagaccttctcgctggaagtgggatgttcacaaaacaagagatagacgaaatagttcagatcggttatctcaacggcctcttcgtcctcgctcgatccatcggtttaatcgggcacacattcgatcagaagagactgaagcagccactgtaccgacacccgtgggaagatgtcttgtacaccaagtaatcatatcattattcacttcttctggtcgttccttattcctgttatcattctctcccattcagttaggctatgtttgattatatatttgttctgacactctatctgttgtgatctcttaatgcttgaaaaaataaaagaaagttcaattttaga

SEQ ID NO: 2523 - DNA, 2233 bp, Orobanche aegyptiaca
tttcttaacgggcaacaacccacagctatttttctacatatatttatatattaactaccttgccaccgcctacttttctcctataaacacacatattggttcttcctttgcaggtgactgtaaattttcctgaaaggagttgtttcagacaacgccatggcgaccggacaactgttctccaaaaccactcaagcattattttacaattacaaacaactgccgattcagcggatgcttgattttgatttcctatgcggcagagaaacgccttctgttgctggaattataaatcctggctccgagggattccagaagctattttttggccaagaagagatagccattcctgttcaccccgctattgaaacggcttgtgctgcacatcctacggctgatgttttcattaactttgcatcattcagaagtgctgctgcttcatctttggccgctctcaagcagccaactattaaggttgtggccattatagctgaaggtgtacctgaatcagacaccaagcagttgattgcatatgcaaaagcaaacaacaaggttgtcatcggtccagctactgttggaggtattcaagctggagcatttaagattggtgatactgctggaacaattgataatataattcaatgcaagttatacagacctgggtctgttggctttgtctccaaatctggtggcatgtctaatgaactgtacaatacaattgcacgtgtcaccgatggaatttatgaaggcattgcaattggaggagatgtgtttcctgggtcaacactttcggaccatgtcctgcggtttaacaatattcctcaggttaagatgatggttgttcttggagaacttggtggacatgatgaatattccttagtcgaggccctaaaacaggggaaaatcaacaagcctgtggttgcctgggtcagtggaacctgtgctagactcttcaaatcagaagtgcaatttggtcatgcgggggcaaagagtggtggggagttggaatctgctcaggccaagaatcaagcacttggggatgctggagctgttgttcccacttcttttgaagcatttgagggtgcaatcaaagaaacatttggaaaattggttgaggcaggtaaaatatctcctgtgaaggaggtgacaccccctcaaataccagaggatcttaacacggctatcaagactgggaaagttcgggctccaacacacattatttccacaatctccgacgatagaggtgaagagccaacttatgccggggtcccaatgtcctccattgttgaacaaggattaggtgttggtgatgtcatttccttattgtggtttaagcgaagccttcctcattattgcacacgttttatcgagatttgcatcatgttgtgtgctgatcatgggccctgtgtctctggtgctcacaacaccattgtaacggctagagctgggaaagacctcgtctctagtcttgtttcaggtttgttgacaattggtcctcgatttggtggagctattgatgatgccgctcgatacttcaaagatgcttatgataggggtcttacaccttatgaatttgtggagagcatgaaaaagaagggcattcgcgttccaggtattgggcacagaatcaagagtgctgacaacagagacaagagggtggaattattacagcgttttgcaagagccaattttccatcagtgaagtacatggaatatgccgttgaagttgaaacatacactctttcaaaagcaaacaaccttgtactcaatgttgatggtgccattgggtctttattcctggatcttcttgccggtagtggcatgttcactaagcaagaaatcgatgagattgtcgggattggctatctcaatggtctctttgtcctagctcgttccattggtctcatcgggcatacgttcgatcaaaagagactcaagcagccactataccgccacccatgggaagatgttctctacactaagtgaaacttctgctgataggaactgctatatttctgcttgccttacagcctggccattcttcttcagggttttccattttatttgttgtcattttcagttaataatttgatgtttgttgtactgctgaaaagcagaccgagtacttgtagtttttagccagagcagccaagagagaacacttttggaaaaatgccaatcaaagaactacttgccttcgttatgagttcttatatcattatatgtaatcaaaagg

SEQ ID NO: 2524 - DNA, 2374 bp, Populus trichocarpa
ttcctcctctacttcccctatatataatcgccccccctccccctccatttcctgtaataatccacttcattaacattcccctctccttttcttcaaatcgaggccagaacataaaaagaaacaggagttgcaaagtccaattctggccagtttgagttttgtacaatatggcgacaggacaactcttctctcgaacaacacaagctctgttttacaattataagcagctgcctattcaacgcatgcttgattttgattttctttgtgggagggaattaccgtctgtagctggaatcattaaccctggtgctgagggatttcagaaactctttttcggtcaagaggaaatagcaatccctgtgcattcgactattgaggcagcttgtgctgctcatccaactgctgatgtgtttatcaacttcgcatcattcagaagtgcggctgcttcatccatgtctgctctgaagcagccaaccgttcgagttgtggctattatagctgagggtgttcctgaggcagacgccaaacaattgattgcatatgctcgggctaacaataaggttgtcattggtccagctactgttggaggcattcaagctggagcattcaagataggcgatactgctggaacaatcgataacataattgcttgcaagctgtaccggcctggatctgttggatttgtctccaaatcaggtggtatgtctaatgaactatacaatagcattgcccgtgtaaccgatggaatttatgaaggtattgcaatcggaggggatgtgttcccaggatctactctttctgatcatgtcctgaggtttaacaacatcccacaggttaaaatgatagttgtacttggggaacttggtggaagagacgagtattctcttgttgaagccctaaaacagggaaaggtaagcaaaccagtggttgcttgggtcagtggaacttgcgcgcgactctttaagtcagaagtgcaatttggtcatgctggtgctaaaagtggtggtgagatggagtctgctcaagcaaaaaatcaagcactgaaagatgctggagctgttgttcccacttcatatgaagcttttgagactgcaattaaggaaacatttgagaaactggttgaagaggggaagatatcatctgttaaggagtttacgcctccacaaatcccagaagatcttaacattgcaatcaagagtggaaaagttcgggcaccaactcatattatttctaccatctctgatgacagaggtgaggaaccatgctatgctggcgtgccaatgtcttccattgttgaacagggttatggcgtgggtgatgtcatctctcttttatggttcaagcgcagccttccacgttactgtacccattttattgagatatgcatcatgttgtgtgctgaccatggtccctgtgtctctggtgctcacaacactatagtaactgcaagggcaggaaaggacctagtttccagccttgtctcaggtttgctcacaattggtccccgatttggtggtgccattgatgatgctgctcggtactttaaggatgcatatgacaggggtctaacaccctatgagtttgttgaaagcatgaaaaagaagggaatacgagttcctggtattgggcacaggatcaagagaggggacaacagggataaaagagtggagcttctacagctgttcgctcgcacgcatttcccttctgtgaagtatatggagtatgctgttcaagttgaaacttacactctctcaaaggccaataacttggtccttaacgtcgatggcgcgattgggtcccttttcttggatctccttgcaggcagtggaatgtttactaaacaagagattgatgagattgttgggattggttatttgaatgggctctttgtgttggcgcgttccattggtttgattgggcacacctttgaccagaagagattgaaacagcctctataccgtcacccatgggaggatgttctctactccaagtgagagaataacaggtagcaggtgcagctctcacgtgctctacacaagccttttgtttttcaaatttcttgagtctctgctgaaatgtctgttcagttgttagattagtgttgagctgcggcgaggtcaagcgttccattgtgtttggaagttataagtagccttttatcatttattaaacagatgttgctataagatgctagtttcatatttcaagaaagaataactatgttgctgggatgtatgggtaaagaacattaaccatcacccaaatgtaagagaatttgtcctttcttggtattccctttggatttttggtcacattctcctgttgtggatgctaataaagtaaatgaaataaggttttttttttttcatagcta

SEQ ID NO: 2525 - DNA, 2241 bp, Arabidopsis lyrata
tgtttttctttgtcaatgtagatagagaaatcaattttgggtagaaagaagttgtgaactaactacctaccaatataactaaagccacatgaccatcactgcgatgagaagcttttgtttccctcccatttctctatattaatgctgcttctcctctaatccattcctctctctctctctctctgcttccatttttattctctccctcatcactgactcgactcgggtcgtgaccagtttttctattgagctatggcaacgggacagcttttttctcggactacacaagctttgttctacaactataagcagcttcctgttcaacgaatgctcgatttcgactttctctgtggacgtgaaacgccttctgttgctggaatcataaatcctggttctgaaggttttcaaaagctctttttcgggcaggaggaaatcgctatccctgttcatgccgccattgaggcagcttgtgctgcgcatccaaccgcggatgtattcatcaactttgcatctttcaggagtgctgctgcttcgtccatggctgctttgaagcaaccaactatcaaagttgtggcaattatagctgaaggtgttccagaatcagacactaagcatctgattgcttatgctcgtgcaaacaataaggttgttattggaccggctactgttggaggtattcaagctggagcctttaagattggtgacactgcaggaacaatcgataacattatccagtgcaagctatacagacctggatctgttggttttgtctccaaatctggtggaatgtctaatgaaatgtacaatactgttgcccgtgtgactgatgggatctatgaaggcattgcaattggtggagacgtgttcccaggatccactttatctgaccacatccttcggtttaacaacatcccacagataaaaatgatggttgtacttggagagcttggaggaagagatgaatactctcttgttgaagctttgaaagagggaaaagtcaataaacctgtggttgcttgggtcagcggaacttgtgcacggctcttcaagtctgaagtacagtttggtcatgcaggtgccaaaagtggcggcgagatggagtctgcacaagccaagaatcaagctctcatggatgctggagctattgttcccacttcatttgaagccctcgaagctgcaatcaaagagacttttgagaaactggttgaagaaggaaaggtctctcctatcaaggaagtcactcctccacaaattcccgaggatctcaattccgcaattaagagcgggaaagttcgggctcctactcacataatctccaccatctctgatgacagaggggaggaaccttgctatgccggtgttccaatgtcttccatcatcgaacaaggctatggagtgggtgatgtcatttctcttctatggttcaaacgtagtctacctcgttactgtacaaaattcattgagatatgcataatgctgtgtgctgatcacggtccatgcgtctctggtgctcacaacaccattgtaacagcaagagcaggcaaagaccttgtctcaagtcttgtctcaggtttacttaccattggtccccgatttggtggtgccattgatgacgctgctcgatatttcaaggacgcttgtgacaggaatctcacaccttatgaattcgttgagggaatgaagaagaaaggaatccgagtccccgggattggacacaggatcaagagcagagacaacagagacaaaagagtggagctgctacagaaatttgctcggtccaacttcccatcagtgaagtacatggagtacgcagtgacagtggagacttacacgctctcaaaagcaaacaacctcgtactcaacgttgatggagccataggatctctcttcttggaccttctagctggaagtgggatgttcactaagcaagagatcgacgagatagttcagatcggttatctcaacggtctctttgttcttgctcgctccatcggtttgatcgggcacacgtttgatcaaaagagattgaagcagcctctgtatcgccacccatgggaagatgtgttatacaccaagtaaaactcatctcaatcctatttttgttattattccaattaattagctttttaaaattcttctgagagatgtttactaaaaaaatgcatatctatatgctcttctgtctcttttgttttcatgtttgtttgtttactttttttttttttttccattcttataaac

SEQ ID NO: 2526 - DNA, 2087 bp, Brassica napus
ttctatattaatggtcttctaaccattcctctccctaccaccatttatcagcttcttcccccaactcactcgactcgggtcgtgaccagctctttcgaaaatggcaacgggacagcttttttctcggacaacacaagctttgttctacaactacaagcagcttcctgtccaacgaatgctcgacttcgacttcctctgtggacgtgaaacgccttctgttgctgggatcatcaaccctggctccgaagggtttcagaagctcttcttcggacaagaagagatcgccatccctgttcacgccgctattgaggcagcttgtgctgcgcatccaactgcggatgtattcatcaactttgcatctttcaggagtgctgctgcttcatccatggctgctttgaagcagccaactattaaagttgtggcgattatagcagaaggtgttccggagtcagacaccaagcagctgattgcttatgctcgtgctaacaacaaggttgttattggaccggctactgttggaggtattcaagctggtgcctttaagattggtgacactgctgggacaattgataacattatccagtgcaagctttacagacctggatctgttggttttgtctccaaatctggtggaatgtctaatgaaatgtacaatactgttgctcgtgtgactgatgggatctatgaaggtattgctattggtggagacgtgttcccaggatcaactttgtctgaccacatcttaaggtttaacaacatcccacagataaaaatgatggttgtacttggagagcttggaggaagagatgaatactctcttgttgaggctttgaaacaggggaaagtgaataaacctgttgttgcttgggtcagtgggacttgtgcacggctcttcaagtctgaagtacagttcggtcacgcaggtgccaaaagtggtggggagatggagtctgcacaagccaagaaccaagctctcatggatgctggagccattgttccaacttcattcgaagctctcgaatctgcaatcaaagagacttttgataaactggttgaagaaggaaaggtctctcctataaaagaagtcactcctccacaaatccctgaggatctcagctccgcaatcaagagtgggaaagtcagggctcctactcacatcatctccaccatttctgatgacagaggggaggaaccatgctatgctggtgttccaatgtcttcaatcatcgaacaaggcttaggagtgggcgatgtcatttcccttctatggttcaagcgtagtcttccacgctactgtacaaagttcattgagatatgcataatgctgtgtgctgatcatggtccttgcgtctcgggcgctcacaacaccattgtgacagcaagagcaggcaaagaccttgtctcaagtcttgtctctggtttattaaccattggccctagatttggtggtgccattgatgatgctgctagatacttcaaggacgcttgtgacaggaatctcacaccttatgagttcgttgaggggatgaagaagaagggaatcagagtccctgggatcggacacaggatcaagagcagagacaacagagacaagagagtggagctgcttcagaaatttgctaggtctaacttcccatcagtgaagtacatggagtacgcagtaacagtggaaagctacacgctctctaaggcgaacaacctcgtgatgaacgttgatggagccattggatctctcttcttggaccttctagctggaagtgggatgtttactaagcaagagatcgatgagattgttcagatcggttatctcaacggtctctttgttcttgctcgctccatcggtttgattggacacacctttgatcagaagaggttgaagcagccattgtaccgtcacccatgggaagatgtgttgtacaccaagtgaaactctcatctcagctttgttttctttgttgttaattccaattaattagctttttatattcttctgagagagatgttaccaagaatgcatatctatgctcttctgtttcttttgttgtgatgttatgtttacttttattttgttttccatttatctgaac

SEQ ID NO: 2527 - DNA, 2161 bp, Brassica napus
  misc_feature (23)..(23): n is a, c, g, or t
  misc_feature (689)..(689): n is a, c, g, or t
  misc_feature (878)..(878): n is a, c, g, or t
  misc_feature (893)..(893): n is a, c, g, or t
  misc_feature (905)..(905): n is a, c, g, or t
taccaccatttattagcttcttncccccactcactcgactcgggtcgtcaccagatctttcgaaaatggcaacgggacagcttttttctcggacaacgcaagctttgttctacaactacaagcagcttcctgtccaacgaatgctcgacttcgacttcctctgtggacgtgaaacgccttctgttgctgggatcatcaaccctggctctgaagggtttcagaagctcttcttcggacaggaggagatagctatccccgttcacgccgctattgaggcagcttgtgctgcgcatccaactgcagatgtattcatcaactttgcgtctttcaggagtgctgctgcgtcatccatggctgctttgaagcagccaactattaaagttgtggcgattatagcagaaggtgttccggagtcagacaccaagcagctgattgcttatgctcgtgcaaacaacaaggttgttattggaccggctactgttggaggtattcaagctggtgcatttaagattggtgacactgcaggaactattgataacattatccagtgcaagctgtacagacctggatctgttggctttgtctccaaatctggtggaatgtctaatgaaatgtacaatactgttgctcgtgtgactgatgggatctatgaaggtattgctattggtggagacgtgttcccaggatcnactttgtctgaccacatcctaaggtttaacaacatcccacagataaaaatgatggttgtacttggagagcttggaggaagagatgaatactctcttgttgaggctttgaaacaggggaaagtgaataaacctgttgttgcttgggtcagtgggacttgtgcacggctcttcaagtctgaagtacagttnggtcacgcaggtgcnaaaagtggtggngagatggagtctgcacaagccaagaaccaagctctcatggatgctggagccattgttccaacttcattcgaagctctcgaatctgcaatcaaagagacttttgagaaactggttgaagaaggaaaggtctctcctataaaggaagtcactcctccacagatccctgaggatctcagctctgcaatcaagagtgggaaagtcagggctcctactcacatcatctccaccatttctgatgacagaggggaggaaccatgctatgctggtgttccaatgtcttcaatcatcgaacaaggcttaggagtgggcgatgtcatttcccttctatggttcaagcgtagtcttccacgctactgtacaaagttcattgagatatgcataatgctgtgtgctgatcatggtccttgcgtctcgggcgctcacaacaccattgtgacagcaagagcaggcaaagaccttgtctcaagtcttgtctctggtttattaaccattggccctagatttggtggtgccattgatgatgctgctagatacttcaaggacgcttgtgacaggaatctcacaccttatgagttcgttgaggggatgaagaagaagggaatcagagtccctgggatcggacacaggatcaagagcagagacaacagagacaagagagtggagctgcttcagaaatttgctaggtctaacttcccatcagtgaagtacatggagtacgcagtaacagtggaaagctacacgctctcaaaggcgaacaacctcgtcctcaacgttgatggagccattggatctcttttcttggaccttttagctggaagtgggatgtttactaagcaagagatcgatgagattgttcagatcggttatctcaacggtctctttgttcttgctcgctccatcggtttgattggacacacctttgatcagaagaggttgaagcagccattgtaccgtcacccatgggaagatgtgttgtacaccaagtgaaactcatctcagctttgttcttttgttgttaattccaaataattagcttttacattcttctatgagagatgttaccaaaaatgcatatctatgctcttctgtttcttttgttgtgatgttatgtttacttttattttgttttccatttatctgaacttttatcaattggtcttcttactttctataattctatgtagtgtctggctagggatgttatgacgatcttccatatgaaatttggtagctagctagctagccttgttggactc

SEQ ID NO: 2528 - DNA, 2382 bp, Quercus alba
ccttaccaaaccaattccaacgaggcctttcactcaaccccccgccccccttttcttctccgccaggtgtgtaaaggcctctttgactctacaccatggccactggacagctattttcccgcaccacacaagctttattttacaattacaagcaacttccgattcagcggatgcttgattttgacttcctttgcgggagggaaacaccatcagttgctggaatcattaaccctggtggcgatggatttcagaaacttttttttggtcaagaggaaattgctatccctgtgcactcagccattgacgcagcttgtgctgcacatcccactgctgatgtctttatcaacttcgcatcatttagaagtgccgctgcttcatctatggctgctctgaagcaaccaaccattcgagttgtggctatcattgctgaaggtgttcctgagtcagacactaagcaattgattgcatatgcacgggcaaacaataaggttgttattggcccagcaactgttggaggaattcaagccggagcttttaagataggtgacactgctggaactattgataacataattcaatgcaagctgtacaggcctggatccgttggttttgtctccaaatctggtgggatgtctaatgaattatacaatactattgcccgtgttactgatggaatttatgaaggtattgcaattggaggagatgtgttcccaggctccactctatctgatcatgttttgcggtttaacaacatcccacagattaaaatgatagttgtacttggggagcttggtgggcaagatgaatattccttagttgaagccctgaagcagggaaaagtaactaaaccagtggttgcttgggttagtggaacttgtgcacgactcttcaaatctgaagtacaatttggtcatgctggtgctaaaagtggtggtgacatggagtctgcacaaggcaaaaatcaagcactaagagaagctggagctgttgttcccacgtcatatgaagctttagaagctgcgattaaggaaacttttgagaaactggttgaaggggggaatattacagcagtaaaggaagttatacctccacaaatccctgaggatcttaacacagccattaagagtgggaaagttcgtgctccaactcatattatttccacaatctctgatgacaggggtgaggagccatgctatgctggtgtacctatgtcttccattgttgaacaaggttatggtgttggtgatgttatctctcttttgtggttcaaacgcagccttccccgttactgcacaaaatttattgagatatgtatcatgttatgtgccgaccatggtccttgtgtctctggtgctcacaacactatagtaacagcaagagctggaaaggaccttgtttcgagcctagtctcaggtttgcttacaattggtccccgatttggtggtgccatcgatgatgctgctcgatacttcaaggatgcttatgacaggaatttgacaccttatgagttcgttgaaagcatgaaaaagaagggcattcgtgtaccaggaattgggcacaggattaagagaggtgacaacagagataagagagtagagctgctacaactatttgcacgcacaaattttccttctgtgaagtacatggaatatgctgtgcaagttgaaacctacactctctccaaggcaaacaacctggtgctcaatgtagatggtgcaattgggtcccttttcttggatctccttgcaggcagtggaatgttcaccaagcaagagattgatgagattgtcgagattggctatctgaatggactcttcgtgctggcacgctccattggtctgattgggcacacctttgaccagaagagattgaaacagccgctataccgccacccatgggaggatgttctctacaccaagtgaaagcattttcaatttgctggaacagctccaacggtccaacctgcttttaagtagcaatttattgttcaagtttctacaattggctgaaatgatcgtctgtcgttagactaatgtttgtactttgtaccactaatgtcaggttaagtatcttcatttgtaagctgtatcaaaattcataagagtgaactctcaaaccaccttgttcaacgaagttacatttccattaagaaatcctgctttctgttttgtatcaagaagatataatggcatgtaagtgaaattgtgcagagcatgcaggtcattatattcttcccattttgggttatgttagttattttaatatgaataataccatttctatatcctttctcgtccacatatgagacggatcatttgagagagcttgaaagttcccgagcatgaaaataatgtcttccttaaaaattcatataattaaata

SEQ ID NO: 2529 - DNA, 2358 bp, Castanea mollissima
attgattcaaccaccaccgcctttccaaaccaattccaacgaggcctttcactcacacccccctttttcttctctgccaggtgtgtaaaggcctctttgactctacgccatggccaccgggcagctattctcccgcaccacacaagctttattttacaattacaagcaacttccgattcagcggatgcttgattttgacttcctttgcgggagggaaacaccatcagtagctggaatcattaaccctggtggcgatggatttcagaaactttttttggtcaagaggaaattgctatccctgtgcactcagccattgacgcagcttgtgctgcacatcccactgctgatgtctttatcaactttgcatcatttagaagtgccgctgcttcatctatggctgctctgaagcaaccaaccattcgagttgtggctatcattgctgaaggtgttcctgagtcagacactaagcaattgattgcatatgcacgggcaaacaataaggttgttataggcccagcaactgttggaggaattcaagccggagcttttaagataggcgacactgctggaactattgataatataattcaatgcaagctgtacaggcctggatccgttggttttgtctccaaatctggtgggatgtctaatgaattatacaatactattgcccgtgttactgatggaatttatgaaggtattgcaattggaggagatgtgttcccaggctccactctatctgatcatgttttgcggtttaacaacatcccacagattaaaatgatagttgtactaggggagcttggtgggcaagatgaatattccttagttgaagccctgaagcagggaaaagtaactaaaccagtggttgcttgggttagtggaacttgtgcacgactcttcaaatctgaagtacaatttggtcatgctggtgctaaaagtggtggtgacatggagtctgcacaaggcaaaaatcaagcactaagagaagctggagctgttgttcccacatcatatgaggctttagaagctgcgattaaggaaacttttgagaaactggttgaaggagggaatattacagcagtaaaggaagttacacctccacaaatccctgaggatcttaacacagccattaagagtgggaaagttcgtgctccaactcatattatttccacaatctctgatgacaggggtgaggagccatgctatgctggtgtaccgatgtcttccattgttgaacaaggttatggtgttggtgatgttatctctcttttgtggttcaaacgcagccttccccgttactgcgcaaaatttattgagatatgtatcatgttatgtgccgaccatggtccttgtgtctctggtgctcacaacactatagtaacagcaagagctggaaaggaccttgtttccagcctagtctcaggtttgcttacaattggtccccgatttggtggtgccatcgatgatgctgctcgatacttcaaggatgcttatgacaggaatttgacaccttatgagtttgttgaaagcatgaaaaagaagggcattcgtgtaccaggaattgggcacaggattaagagaggtgacaacagagataagagagtagagctgctacagctgtttgcacgcacaaattttccttctgtgaagtacatggaatatgctgtgcaagttgaaacctacaccctctcaaaggcaaacaacctggtgctcaatgtagatggtgcaattgggtcccttttcttggatctccttgcaggcagtggaatgttcaccaagcaagagattgatgagattgttgagattggctatctgaatggactctttgtgctggcacgctccattggtctgattgggcacacctttgaccagaagagattgaaacagccgctataccgccacccatgggaggatgttctctacaccaagtgaaagcattttcaatttgctggaacagctccaacggtccaacctgcttttaagtagcaatttattgttgaagtttctacaattggctgaaatgatcgtctgttgttaggctagtgtttgtactttgtactactaatgtcaagtgtcttcatttgtaagctgtatcgaaattcataagactgaactctcaaaccaccttgttcaacgaagttacatttccattaagaaatcctgctttttgttttgtatcaagaagagataggcatgtaagtgaaattgtgcagagcatgcaggtcattatgttcttcccattttgggttatgttagtaattttgatatgaataataccatttctatgtcctttctcgtccacatatgagacggatcatttgaaagaagcttagaaagttacccaagacaataaga

SEQ ID NO: 2530 - DNA, 2168 bp, Prunus persica
ctcttctctatatatctctctctctatttaaacacttcctctatcctccctaaattccagcatttgcatttcccccaaatcccaaattccactctcacagcctcacagaaaccggaggttgccttgacctgaaaccatggccactggacaacttttctcgcgcaccacacaggcgttgttctacaactacaagcagctcccaatccagcgcatgctggattttgacttcctttgtgggagggaaacaccgtccgttgctggaatcattaaccccggtgctgagggatttcagaaactctttttcggtcaagaggagatcgccataccagtgcactcaaccattgaagcatcttgtgcagcacatcctaccgccgatgtcttcatcaactttgcttcctttagaagtgctgccgcttcctccatggctgctctgaagcaaccaacaattagagttgttgcaatcattgctgaaggtgtacctgagtcagacgctaagcaattgatcgcatatgcacgagcaaacaacaaggttgttattggcccagctactgttggaggaattcaagctggtgcttttaagattggtgacactgctggaacaattgataacataattcactgcaagctgtacaggcctggatctgttggttttgtctccaaatctggtgggatgtctaatgaattatacaatactgtggctcgtgtaacagatggactttttgaaggtattgctattggaggagatgtgttcccaggttctactctttctgaccatgttctgcggtttaacaatatcccccaggttaaacttattgttgtacttggggaacttggtgggagagatgagtattctctagttgaagctttgaaacaggggaaagtttccaaaccagttgttgcttgggttagtggaacttgcgcaaggcttttcaaatccgaagtacaatttggtcatgctggcgcaaaaagtggtggtgagttggagtctgcacaagcaaagaatcaagccttgagggatgctggagctgttgttcccacttcatatgaagctttagaaactgctataaaggaaacctttgaaaaactggttgaacaagggaagattacaccagtgaaggaatttaagcctccacaaatacctgaagatcttaactctgcaattaagagtggaaaagttcgggctccaactcatattatatccacaatctctgatgatagaggtgaggaaccatgctatgctggtgtacctatgtcctccattgttgagcagggttacggtgtgggtgatgttatctctcttttgtggttcaagcgcagccttccccgttattgtactcagtttattgagatatgcatcatgttatgtgctgaccatggtccttgcgtctctggagctcacaacacaatagtaactgctagggctggcaaggaccttgtttccagccttgtctcaggtttgctcacaattggtccccgatttggtggtgccgttgatgatgctgcccgatacttcaaggatgcatatgacaggaatcttacaccttatgaatttgtcgagagtatgaaaaagaaaggcattcgtgtgccagggattgggcacaggatcaagagaggggacaacagagataagagagtagagctcctacaagcgttcgcgcgcacacatttcccttctgtcaagtatatggaatatgccgtacaagttgaaacctacaccctctcgaaggcaaacaacctggtccttaatgtcgatggtgctattggaaccctgttcttggatcttcttgcaggcagtggaatgttcagcaagcaagagattgatgagattgttgatattggctatctgaatgggctatttgtgctggcacgttctatcggtttgattgggcacacttttgaccagaagagattgaagcagcccctataccgccacccatgggaggatgttctttacaccaagtgaaaggctctcagatagcaggtgcaaagccgacttacctgcttttgacgagcattgttgtcttcaaggtccttgagtctgcagattcgcttggaatgattgttcagttgttagaatagtgtttgtattgctaatgctggagttgagtatcttcatttgtaagttgtatccaaagttcataaagggacaaccctcgatcagtttacta

SEQ ID NO: 2531 - DNA, 2081 bp, Helianthus annuus
cggggacacttcaaagctcgtctggaaaaccgctcacctgcttccaatagtcttaacaaattcctacttactcagggagcaccatggcaaccggacaaatattctctcgtacaacgcaagcattgttctataactataagcaattgccgattcaacggatgcttgattttgacttcctttgtgggagggaaacaccttcagttgctggaatcatcaacccaggttccgagggatttcagaaattatttttcggccaagaggaaattgccataccagtacattcaaccattgaagcagcttgtgctgcccatcctactgctgatgtattcataaactttgcatcattccgaagtgctgctgcttcatcgaaacttgctctcaaacagcctacgatcagagttgtggctattattgccgagggtgttccggaatcagacaccaaggagttaatttcgtacgcgaggttaaacaataaggtagttattgggcccgcaacggttggtgggattcaagctggagctttcaagattggtgacactgctggaacaattgataatattatacaatgcaaattgtacaggcctggatctgttggattcgtatccaaatctggtggcatgtctaatgagatgtacaacaccattgcacgtgtgactgatggaatctatgaaggtattgctattggaggagatgtttttcctggttctactctttctgatcatgttttgcggttcaacaacattccccagataaaaatgattgttgtgcttggggaactcggtggtcgagacgagtattccttagtcgaagcacttaaatcgggaaaaataactaaacccgtatgtgcttgggttagtggaacatgcgcacgcctctttaaatcggaagtccagttcggtcacgcaggggccaaaagtggcggtttaatggagtctgcacaagctaaaaacaaagcacttaaagaagccggggcagtggtccccacttcatacgaagcattcgaaagcgcaatcaaggaaacatttgagaagttgtccgaagagggcaagatttcccccgtcaaggaaataacccctccgcaaatccccgaggaccttaacacagcaattaagagcgggaaagtacgggctcctactcatattatttcaaccatttctgatgacagaggtgaagagccttgctatgcaggggtaccgatgtccacgatcgtggaaaagggaatgggcgtcggtgatgtcatctctcttttgtggtttaaacgtagtcttccccgttactgcacacaattcattgagatttgtgtcatgctatgtgctgaccacggtccgtgtgtgtctggtgctcacaacacaattgtaactgcaagagcgggaaaagatctcgtatcaagtcttgtttctggtttactaacaatcggtccgcgttttggcggtgccattgacgacgctgctcgatacttcaaggatgcatatgacagaaaacttacgccatacgagtttgttgaaggcatgaaaaagaagggtattcgtgtaccaggaatcgggcacaggatcaagagaggtgacaatagagataagagagttgagctactacaactatttgctcgcacgcatttcccgtcaacgaagtacatggaatacgcggttgaagttgaaacgtacactctctcaaaggcaaacaatttagtgatgaacgttgatggtgccattggtaccctgtttttggatcttctcgcgggtagtggaatgttctccaaacaggaaattgatgagattgtttccattggttaccttaacgggctttttgttttggcccgttccatcggtctcatcgggcatacgttcgaccaaaagaggttgaagcagccgctatacaggcacccatgggaagatgtcctttacaccaaatgatcattttcaaaagtatacacatcattcaaaacaggttatgtttaaagtttttctgttgtaatgacattttggagtgtttttcttttgtgacggttgtgtttgtattggtcgctgtaagttcattgatagacaactggctcttttgatattcatagacaatagtttcccttc

SEQ ID NO: 2532 - DNA, 2104 bp, Helianthus annuus
cttcaagctcgtctggaaaccgctcacctgcttccatagtcttaacaaattcctacttactcagggagcaccatggcaaccggacaaatattctctcgtacaacgcaagcattgttctataactataagcaattgccgattcaacggatgcttgattttgacttcctttgtgggagggaaacaccttcagttgctggaatcatcaacccaggttccgagggatttcagaaattatttttcggccaagaggaaatcgccataccagtacattcaaccattgaagcagcttgtgctgcccatcctactgctgatgtattcataaactttgcatcattccgaagtgctgctgcttcatcgaaacttgctctcaaacagcctacgatcagagttgtggctattattgccgagggtgttccggaatcagacaccaaggagttaatttcgtacgcgaggttaaacaataaggtagttattgggcccgcaacggttggtgggattcaagctggagctttcaagattggtgacactgctggaacaattgataatattatacaatgcaaattgtacaggcctggatctgttggattcgtatccaaatctggtggcatgtctaatgagatgtacaacaccattgcacgtgtgactgatggaatctatgaaggtattgctattggaggagatgtttttcccggttctactctttctgatcatgttttgcggttcaacaacattccgcagataaaaatgattgttgtgcttggggaactcggtggtcgagacgagtattccttagtcgaagcacttaaatcgggaaaaataactaaacccgtatgtgcttgggttagtggaacatgtgcacgcctctttaaatcggaagtccagttcggtcacgcaggggccaaaagtggcggtttaatggagtctgcacaagctaaaaacaaagcacttaaagaagccggggcagtggtccccacttcatacgaagcattcgaaagcgcaatcaaggaaacatttgagaagttgtccgaagagggcaagattgcccccgtcaaggaaataacccctccgcaaatccccgaggaccttaacacagcaattaagagcgggaaagtacgggctcctactcatattatttcaaccatttctgatgacagaggtgaagagccttgctatgcaggggtaccgatgtccacgatcgtggaaaagggaatgggcgtcggtgatgtcatctctcttttgtggtttaaacgtagtcttccccgctactgcacacaattcattgagatttgtgtcatgctatgtgctgaccacggtccgtgtgtgtctggtgctcacaacacaattgtaactgcaagagcgggaaaagatctcgtatcaagccttgtttctggtttactaacaatcggtccgcgttttggcggtgccattgacgacgctgctcgatacttcaaggatgcatatgacagaaaacttacgccatacgagtttgttgaaggcatgaaaaagaagggtattcgtgtaccaggaatcgggcacaggatcaagagaggtgacaatagagataagagagttgagctactacaactatttgctcgcacgcatttcccgtcaacgaagtacatggaatacgcggttgaagttgaaacgtacactctctcaaaggcaaacaatttagtgatgaacgttgatggtgccattggtaccctgtttttggatcttctcgcgggtagtggaatgttctccaaacaggaaattgatgagattgtttccattggttaccttaacgggctttttgttttggcccgttccatcggtctcatcgggcatacgttcgaccaaaagaggttgaagcagccgctatacaggcacccatgggaagatgtcctttacaccaaatgatcattttcataagtatacacatcattcaaaacaggttatgtttaaagtttttctgttgtaatgacattttggagtgtttttcttttgtgacggttgtgtttgtattggtcgctgtaagttcattgatagacaactggctcttttgatattcatagacaatagtttcccttccaggctttatatctttactctttcacataaataa

SEQ ID NO: 2533 - DNA, 1848 bp, Glycine max
gatctatctgttccttcgtcatggccactggacaactcttctcccgtactacacaagctttgttttacaactacaagcaacttcctgtccagcggatgcttgactttgactttctttgtggtagagaaacaccgtcagttgctggaataattaatcctggttctgagggatttcaaaagctcttttttggtcaggtggaaattgccattccagttcatgctggtattgaagcagcttgtgcagcacaccccactgctgatgtgttcatcaattttgcgtcatttagaagtgcgtctgcatcatccatggctgctttgaagcagacaacaattagagttgttgctattattgctgaaggtgtaccggagtcagacactaagcaacttatagcgtatgctcgagcaaacagtaaggttgttattgggccagccactgttggaggaattcaagctggtgcttttaagataggtgacacagctgggacaattgataacataattcattgcaagctctacaggcctggatctgttggatttgtttctaaatctggtgggatgtccaatgaattatacaacactattgcccgtgtaactgatggaatttatgaaggcattgccattggtggagatgttttcccaggttccacactttctgaccatgttttgcggtttaacaacataccacaggtgaaaatgatggtagtacttggggaacttggtgggcgtgatgagtattctctagtggaagccctaaaacaagggaaagtgactaaaccagttgttgcctgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagacgcaataaaggaaacatttgacaaattggttcaagaagggaacatcacaccttttaaagagtttactgcaccgccaatccctgaggaccttaacacagcaattaggagtggaaaagtacgtgctccaactcacattatttccaccatctctgatgacagaggtgaggagccatgctatgctggtgtaccaatgtctaccattattgaaaatggttatggtgtgggtgatgtaatctctcttttgtggttcaaacgcagccttccccgttactgtactcaatttattgagatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgctatttcaaggatgcctatgacaggagtcttacaccttatgaatttgttgaaagtatgaagaagaagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgattgggcatacctttgaccagaagaggttgaaacaaccactctaccgccacccatgggaggatgttctttacacaaagtgag

SEQ ID NO: 2534 - DNA, 2364 bp, Cucumis melo
atttaaaatcccaattcaatctcctccaacttccagcattcaatttccctctcccgttgcatttctccgccggatcaccgccggatttcactcgccggctcttactgacctttctgggaaaataaagttaacggtgaaaagataagaagaatcacactgctattggcaggtccctctgaagatcaccatggctactggacaaatattttctcgcacgacacaagcattattctataattacaaacaacttcccatccaacggatgcttgattttgacttcctttgcgggagggaaacaccatcagttgcgggaataatcaatccaggtgctgaaggatttcagaaactcttttttggtcaagaggaaattgccatccctgtgcattctacgattgaagcagcttgtgcagcacatcccacagccgatgtcttcatcaactttgcatccttcagaagtgctgctgcatcctcaatggctgctttgaaacagcctaccatcagagttatagctgtcatagctgagggtgttccggagtcggacactaaacaattgattgcatatgcacgggcaaacaataaggttgttattggcccagctactgttggaggcatacaagccggagcatttaaaattggtgacactgctggaacgattgacaatattgtacaatgcaagctttacagaccgggatctgttggttttgtctctaaatcaggtggaatgtctaatgagatgtataatactattgcacgtgttaccgacggaatttatgaaggtattgcaattggaggagatgtgtttccaggttcgactctttctgatcacattttgcggtttaacaacattccacaggttaaaatgatggttgtgcttggagaacttggtggtcgagatgagtattctttagttgaagctttgaaacaaggaaaagttaacaaaccagtggttgcctgggttagtggcacttgtgccacattgtttaaatctgaagttcaatttggtcatgctggagcaaaagtggtggtgagttggagtctgcacaagcaaaaaatcaagctttaaaggaagctggagctattgttcccacatcatatgaggcccttgaagctgcaattaaggaaacatttgaaaaattggttggagacgggaaaattactccagtgaaggaagtgaagcctcctcaaattcctgaggatcttaactcagcaattaagagtgggaaagttcgtgcaccaacccacattatttccaccatttctgatgacagaggtgaggagccaagatacgctggaataccgatgtcttcaattgttgagcaaggctatggcgttggcgatgtcatttcactcttatggttcaagcgcagccttcctcgttactgtacacacttcattgagatatgtattatgctctgtgctgatcacggtccttgtgtatctggagcgcataacaccatagtaactgcaagggctggaaaagacctcgtgtccagtcttgtctcaggtttacttactatcggacctcgattcggtggtgccattgatgacgctgctcggtactttaaggatgcttatgacagaggtcttacgccttatgagtttgtcgaaagcatgaaaaagaaaggaattcgagtgcctggaattggtcacaggataaagagaggagacaatagagacaagagagtggagctgctacagcgatttgcaagaacacatttcccaacagtgaagtacatggaatatgccgtggaggttgaaacttacacactctcaaaggcaaacaacttggttcttaatgtggatggtgcaattggttctcttttcttggatcttcttgctggcagtggaatgttcagcaaacaagagattgatgagatcgtccaaattggttatttgaacggcctctttgtccttgctcgctccattggtctcatcggacatacatttgatcagaagagattgaaacagcctctataccgccatccttgggaagatgtcctctacaccaaatgataaggacttttatacacataagacccggccaaacctcaatttccaaatttttgtaaaattattatcactacggatactgttgtttgtttttcttttcttctttttttttttttccctttccatttttccttcattgcccttttctagatcaacgtatgtgtcatgccttgctctttagttttctaactgtaattcataagaaaaggattgtagtgtttttattcataaaataaatcgtctccgtacatttattcgttttagtgtattttctagctctcaagtggtggtggctgcaagtgatggaatactaaaagttgaatatcttatagataatttgatatgtaaaaaaat

SEQ ID NO: 2535 - DNA, 2150 bp, Vitis vinifera
tcgcatttctttgcccttttttataatcctccacttacccttccgcccacccccacccctacaggtttctctgagaccaagccatggctactggacaactattttcccggactacacaagcattattctacaattacaaacaacttcccatccagcggatgcttgattttgacttcctttgtggaagggagacaccttcagttgctggaattattaaccctggttctgaggggttccagaaactcttttttggtcaggaggaaattgccatcccagtacattcatccattgaagcagctagtgcagcacatcctactgctgatgtttttataaactttgcatcatttagaagtgctgctgcttcatccatggctgctctgaaacagcctaccattagagttgtggctattattgctgaaggtgttccagaggcagacaccaagcagttaatcgcatatgcacggtcaaacaataaggttgttattggccccgctactgttggtggtattcaagctggagcctttaagataggggacactgcaggaacaattgataatatcattcagtccaaactttacaggcctggctctgttggttttgtttctaaatctggtggcatgtctaatgaactatataatacgattgcccgtgtcacagatggtatctatgaaggtattgcaattggaggagatgtgttcccaggatctactctttctgatcatgttttgcggtttaacaacatcccacaggttaaaatggtggttgtacttggggaacttggtgggcgagatgaatactccctagttgaagccctgaaacagggaaagattaacaaaccagttgttgcttgggtcagcggaacttgtgcacggctctttaaatcagaagtgcaatttggtcatgcgggggccaaaagtggtggtgaaatggagtctgcacaggcaaagaatcaagcactaagtgaagctggtgctgttgtgcccacttcatatgaagcatttgaaactgcaattaaggaaacatttgagaaactgcatgaagagggaaagattactcctgtgaaggaagtaacgcccccgcaaatccctgaggatcttaacactgcaattaagagtggaaaagttcgtgctccaactcatattatttctaccatctctgatgacagaggtgaggagccatgctatgctggtgtaccaatgtcctctattgttgagcaaggttatggtgtgggcgacgttatctctctcttgtggtttaaacgcagccttccacgttactgtactcactttattgagatctgcatcatgttatgtgctgatcatggcccctgtgtctctggtgctcacaacactattgttacagcaagggcaggaaaggacctcgtatccagtcttgtctcaggcttgcttacaattggtccccgatttggtggagctattgatgatgctgctcgatacttcaaggacgcttatgataggggtcttacggcttatgagtttgttgaggacatgaagaagaagggcattcgcgtgcctggcattggacacaggatcaagagaggagacaacagagacaagagagtcgaacttctccaacgatttgcacgcactcatttcccctctgtgaagtacatggagtatgctgttgaagttgaaacatataccctctcaaagtcaaacaacctggtccttaatgtagatggtgctattggatccctcttcttggatctccttgctggcagtggaatgttcaccaagcaagagattgacgagatagtccagattggatatctgaatggactgtttgtgttggctcgttccattggtctcattgggcacactttcgaccagaagagattgaagcagcccctataccgtcacccatgggaggatgtcctctacaccaagtgagaaacttacagattgccgacacaatgggtacctgcttccaacaagcatttttccccttttagaaagagtttgtgagctatttgttggaatgattattctgttgttagactagtatttgtgttgctagtagccagctgaacaccttcttcccttgtaagttctaattaaaaagtttatcaagagaggactctctaccatttaataaggaaaaaaagaaaaaaggttgttgatgtatccata

SEQ ID NO: 2536 - DNA, 2165 bp, Solanum phureja
cagtgatcttaattgacttggcaaaatggctactggacaacttttctccaagactacacaagcgttgttctacaactacaagcagcttcctattcagcgcatgcttgattttgatttcctttgtgcgagggaaacaccatctgttgctggaattattaatcctggttctgagggattccagaaacttttctttggtcaggaggaaatcgcaatcccagtacactcaaccattgaagccgcctgtgctgcacatcccacggctgatgttttcattaactttgcatctttcagaagtgccgctgcttcctccatgtcggctcttaaacagccaaccatcaaagttgcggctattatagctgaaggtgttcccgagtcagatgctaaagagctgattgcttatgcaaaggcaaacaataaggtggttattggtccagctactgttggaggtattcaagctggtgcatttaagattggtgatactgctggaactattgataacattattcagtgcaaactttaccgacctggatctgtgggatttgtctcaaaatctgggggtatgtctaatgaattatacaattcaattgctcgtgtcactgatggaatttatgaaggaatagcaatcggtggagatgttttccctggctctaccctttctgatcacgttttgcgcttcaacaatatcccacaggttaaaatggtggttgttctcggggaacttggtggacgagatgaatattccttggttgaagccttgaagcagggaaaaatcaacaagcctgttgttgcctgggttagtggaacttgtgctacgctcttcaagtcagaagtacaatttggtcatgcgggggcaaagagtggtggcgaaatggagtctgcacaagcaaagaatcaagcactcagagacgctggagctatagttccaacctcgtatgaagcttttgaaggagcaatcaaagatgcatttgaaaagctagttgaagcaggaaagactactcctgtaaaggaaattacacctcctcaaatacctgaggatcttagcacggcaattaagagtgggaaagttcgggccccaactcatatcatttccacaatatctgacgatagaggtgaagagccttgctatgctggcgtacccatgtcatccattgtggagcagggacttggtgttggtgatgtaatatctctcttgtggttcaaacgtagcctaccacgttattgcacacgttttattgagatttgcgtcatgttatgtgctgatcatggtccttgtgtctctggtgcacacaattccattgtaactgccagggctggaaaagatttggtttcctgccttgtttctggattgctgactattggtccgcgttttggtggtgctattgatgatgctgcccggtacttcaaggatgcttatgacaagggtcttactccatatgagtttgtggaaagtatgaagaagaagggcattcgagttccaggaattggccacaggattaagagaggtgacaacagagataagagagtggaactactgcaacgttatgctagggaaaatttcccttctgttaagtacatggaatatgctgttcaggttgaaacttacacactctcaaaggcaaacaacctagtcctcaacgttgatggtgccatcggatccctcttcttggatctccttgctggcagtggaatgttcaccaagccagaaattgatgaaatagtggagattggttacctcaatggactttttgtcctggctcgttcaattgggcttatagggcacacatttgaccagaagagattgaagcagccattgtaccgtcacccatgggaagatgtcctctacacaaagtgaagagtttccccataacaacaggcagaaagttgccttctcccaatctatagttttcattcaaaccattaagttagccatttgttgtgtgtgagtgttttgttcatgtgttagactagtgtttccactactcctaagggctcctatgatgattttgtaagttgttagggagattcctaccagacaagttatcatttatgatcaattcttagttccaccactcaagtgtttgtttttctctcttttcatgtcataaagaaataagtcattccattgttgtacctgatttcaattttacaaggagattctttcaatc

SEQ ID NO: 2537 - DNA, 1824 bp, Glycine max
atggccactggacaactcttctcccgtactacacaagctttgttttacaactacaagcaacttcctgtccagcggatgcttgactttgactttctttgtggtagagaaacaccgtcagttgctggaataattaatcctggttctgagggatttcaaaagctcttttttggtcaggtggaaattgccattccagttcatgctggtattgaagcagcttgtgcagcacaccccactgctgatgtgttcatcaattttgcgtcatttagaagtgcgtctgcatcatccatggctgctttgaagcagacaacaattagagttgttgctattattgctgaaggtgtaccggagtcagacactaagcaacttatagcgtatgctcgagcaaacagtaaggttgttattgggccagccactgttggaggaattcaagctggtgcttttaagataggtgacacagctgggacaattgataacataattcattgcaagctctacaggcctggatctgttggatttgtttctaaatctggtgggatgtccaatgaattatacaacactattgcccgtgtaactgatggaatttatgaaggcattgccattggtggagatgttttcccaggttccacactttctgaccatgttttgcggtttaacaacataccacaggtgaaaatgatggtagtacttggggaacttggtgggcgtgatgagtattctctagtggaagccctaaaacaagggaaagtgactaaaccagttgttgcctgggttagcggaacctgtgcacgactcttcaaatctgaagtacaatttggtcatgctgtatctaaaagtggtggtgagatggagtctgctcaagcaaagaatcaggcactaaaagaagctggagctgttgttcccacttcatttgaagcttttgaagacgcaataaaggaaacatttgacaaattggttcaagaagggaacatcacaccttttaaagagtttactgcaccgccaatccctgaggaccttaacacagcaattaggagtggaaaagtacgtgctccaactcacattatttccaccatctctgatgacagaggtgaggagccatgctatgctggtgtaccaatgtctaccattattgaaaatggttatggtgtgggtgatgtaatctctcttttgtggttcaaacgcagccttccccgttactgtactcaatttattgagatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgctatttcaaggatgcctatgacaggagtcttacaccttatgaatttgttgaaagtatgaagaagaagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgattgggcatacctttgaccagaagaggttgaaacaaccactctaccgccacccatgggaggatgttctttacacaaag

SEQ ID NO: 2538 - DNA, 2088 bp, Medicago truncatula
cccactcactcttcttctctgtttcaccaaccgagttcaaatcaaatcagatagatctggttctaaatcatggccaccggacaattattctcccgtactacacaagctctgttttataactacaagcaacttccgatccagcggatgcttgattttgacttcctttgcggcagagaaacaccatcagttgctggaataattaacccgggttcagaaggatttcaaaaactcttttttggtcaggaggaaattgccatcccagttcatgctacaattgaagcagcttctgctgcacatcctactgctgatgtcttcatcaatttcgcatcgtttaggagtgccgccgcatcatccatggctgctttgaagcagcctacaattagagttgttgctattattgctgaaggggtacccgagtcagacaccaaggaattgattgcatatgcccggtcaaacaataaggttgttattggcccagccactgtcggaggcattcaagctggggcttttaaaattggtgacacggctggaacaattgacaatataatccagtgcaagctctacaggcctggatctgttggattcgtttctaaatctggtgggatgtccaacgaattatacaactccattgcccgtgtaactgatggcatttatgaaggcattgccattggaggagatgttttccccggttccactctatctgaccatgttttacggtttaacaacataccacaggttaaaatgatagtggtgcttggagagcttggtgggcgtgatgaatattctttagtggaagccctaaaacaagggaaagtgaccaaacctgttgttgcctgggttagtggaacttgtgcaacactcttcaaatcggaagtacaattcggtcatgctggagctaaaagtggcggtgatatggagtctgctcaagggaagaatcaagcactaagagaagctggagctgttgttcctacttcttatgaatcttttgaaacttcaattaaagaaacatttgacaaattgattgaaggagggaaaattacaccagtgaaggaatttactcctccacaaatccctgaggaccttaacactgcaatcaagagtggaaaagtccgtgctccaactcatataatttccaccatttctgatgacagaggtgaggagccatgctatgctggtgtacccatgtcttccattattgaaaagggctttggtgttggcgatgttatctctcttttgtggtttaaacgaagcctaccccgttactgtactcattttattgagatatgcatcatgttatgtgccgatcacggtccttgtgtctctggtgctcacaatactattgtgacagcgagggctgggaaggacctagtttccagtcttgtatcaggtttgcttacaatcggtccacgatttgggggtgccattgatgatgctgctcgctacttcaaggatgctcatgacagggggcttacaccttacgagtttgttgaaggtatgaagaagaagggaattcgtgtagcaggaatagggcacaggatcaagaatagggacaacaaagataaaagagttgagctattacagaagtttgcacgcacacattttccttctgtgaaatacatggaatatgccgttcaagttgaaacctacactctcaccaaggcaaataatttagttcttaatgtagatggtgcaattggatctctgttcttagatcttcttgctggtagtggaatgttcaccaagcaagagattgatgaaattgttgagattggatatctgaatgggctttttgttcttgcacgatccattggtctgatcgggcacacctttgaccagaagagattgaagcagccactataccgccacccatgggaggatgtactctacacaaaatgagagggtttttttatggctggaagaactttgcaatgtttcaaattagcatcttttggaaaatcgtgcctccaaaatttgctagaatgattttttagccgccaaattagtgttgtaagatgttgaaaaagtcatatttcatttgtaatttgtattgaatttcgaaagaaataactcagagccaattttaaactt

SEQ ID NO: 2539 - DNA, 2326 bp, Solanum lycopersicum
atgtattatgcctaattcgtttgcctttgttggttaggtactacttgtattgaatatatatttactatgtgtgtgtggcagcccccatttgaattccataaatacaatattagtttccttgtgtgtatatatagagagatctaattctggccaacaacattctccaactagttaggggactttcttcatctacagagatcttaattgatttgggaaaatggctactggacaacttttctccaagactacacaagctttgttctataactacaagcagcttcctattcagcgcatgcttgatttcgatttcctttgtgggagggaaacaccatctgttgctggaattattaatcctggttctgagggattccagaaacttttctttggtcaggaggaaattgcaatcccagtacactcaaccatcgaagccgcttgtgctgcacatcccacagctgatgtattcattaactttgcgtctttcagaagtgccgctgcttcctccatgtcggctcttaaacagccaaccatcaaagttgcggctattatagctgaaggtgttcctgagtcagatgctaaggagctgattgcttatgcaaaggcaaataataaggtggttattggtccagctactgttggaggtattcaagctggtgcttttaagattggtgatactgctggaactattgataacatcattcagtgcaaactttaccgacctggatccgtgggatttgtctcaaaatctggtggtatgtctaatgaattatacaattcaattgctcgagtcactgatggaatttatgaaggaattgcaatcggtggagatgttttccctggctctaccctttctgatcacgttttgcgcttcaacaatatcccacaggttaaaatggtggttgttctcggggaacttggtggacgagatgaatattccttggttgaagccttgaagcagggaaaaattaacaagcctgttgttgcctgggttagtggaacttgtgctacgctcttcaagtcagaagtacaatttggtcatgcgggagcaaagagtggtggcgaaatggagtctgcacaagcaaagaatcaagcactcagagatgctggagctatagttccaacctcgtatgaagcttttgaaggagcaatcaaagatgcatttgaaaagctagttgaagcaggaaagactactcctgtaaaggaaattacacctcctcaaatacctgaggatcttagcacggcaattaagagtgggaaagttcgggccccaactcatatcatttccacaatatctgacgatagaggtgaagagccttgctatgctggcgtacccatgtcatccattgtggagcagggacttggtgttggtgatgtaatatccctcttgtggttcaaacgtagcctaccacgttattgcacacgttttattgagatttgtgtcatgttgtgtgctgatcatggtccttgtgtctctggtgcacacaattccattgtaactgccagggctggaaaagatctggtttcctgccttgtttctggtttgctgactattggtccgcgttttggtggtgctattgatgatgctgcccggtacttcaaggatgcttatgacaagggtcttactccatatgagtttgtagaaagtatgaagaaaaaaggcattcgagttccaggaattggccacaggattaaaagaggtgacaatagagataagagagtggaactactgcagcgttatgctagggaaaatttcccttctgttaagtacatggaatatgctgttcaggttgaaacttacacactctcaaaggcaaacaacctagtcctcaacgttgatggtgccatcggatccctcttcttggatctccttgcgggcagtggtatgttcacgaagccagaaattgatgaaatagtggggattggttacctcaatggacttttcgtgctggctcgttcaattgggcttataggacacacatttgaccagaagagattgaagcagccattgtaccgtcatccatgggaagatgtcctctacacaaagtgaagagtctccccataacaagaggcagaaagttgcctgcccccaatctatagttttcattcaaatcatttggttagccattttgttgtgtgtgagtgttttattcatgtgttagattagtgtttctactactccaaaggactcctatgatgattttgtaagttgttagggagattcctactagaaaagtttatcatttatgatcaattcttagttccacgactcaagtgtttgtttttctctcttttcatgtcataaagaaataagtcattccattgttgtacc

SEQ ID NO: 2540 - DNA, 2226 bp, Solanum lycopersicum
acactcactcatctaacattctaccaccacttaccaaccacctaactatttcactcacctcaatctacttacaggggacaaaatatcaatttttttcatcaatcaagaacaaatacatacttggtttcgattaaatcagcataatggcgactggacaacttttctccaaaactactcaagctttgttctacaactacaagcagcttcctatccaacggatgctcgactttgatttcctttgtgggagagaaacaccttctgttgctggaattatcaatcctggttccgagggattccagaaactcttctttggtcaggaggaaattgcaatcccagtacattctactgttgaagctgcctgtgctgctcatccaacagctgatgttttcatcaattttgcttctttcagaagtgctgctgcttcctccatgtctgctctaaaacagccaaccatcagagttgtggctattatagctgaaggtgttcctgagtcggacaccaagcagcttattggttttgcaaaggcaaataataaggtggttatcggtccagctactgtgggagggattcaagccggagcttttaagattggtgatactgctggaacaattgataacattattcagtgcaagctttacaggcctggatctgtgggatttgtctccaaatctggcggtatgtctaatgaactatacaacacaattgcccgtgtgactgatggagtttatgaaggaattgcaattggcggggatgtctttcctggctctaccctttctgatcatgttctgcgcttcaacaatattccacaggtcaaaatgattgttgtacttggggaacttggtggacgagatgagtattccttagttgaagccctgaagcaagggaaaatcaacaagcctgttgttgcctgggtcagcggaacttgtgctacactcttcaagtcggaagtacagtttggacatgcgggtgcaaagagcggtggtgaaatggaatctgcacaagctaagaatcaagcactcagagatgctggagctacggttcccacttcgtatgaggcttttgaaggagcaatcaaagaagcatttgaaaagctggtttcggaaggcaaaacaactcccgtaaaggaaataacgcctccacaaattcctgaggatctcaacacagcaattaagagtgggaaagttcgggccccaacacacattatttccacgatatctgatgatagaggtgaagagccatgctacgctggtgtacccatgtcatctattgtggagcaaggattaggtgtcggtgatgtcatttctctattgtggttcaaacgcagcctcccccgttattgtacacgttttattgagatttgcactctgttgtgtgctgaccatggtccctgtgtctctggtgctcataacaccatcgtaactgccagggctggaaaagacttagtgtcatgtcttgtgtctgggttgttgactattggtccacgatttggtggtgctgttgacgatgctgcccgatactttaaggatgcttatgacaggggtcttacaccatatgaatttgttgaaagtatgaagaagagaggcatccgagtgccaggaatcggacacaggatcaagagaggtgacaacagagataagagagttgaactacttcagctctacgctagggaaaatttcccttccgttaagtacatggaatacgcagttcaagttgaaacctacacactctcaaaggcaaacaacctagtcctcaacgttgacggagccattggttccctcttcttagatctccttgctggaagtggaatgttcaccaagccagaaatcgatgaaatagtagagattggttacctgaatgggctattcgtgctggcacgttccattggtcttatcggacacacgttcgatcagaagagattgaaacagcctctataccgtcacccatgggaagacgtcctctacaccaagtgaaaacgctttcgatagcaacaaagaaacaataatttgcctgccctttcaacattttatcaaagtgttttgttaaccattttgttgtgatcattcttcatgttttttagacttgtatttgtattcccataagtgctttttaagcattttttttgtaagttgttataaaagagaccactcttcagttccaatgtatgaaagaaataaacatattcattgttttacctcctaaattacactggatatgttgtagttgtcg

SEQ ID NO: 2541 - DNA, 2232 bp, Capsicum annuum
tgtttaccaaaaacacaggtctccgcaaagtcgtaagaccatgtatcggggctgacgcctgcccagtgccggaaggtcaaggaagttggtgacctgatgacctcacatcaaacttaactattcattgcggggaggcaaacttcattcttcaacctcatttaatcaagaacaaatacatatttggtctcgattaaatcggcagaatggcgactggacaacttttctccaaaactacgcaagcattgttctacaactacaagcagcttcctatccaacggatgctcgactttgatttcctttgtgggagagaaacaccttctgttgctggaattatcaatcctggttccgagggattccagaaactcttctttggtcaggaggaaattgcaatcccagtacattctaccgttgaagctgcctgtgctgctcatcctaccgctgatgtcttcataaactttgcgtctttcagaagtgctgctgcttcttccatgtccgctctaaagcagccgaccatcagagttgtggctattatagctgaaggtgttcctgagtcggacaccaagcagcttattggttttgcaaaggcaaacaataaggtagttattggtccagctaccgttggagggattcaagctggagcttttaagattggtgatactgctggaacaattgataacattattcagtgcaagctttacaggcctggatctgtgggattcgtctccaaatctggtggtatgtcgaatgaactatacaacacaattgcccgtgttactgatggagtttatgaaggaattgcaattggtggggatgtctttcctggctctaccctttctgatcatgttttgcgcttcaacaatattccacaggtcaaaatgattgttgtacttggggaactcggtggacgagatgaatattccttagttgaagctctgaagcaagggaaaatcaacaagcctgttgttgcctgggtcagcggaacttgtgctaccctcttcaagtcggaagtacagtttggacatgcgggtgcgaagagcggtggtgaaatggagtctgcacaagctaagaatcaagcgctcagagatgctggagctgtggttcctacttcatatgaagcttttgaaggagcgatcaaagcagcatttgaaaatctggtctcggaaggcaaaacaactcctgtaaaggaaataacgcctccaaatattcctgaggatctcaacacagcaattaagagcgggaaagttcgagccccaactcatattatttccaccatatctgatgatagaggtgaagagccatgctacggtggtgtacccatgtcatctattgtggagcaaggattaggtgtcggtgatgtcatttctctgttgtggttcaaacgtagcctcccccgttattgtacacgttttattgagatttgcgttctgttgtgtgctgaccatggtccatgtgtctctggtgctcacaactccatcgtaactgcccgagctggaaaagacttggtatcatgtcttgtttctggattgttgactattggtccccgatttggtggtgctgttgatgacgccgcaagatactttaaggatgcttacgacaggggtcttacaccatatgaatttgtcgaaagtatgaagaagaagggcattcgcgtgccaggaattggccacaggatcaagagaggtgacaacagagataagagagtggaactactgcagctttacgcgagggataatttcccttccgttaagtacatggaatacgcggttcaggttgaaacctacacactctcaaaggcaaacaacctagtcctcaacgttgacggagccattggtaccctcttcttagatctcctagctggaagtggaatgttcaccaagccggaaattgatgaaatagtagagatcggttacctgaatggtctcttcgtgcttgcacgttccattggtcttatcgggcacactttcgatcagaagagattgaagcagcctctataccgtcacccatgggaagacgttctctacaccaagtgaagacagacgctctcgacagcaacgagaagcaaaaatttgcctgctctctctatccagcatttcatcaaagtgtttctgttaaccatttgttggtatcattcttcatgttttagactagtgtttgtgtaagttgttataaagagaaataaacacattcgttgttttacgcgttccgatagaatggagagaatgtctactgttc

SEQ ID NO: 2542 - DNA, 2472 bp, Solanum tuberosum
gctttgatgagcaactgaaggaagaattaaggaattctgtagcagggtctttgtctccagcatatctcctcaaagtaggaattgaataacttaagcttttctttcaaagatctcgaagctccagtaggtgacatagcattattatcaatcttcagaactcctgaaaccttactccacgaacttcggtgataacttacatgatactgcttcactttggctgcgtgttttcgtatccaatcatcacctaaaagcaatcccaactcactatctctaacattctaccaccactcaccaaccacctaactatttcactcacctcaactctacttacaggggacaaaagatcatttttttcatcaatcaagaacaaatacatacttggtttcgattaaatcagcagaatggcgactggacaacttttctccaaaactacacaagccttgttctacaactacaagcagcttcctatccaacggatgctcgactttgatttcctttgtgggagagaaacaccttctgttgctggaattatcaatcctggttccgagggattccagaaactcttctttggtcaggaggaaattgcaatcccagtacattctactgttgaagctgcctgtgctgctcatccaacagctgatgttttcatcaactttgcttctttcagaagtgctgctgcttcctccatgtccgctctaaaacagccaaccatcagagttgtggctattatagctgaaggagttcctgagtcggacaccaagcagcttattggttttgcaaaggcaaataataaggtggttatcggtccagctactgtcggagggattcaagccggagcttttaagattggtgatactgctggaacaattgataacattattcagtgcaagctttacaggcctggatctgtgggatttgtctccaaatctggtggtatgtctaatgaactatacaacacaattgcccgtgtgactgatggagtttatgaaggaattgcaattggtggggatgtctttcctgggtctaccctttctgatcatgttttgcgcttcaataatattccacaggtcaaaatgattgttgtacttggggaacttggtggacgagatgagtattccttagttgaagccctgaagcaagggaaaatcaacaagcctgttgttgcctgggtcagcggaacttgtgctacactcttcaagtcggaagtacagtttggacatgcgggtgcaaagagtggtggtgaaatggagtctgcacaagctaagaatcaagcactcagtgatgctggggctacggttcccacttcgtatgaagcttttgaaggagcaatcaaagaagcatttgaaaagctggtttcggaaggcaaaacaactcctgttaaggaaataacgcctccacaaattcctgaggatctcaacactgcaattaagagcgggaaagttcgggccccaacacatattatttctaccatatctgatgatagaggtgaagagccatgctacgctggtgtacccatgtcatctattgtggagcaaggattaggtgtcggtgatgtcatttctctgttgtggttcaaacgcagtctcccccgttattgtacacgttttattgagatttgcactctgttgtgtgctgaccatggtccctgcgtctctggtgctcacaacaccatcgtaactgccagggctggaaaagacttagtgtcatgtcttgtttctgggttgttgaccattggtccacgatttggtggtgctgttgacgatgctgcccgatactttaaggatgcttatgacaggggtcttacaccatatgaatttgttgaaagtatgaagaagaagggcattagagtcccaggaatcggacacaggatcaagagaggtgacaacagagataagagagttgaactacttcagctctacgcaagggaaaatttcccttcagttaagtacatggaatacgcggttcaagttgaaacctacacactctcaaaggcaaacaacctagtcctcaacgttgacggagccattggttccctcttcttggatctccttgctggaagtggaatgttcaccaagccagaaattgatgaaatagtagagatcggttacctcaatggactgttcgtgctggcacgttccattggtcttatcggacacacgttcgatcagaagagattgaaacagcctctataccgtcacccatgggaagacgtcctctacaccaagtgaaaacgctttcgatagcaacaaacaagcaaaaatttgcctgctcttcaacattttatcaaagtgttttgttaaccattttgttgtgatcattcttcatgttttttagacttgtatttgtattctcctaagtgctttttaagcatttttgtgtaagttgttataaaagagacaactctttttgtttcacacaaatgagttttcttcaattccaatgtatgaaaggaataaacacattcattgtttt

SEQ ID NO: 2543 - DNA, 2153 bp, Solanum tuberosum
caccaaccacctaactatttcactcacctcaactctacttacaggggacaagagatcatttttttcatcaatcaagaacaaatacatacttggtttcgattaaatcagcagaatggcgactggacaacttttctccaaaactacacaagccttgttctacaactacaagcagcttcctatccaacggatgctcgactttgatttcctttgtgggagagaaacaccttctgttgctggaattatcaatcctggttccgagggattccagaaactcttctttggtcaggaggaaattgcaatcccagtacattctactgttgaagctgcctgtgctgctcatccaacagctgatgttttcatcaactttgcttctttcagaagtgctgctgcttcctccatgtctgctctaaaacagccaaccatcagagttgtggctattatagctgaaggtgttcctgagtcggacaccaagcagcttattggttttgcaaaggcaaataataaggtggttatcggtccagctactgtcggagggattcaagccggggcttttaagattggtgatactgctggaaccattgataacattattcagtgcaagctttacaggcctggatctgtgggatttgtctccaagtctggtggtatgtctaatgaactatacaacacaattgcccgtgtgactgatggagtttatgaaggaattgcaattggtggggatgtctttcctgggtctaccctttctgatcatgttttgcgcttcaataatattccacaggtcaaaatgattgttgtacttggggaacttggtggacgagatgagtattccttagttgaagccctgaagcaagggaaaatcaacaagcctgttgttgcctgggtcagcggaacttgtgctacactcttcaagtcggaagtacagtttggacatgcgggtgcaaagagtggtggtgaaatggagtctgcacaagctaagaatcaagcactcagtgatgctggggctacggttcccacttcgtatgaagcttttgaaggagcaatcaaagaagcatttgaaaagctggtttcggaaggcaaaacaactcctgttaaggaaataacgcctccacaaattcctgaggatctcaacactgcaattaagagcgggaaagttcgggccccaacacatattatttctaccatatctgatgatagaggtgaagagccatgctacgctggtgtacccatgtcatctattgtggagcaaggattaggtgtcggtgatgtcatttctctgttgtggttcaaacgcagtctcccccgttattgtacacgttttattgagatttgcactctgttgtgtgctgaccatggtccctgcgtctctggtgctcacaacaccatcgtaactgccagggctggaaaagacttagtgtcatgtcttgtttctgggttgttgaccattggtccacgatttggtggtgctgttgacgatgctgcccgatactttaaggatgcttatgacaggggtcttacaccatatgaatttgttgaaagtatgaagaagaagggcattagagtcccaggaatcggacacaggatcaagagaggtgacaacagagataagagagttgaactacttcagctctacgcaagggaaaatttcccttcagttaagtacatggaatacgcggttcaagttgaaacctacacactctcaaaggcaaacaacctagtcctcaacgttgacggagccattggttccctcttcttggatctccttgctggaagtggaatgttcaccaagccagaaattgatgaaatagtagagatcggttacctcaatggactgttcgtgctggcacgttctattggtcttatcggacacacgttcgatcagaagagattgaaacagcctctataccgtcacccatgggaagacgtcctctacaccaagtgaaaacgtttttgatagcaataaacaagcaaaaatttgcctgctcttcaacattttatcaaagtgttttgttaaccattttgttgtgatcattcttcatgttttttagacttgtatttgtattctcctaagtgctttttaagcatttttgtgtaagttgttataaaagagacaactctttttgtttcacacaaatgagttttcttcaattccaatg

SEQ ID NO: 2544 - DNA, 1924 bp, Arachis hypogaea
aatttcccaactcgcgctctcttccactcacctcctcgcccgagtcaacaagatctatctctttattcatcatggcaactgggcaactattctcccgaactacacaagcattgttttacaactacaagcaactgcccatccagcggatgcttgatttcgactttctttgtggaagggaaacaccatcagtagctggaataattaatcctggccctgagggatttcagaagcttttttttggtcaggaagaaattgcaatcccggttcatgctagcattgaagcagcttgtgctgcacatcctactgctgatgtcttcatcaattttgcatcatttagaagtgctgccgcatcgtccatgtctgctttgaagcaaccaacagttagagttgttgctataattgctgaaggagtacccgaatcagacactaagcaattgattgcgtatgccagggcaaacaataaggttgttattggtccggccactgttggaggcattcaagccggtgcatttaaaattggtgacacagctggaacaattgataatataattcactgcaagctctacaggcccggatctgttggatttgcttctaaatctggtggaatgtctaacgaattatacaacactattggccgtgtatctgatggaatttatgaaggcattgccattggaggagatgttttccctggttccactctttctgatcatgttttgcggtttaacaatataccacaggttaaaatgatagtagtacttggggagcttggtggccgagatgagtattccctagttgaagccctaaaacaaggaaaagtaacaaaaccagttgttgcctgggttagtggaacctgagcaagactcttcaaatctgaagtgcaatttggtcatgctggagctaagagtgggggtgagatggagtctgcccaagcaaaaaatcaggcactacaggatgctggagctgttgttcccacttcgtatgaagctttggaaagctgcaattaaagagacatttgataaattggttgaagaaggaaagatcacgccagtgaaggagattactcctccaccaatccctgaggacctaaactctgcaatcaagagtggaaaagtccgagctcctactcatatcatttccaccatttctgatgacagaggtgaggagccatgctatgctggtgtacccatgtcttccattatcgaaaaaggttttggtgtgggtgatgttatctctcttttgtggtttaaacgcagccttccacgttactgtactcaatttattgagatctgcatcatgctatgtgccgaccatggtccgtgtgtctcaggtgctcacaatactattgtgacagcaagggctgggaaggacctagtttccagtcttgtatcaggtttgcttacaattggtcctcgatttggaggtgccattgatgatgctgctcgctacttcaaggatgctcatgataggggccttacaccttatgaatttgtagaaaatatgaagaagaagggcattcgtgtgccaggaatagggcacaggatcaagaatcgtgacaacaaggataagagagttgaactgctacagaagtttgcacggactcattttccttccgtgaaatacatggaatatgctgttcaagttgaagcctacacccttacaaaggcaaataatctagttcttaatgtagacggtgcgattgggtcccttttcttggatcttcttgctggtagtggaatgttcaccaagcaagagattgatgaaattgtggagatcggctatctgaatggtctctttggtctggcacgcgccataggtctgattgggcacagcttggacgaaaagagattgaagcagccgctctaccggcacccatgggaggatggtctcgacacaaagggagtgggtttttgatgggtcaggtgga

SEQ ID NO: 2545 - DNA, 2280 bp, Orobanche aegyptiaca
cgtccaatataattctacctgatttgcctgtgagctaactaacttcacattgccaccttacccatcattgctcagtcgtcgcatttccattatataaatatacccacactcttattcgcctaaataaacatcttacattcttaaccagtagccgatttggtatcctcattgaaaaaaaaaaaggggtgtttcagacggggctatggctacaggacaacttttctcgaaaaccactcaagcattattttacaattacaagcaacttccgatccaacgaatgcttgatttcgactttctctgtggaagagaaacaccttcggtcgccggaattattaatccgggctccgagggatttcaaaaactgttttttggtcaggaggaaattgctattccagttcactcagctgttgaagctgcttgtgctgcacatcctacagctgatgttttcatcaactttgcatcatttagaagtgctgctacgtcctctatggccgctctgaagcagccaaccataagagttgtggccattatagctgaaggtgtccctgagtcagacaccaagcaattgattgcttatgcaaaggcaaacaataaggttgtaattggccctgctactgttggaggtattcaagctggagcctttaagataggcgacacagctggaacaattgataacataattcaatgcaagttgtacagacctggatctgttggctttgtctcaaaatctggtggtatgtccaacgagttatacaacacaattgctcgggtcacagatggaatatatgaaggcattgcaattggaggagatgtgtttcctgggtcgacactttctgatcatgtcctgcggtttaacaatatccctcaggtcaaaatgatggtcgttctaggagaacttggtggacgtgatgaatactccctagttgaagcccttaaacagggaaaagtcaacaagcccgtggttgcttgggtcagtgggacttgtgctaggctctttaagtcagaagtacaatttggtcatgcgggagctaagagtggtggtgagatggagtccgctcaggccaagaatgaagcactcagagaagctggagctgttgttccaacatcttttgaagcatttgaatgtgcaatcaaggagacatttgagaaattggttggggaaagcaaaattacaccggtgaaggaggtgacaccccctcaaataccagaggatcttaacacagcaatcaagagtgggaaagttcgggccccaacgcatattatttccacaatctctgatgataggggggaggaaccgacctatgctggcatgccaatgtcttccattgttgagcagggattaggtgtgggtgatgtcatttctttattgtggttcaaacgcagccttcctcagtattgcacacgtttcattgagatttgcatcatgttgtgtgctgaccatggtccctgtgtctctggtgctcacaacaccattgtaacggctagggctgggaaagacacagtctctagtcttgtttcaggtttgttgacaattggccccagatttggtggggctattgacgatgctgctcgttatttcaaggatgcttatgacaaggggcttacgccttatgagtttgtggaaagcatgaaaaagaagggcattcgtgttcctggtattgggcacagaatcaagaggggtgataacagagataagagagtagagttactacaacgttttgcacgatccaattttccctctgtcaagtacatggaatatgctgtggaagtcgagacatacactctttcgaaatcaaacaacctggtactcaatgtcgatggtgccattggatccctattcttggatcttcttgcgggtagtggcatgttcaccaaccaagaaatcgatgagattgttggaattggttatctaaatggtctctttgttctcgctcgttcaattggtctcatcggacatacgttcgaccagaagagactgaagcaaccactataccgtcacccgtgggaagatgttctctacaccaaatgagtgagtgatcaaattgttgcttagagaaatcaggctacaaacattatgccttatacacatttttttcttttttgggaatcttttttcttatcagttatcacattgttgtgccattttcagttaatttagttatttgtgctgctaaaatagcaggttgacaacttctgtaagtttctaaaataagtcatcaacagagcactcttttgcaagtactgcgtttcttattttatattatggaaaactctattacc

SEQ ID NO: 2546 - DNA, 2583 bp, Podocarpus macrophillus
cgggaacgcccggtattagcgattgtactgtaaaaataggaattacttgacctgtgggtctcgcacctcgcccccgatccaactccctttgtcttgtccaaggtggactgtcaggcgccctccatcaaacatacataagggtacattagacttcattatatttatattataattttggcacctgtgcttcagctctcacgtgaattaactgagctacctgccgtgggtagatagatacatatgcatgcaactccatagctaggcttgctcatatcgaaactttgtgattttgggctttggaggagctgctcctgcgtttggttctgtttcaagagtccgtctttttaaaacatggcaacagggcaactcttctcgagcacaactcaggcattattttacaactataagcaacttcctattcaacgaatgctggactttgattttctctgtggaagagaaacaccatctgttgctggaataattaatcctggctctgaaggatttcagaagcttttctttgggcaggaggaaattgccatacctgttcattcagctattgaggctgcatgcaaaactcatccaacagccgatgtattcatcaactttgcatcctttagaagtgcatttgcatcttccatgtctgctctgaagcagccaacaattagagtagtagctataatagctgaaggtgtcccagaaggagatgcaaagcaattaattgcatatgcacgagctaacaataaggttataattgggcctgctactgtaggtggcattcaggctggagcgtttaaaattggagacactgctggaaccattgacaatattattcaatgcaaactgtataggccaggatctgttggatttgtctcgaaatcagggggaatgtcaaatgaaatgtataacacaattgcccgtgttacagatggaatatatgaaggtattgcaattggtggggatgtgtttcctggttcaacattgtctgatcatgttttgcggtttaacaatattccacaggttaagatgatggttgtgcttggtgaacttggtggtagagatgagtattctctagttgaagccttaaaacaagggaaggttcataagccagttgttgcttgggttagcggcacctgtgcacgcctgtttaagtctgaagtgcagtttggccatgcaggtgcaaaaagtggaggcgacctggagtctgcacaagcaaagaatcaggcactcaaagaagtcggcgcaattgttcccacctccttcgaagggttggaagaaactataaaacaaacattccagcaacttgttgaagaaggaaagattggtccaacacgagatgttaagcctcctcccataccagaagacctgaacatagctatcaagagtggcaaagtcagagcaccaacacatattatttccactatctgtgatgacagaggtgaggagccaacttacgcgggtgtgcccatgtctactattgttgagaaaggctatggtgtgggtgatgtcatctcacttttgtggttcaagcgcagtctgccaagatactgcacacaattcattgagatatgtattatgctttgtgctgatcatgggccatgtgtatctggtgcgcataatacaattgtaacagcaagagcagggaaggatctagtttcaagtcttgtttcaggtcttcttactattggcccaagatttggtggggctattgatgatgctgcaaggtacttcaaggatgcatatgataggggtttatcgccttatgagtttgttgaagggatgaagaagaaaggtattcgtgtgccagggattggtcacaggatcaagagaggagacaaccgtgacaagagagtggagcttctgcaattatatggtcgcacacattttcctgcggtgaagtacatggattatgcagtacaagtggagacttatacattaaccaaagcaaacaatcttgtactcaatgttgatggtgctataggatcccttttcctcgatcttctcagtgttagcggaatgtttacccaacaagagattgatgagattgttcagattggttatctaaatggcctctttgtacttgcacgagcaattggtttgattgggcacacgttcgaccagaagcggttgaaacagcccttgtaccgtcacccatgggaagatgtcctctacaccaagtagaggacatgctagttcacagagcatgttttgggagattttttaggtgtggaacaagatgtttcacaaaacaagaacttcctcatttgatatttattgccaaataaattaacctgtcttacattctgtataagttgtgaagtatatgtgggctcatttttttctcatttcatgtttctgagcaagctaactgttttgttagatgcttaagctttttgattccaagcaagttaactattttgttacatgattaagctttttgaaaataatgagaatacaagtagaagtatgcatgtatatggtttagttccagtagtgacagaaattaccaccttttaaatgtggaaagctgttgcagattgcatggtaatgttattttcttgacattaattaatattatgtgttcag

SEQ ID NO: 2547 - DNA, 2148 bp, Solanum phureja
acactcacccatctaacattctaccaccactcaccaaccacctaactatttcactcacctcaactctacttacaggggacaaaagatcatttttttcatcaatcaagaacaaatacatacttggtttcgattaaatcagcagaatggcgactggacaacttttctccaaaactacacaagccttgttctacaactacaagcagcttcctatccaacggatgctcgactttgatttcctttgtgggagagaaacaccttctgttgctggaattatcaatcctggttccgagggattccagaaactcttctttggtcaggaggaaattgcaatcccagtacattctactgttgaagctgcctgtgctgctcatccaacagctgatgttttcatcaactttgcttctttcagaagtgctgctgcttcctccatgtccgctctgaaacagccaaccatcagagttgtggctataatagctgaaggagttcctgagtcggacaccaagcagcttattggttttgcaaaggcaaataataaggtggttatcggtccagctactgtcggagggattcaagccggagcttttaagattggtgatactgctggaacaattgataacattattcagtgcaagctttacaggcctggatctgtgggatttgtctccaaatctggtggtatgtctaatgaactgtacaacacaattgcccgtgtgactgatggagtttatgaaggaattgcaattggtggggatgtctttcctggctctaccctttctgatcatgttttgcgcttcaacaatattccacaggtcaaaatgattgttgtacttggggaacttggtggacgagatgagtattccttagttgaagccctgaaacaagggaaaatcaacaagcctgttgttgcctgggtcagcggaacttgtgctacactctttaagtcggaagtacagtttggacatgcgggtgcaaagagtggtggggaaatggagtctgcacaagctaagaatcaagctctcagtgatgctggggctacggttcccacttcgtatgaagcttttgaaggagcaatcaaagaagcatttgaaaagctggtttcggaaggcaaaacaactcctgtaaaggaaataacgcctccacaaattcctgaggatctcaacactgcaattaagagcgggaaagttcgggccccaacacatattatttccaccatatctgatgatagaggtgaagagccatgctatgctggtgtacccatgtcatctattgtggagcaaggattaggtgtcggtgatgtcatttctctgttgtggttcaaacgcagtctcccccgttattgtacacgttttattgagatttgcactctgttgtgtgctgaccatggtccctgcgtctctggtgctcacaacaccatcgtaactgccagggctggaaaagacttagtgtcatgtcttgtatctgggttgttgactattggtccacgatttggtggtgctgttgacgatgctgcccgatactttaaggatgcttatgacaggggtcttacaccatatgaatttgttgaaagtatgaagaagaagggcattagagtgccaggaatcggacacaggatcaagagaggtgacaacagagataagagagttgaactacttcagctctacgcgagggaaaatttcccttcagttaagtacatggaatacgcggttcaagttgaaacctacacactctcaaaggcaaacaacctagtcctcaacgttgacggagccattggttccctcttcttggatctccttgctggaagtggaatgttcaccaagccagaaattgatgaaatagtagatatcggttacctcaatggactgttcgtgctggcacgttccattggtcttatcggacacacgttcgatcagaagagattgaaacagcctctataccgtcacccatgggaagacgtcctctacaccaagtgaaaacgctttcaatagcaacaaacaagcaaaaatttacctgctcttcaacattttatcaaagtgttgtgttaaccattttgttgtgatcattcttcatgttttttagaacttgtatttgtattctcctaagtgctttttaagcatttttgtttaagttgttataaaagagacaactctt

SEQ ID NO: 2548 - DNA, 2086 bp, Cucumis sativus
gtccctttgacgctcacaatggctactggacaaatattttctcgcacgacacaagcgttattctataactacaaacaacttcccatccaacggatgcttgattttgacttcctttgcgggagggaaacaccatcagttgctggaatcatcaatcctggttctgagggatttcagaaactcttttttggtcaagaggaaattgccattcctgtgcattctacgattgaagcagcttgttcagcacacccaactgctgatgtttttatcaactttgcatcctttagaagtgctgctgcatcgtcaatggctgctttgaaacagcctaccatcagagttatagctatcatagctgagggtgttccggagtcggacactaaacaattgattgcatatgcacgggcaaacaataaggttgtgattggcccagcaactgttggaggcatacaagccggagcatttaaaattggtgacactgctggaacgattgacaatattgtacaatgcaagctttacagaccaggatctgttggttttgtctctaaatcaggtggaatgtctaacgagatgtataatactattgcacgtgttaccgacggaatttatgaaggtattgcaattggaggagatgtgtttccaggttcgactctttctgatcacattttgcggtttaacaacattccacaggttaaaatgatggttgtgcttggagaacttggtggtcgagatgagtattctttagttgaagctttgaaacaaggaaaagttaacaaaccagtggttgcctgggttagtggcacttgtgccacattgtttaaatctgaagttcaatttggtcatgctggagcaaaaagtggtggtgagttggagtctgcacaagcaaaaaatcaagctttaaaggaagctggagctattgttcccacatcatatgaggcccttgaagctgcaattaaggaaacatttgaaaaattggttggagacggggaaattacaccagtgaaggaagtgaagcctcctcaaattcctgaggatctgaattcagcaattaagagtgggaaagttcgtgcaccaacccacattgttaccaccatttctgatgaaagaggtgaggagccaagatacgctggaatacccatgtcttcaattgttgagcaaggctatggcgttggcgatgttatttcactcttatggttcaagcgcagccttcctcgttactgtacacatttcattgagatatgtattatgctctgtgctgatcacggtccttgtgtatctggagcgcataacaccatagtaactgcaagggctggaaaagacctcgtgtcatgtcttgtctcaggtttgcttactattggacctcgattcggtggtgccattgatgacgccgctcggtacttaaaggatgcttgtgacagaggtcttacggcttatgagtttgtcgaaggcatgaaaaagaaaggaattcgggtacctggaattggtcacaggataaagagaggagacaacagagacaagagagtggagctgctacagcgatttgcaagaacacatttcccaacagtgaagtacatggaatatgctgtggaggttgaaacatacacactatcaaaggcaaacaacttggttcttaatgtggatggtgcaattggttctcttttcttggaccttcttgctgggagtggaatgttcagcaaacaagagattgatgagatcgtccaaattggatatttgaacggcctctttgtcctcgctcgctccattggtctcatcggacatacatttgatcaaaagagattgaaacagcctctataccgccatccttgggaagatgtcctctacaccaaatgataacactttacattagagacccaacccaacccaaacgtcaatttccaaatttttgtaaaattattattactacgaatactgctatttggtgttttgttttttctatttttcctcgccctctttccttcattacccttttctagatcaacgtgtgtgtccctctcgctctttaggtttctaactgtaattcaaaaaacaaaagaaggattgtagtgtttttttctaaaaataaatcttttcc

SEQ ID NO: 2549 - DNA, 2308 bp, Fragaria vesca
aaaccaaacccgttcctaaatcccagcaatctcacatttcacccccaaaatctcatctcctctctccttcggttactctctcagaaatcggaggttaacttgagtcggagatcatggccaccggtcaattgttttcccggactactcaagctttgttctacaactacaagcagctccctatccagcgcatgcttgattttgacttcctttgcgggagggaaacaccgtctgttgccggaatcattaatcccggtgctgagggatttcagaagctctttttcggccaggaggaaatcgccataccagtgcactcaagcattgaggcatcatgtgctgcacatcccactgccgatgtctttatcaactttgcttcctacagaagtgctgctgcttcttccttgactgctctcaagcagccaaccatcagagtcgtggccattattgctgagggtgtgcctgagtcggacgctaagcagttgatcgcatatgcacgagcaaacaacaaggttgtcattggcccagctactgttggaggaatccaagctggagcttttaagattggtgacactgccggaacaattgataacattattcattgcaagctatacaggcctggatctgttggttttgtctccaaatccggtgggatgtccaatgaaatgtacaatactgtagctcgtgtaacagacggactttatgaaggtattgctattggaggtgatgtgttcccaggttctacactctcagaccatgttctgcggtttaacaatatccctcaggttaaaattattgttgtacttggggaacttggcgggagagatgagtattctctagttgaagctttaaagcagggaaaagttaacaaaccagtggttgcttgggttagtggaacttgtgcaacacttttcaaatccgaagtacaatttggacatgctggcgctaaaagtggtggtgagatggagtctgcacaagcaaagaaccaagccctgagggatgctggagctgttgttcccacttcatatgaagctttggaaattgccatcaaggaaacgtttgagaaattggttgaagaggggaaaattgcaccagtgaaggaatttaagcctccacagatacctgaagatcttaacaccgcaattaagagtggaaaagttagggctccaactcatattatatccacaatctctgatgatagaggtgaggaaccatgctatgctggtgtgcctatgtcttccattgttgagcagggttatggtgtgggtgatgttatctctcttttgtggttcaaacgcagccttcccagttactgtaccaagtttattgagatatgtgtcatgttgtgtgctgaccatggtccttgcgtctctggtgctcacaacacaatagtaaccgctagggctggcaaggacctagtttccagccttgtctcaggtttgctcacaattggtccacgatttggtggtgctgttgatgatgctgctcgatacttcaaggatgcatatgacaagaatcttacaccctatgagtttgtcgaaagcatgaaaaagaggggaatccgtgtgccagggattggtcacaggatcaagagaggggacaacagagataaaagagtagagctcctacaactgtttgcacgcacacatttcccttctgtcaagtacatggaatacgccgtagaagttgagacctacacgctctcaaaggcaaacaatctggtcctgaatgtggatggtgctattggaaccctgttcttggatctccttgctggcagtggaatgttcaacaagcaagagattgatgagattgttgagattggctatctgaatgggctatttgtgctggcacgttccattggtttgattgggcacacatttgaccagaagaggttgaagcagcccctataccgccacccatgggaggatgttctttacaccaagtgaagagacgtcttatagcttgtgcaaagctgtccctgctctctatgagcatcggtgccttctccgagtttcttgagtctgcaatttgctggaatatgattgcgcttctttacttgttagaatagtgtttgtactgctaatgcccgagcatgttcatttgtaagccgtgtatcgaaaagttcataaaacagagaacccatgatcattttactaaacaaagtttatgatttatgtcaaatttcttctttgattccactttctcctgttaattatcatgtgttaaaaaaagtggtcagtgaataaatagaaagctgtcaaagctcccatacaattacattgccttcttcttttctgtatatgtgccaagtgtt

SEQ ID NO: 2550 - DNA, 2108 bp, Aquilegia formosa
aacagggtcattcactttctctctgttgtattggattcaggtctgattagtgtgtctgtgcatcatggctacgggacagctattttctcgatcaacacaggcgctattctataattacaagcaacttccaattcaaagaatgctcgattttgacttcctttgtggacgagaaacaccatctgtggctgggattatcaatccaggggcagagggttttcaaaagctctttttcggtcaggaggaaatcgcaataccagttcattcagccattgaagcagcttgtgctacacacccgactgctgatgtttttatcaacttcgcatcatatagaagtgcggcagcttcttccatggctgctctaaagcaaccaaccatcagagttgttgctataatagctgaaggtgttcccgagtcagataccaagcagttaatcgcttatgcaaaggcaaataataaggttgttatcggccctgcaactgtaggaggcattcaagctggagcattcaagattggtgacactgctggaacaattgacaacataatccaatgcaagctctacagacctggatctgttggttttgtctctaaatctggtggtatgtccaatgaactttacaacacaattgcaagggtaacagatggattatatgaaggtatagcaattggaggagatgtgttcccaggctcaactctttctgatcatgtcctgcgatttaacaatattccacaggtcaaaatgatggttgtgcttggtgagctaggagggcgggacgagtactcactagttgaagcactaaaacaagggaagatcaacaaaccagtggttgcctgggttagtggaacctgtgcacggctcttcaagtcagaagtgcagtttggtcatgcgggtgcaaaaagtggtggtgaaatggagtctgcacaggcaaagaatgaagcattaagagaagcaggagctattgttcccacttccttcgaagcttttgagggtgcaataaaagagacatttgagaaacttgtcgaacaggggaagactacacctgtgaaagaaattcagcctcctcagattccagaggatcttaatgttgcaattaaaagtgggaaagttcgcgctcctactcatataatctccaccatctctgatgatagaggtgaggagccatgttatgctggtgtgccaatgtcctccattgttgaacagggttatggagtgggagatgttatctctcttttgtggttcaagcgaagtcttccacggtactgcacacaatttattgagatctgcatcatgttatgtgctgaccacggtccctgtgtctctggtgctcacaataccattgtcaccgctagggctgggaaggaccttgtttcaagccttgtttcagggcttctgacaattggtcctcgatttggaggagctatcgatgacgccgcccgatacttcaaggatgcatatgacaagggtctttctccttatgagtttgtggagagtatgaaaaaaaagggcattcgtgtaccaggaattggacacaggatcaagagaggtgacaacagagacaaaagagtagaactactacaactatatggacggaccaattttccttcagtgaagtacatggaatatgctgttgaagttgaaacctacaccttgtcaaaggcaaataatcttgttctcaatgttgatggagccattggatctcttttcttggatcttcttgctggaagtggaatgttcagcaagccagagattgatgagattgttgagataggttatctgaacgggctctttgtgctggcacgttctattggtctgattgggcacacctttgatcagaagaggttgaagcagccactttaccgccacccatgggaagatgttctctacaccaaatgatctgttgttaaagagtatatgcaacttcaccctatttcagttccatatgttaatcattttttaattgcaattttctgggtgagtattagagttttagattagtgattgtactaattatcagaggtttgccgccagtttgttacgtttgtggaaaaatggaagaaaaaagatgtatcttaaaaattttctcagttttagcagacatttattgaagtgc

SEQ ID NO: 2551 - DNA, 2059 bp, Aquilegia formosa
ttcactttctctctgttgtattggattcaggtctgattagtgtgtctgtgcatcatggctacgggacagctattttctcgatcaacacaggcgctattctataattacaagcaacttccaattcaaagaatgctcgattttgacttcctttgtggacgagaaacaccatctgtggctgggattatcaatccaggggcagagggttttcaaaagctctttttcggtcaggaggaaatcgcaataccagttcattcagccattgaagcagcttgtgctacacacccgactgctgatgtttttatcaacttcgcatcatatagaagtgcggcagcttcttccatggctgctctaaagcaaccaaccatcagagttgttgctataatagctgaaggtgttcccgagtcagataccaagcagttaatcgcttatgcaaaggcaaataataaggttgttatcggccctgcaactgtaggaggcattcaagctggagcattcaagattggtgacactgctggaacaattgacaacataatccaatgcaagctctacagacctggatctgttggttttgtctctaaatctggtggtatgtccaatgaactttacaacacaattgcaagggtaacagatggattatatgaaggtatagcaattggaggagatgtgttcccaggctcaactctttctgatcatgtcctgcgatttaacaatattccacaggtcaaaatgatggttgtgcttggtgagctaggagggcgggacgagtactcactagttgaagcactaaaacaagggaagatcaacaaaccagtggttgcctgggttagtggaacctgtgcacggctcttcaagtcagaagtgcagtttggtcatgcgggtgcaaaaagtggtggtgaaatggagtctgcacaggcaaagaatgaagcattaagagaagcaggagctattgttcccacttccttcgaagcttttgagggtgcaataaaagagacatttgagaaacttgtcgaacaggggaagactacacctgtgaaagaaattcagcctcctcagattccagaggatcttaatgttgcaattaaaagtgggaaagttcgcgctcctactcatataatctccaccatctctgatgatagaggtgaggagccatgttatgctggtgtgccaatgtcctccattgttgaacagggttatggagtgggagatgttatctctcttttgtggttcaagcgaagtcttccacggtactgcacacaatttattgagatctgcatcatgttatgcgctgaccacggtccctgtgtctctggtgctcacaataccattgtcaccgctagggctggaaaggaccttgtttcaagccttgtttcagggcttctgacaattggtcctcgatttggaggagctatcgatgacgccgcccgatacttcaaggatgcatatgacaagggtctttctccttatgagtttgtggagagtatgaaaaagaagggcattcgtgtaccaggaattggacacaggatcaagagaggtgacaacagagacaaaagagtagaactactacaactatatggacggaccaattttccttcagtgaagtacatggaatatgctgttgaagttgaaacctacaccttgtcaaaggcaaataatcttgttctcaatgttgatggagccattggatctcttttcttggatcttcttgctggaagtggaatgttcagcaagccagagattgatgagattgttgagataggttatctgaacgggctctttgtgctggcacgttctattggtctgattgggcacacctttgatcagaagaggttgaagcagccactttaccgccacccatgggaagatgttctctacaccaaatgatctgttgttaaagagtatatgcaacttcaccctatttcagttccatatgttaatcattttttaattgcaattttctgggtgagtattagagttttagattagtgattgtactaattatcagaggtttgccgccagtttgttacgtttgtggaaaaatggaagaaaaaagatgtatctt

SEQ ID NO: 2552 - DNA, 2307 bp, Nicotiana tabacum
  misc_feature (1270)..(1270): n is a, c, g, or t
  misc_feature (1329)..(1329): n is a, c, g, or t
  misc_feature (1332)..(1332): n is a, c, g, or t
  misc_feature (1337)..(1338): n is a, c, g, or t
ggccattacggccggggaattccaccattcaaccaaccaactacctaactatttcactcacctcaactgtacttagggggaacaagttcattctccatctccatttaatcaagaatatacatacttgaggtctcaattaaaccagcagaatggcgactggacaacttttctccaaaactacacaagctttgttctataactacaagcagcttcctatccaacggatgctcgactttgatttcctttgtgggagagaaacaccttctgttgctggaattatcaaccctggttctgagggattccagaaactcttctttggtcaggaggaaattgcaattccagtacattctaccattgaagctgcctgtgctgctcatcccacagctgatgttttcataaactttgcctctttcagaagtgctgctgcttcctccatgtccgctctaaaacagccaaccatcagagttgtggctattatagctgaaggtgttcctgagtcggataccaaacagcttattggttatgcaaaggcaaataataaggtggttattggtccagctactgtcggagggattcaagctggagcttttaagattggtgatactgctggaacgattgataacattattcagtgcaagctttacagacctggatctgtgggcttcgtctccaaatctggtggtatgtctaatgaattatacaacacaattgcccgtgtgactgacggagtttatgaaggaattgcaattggtggggatgtctttcctggatctaccctttctgatcatgttttgcgcttcaacaatatcccacagatcaaaatgattgtggtacttggggaacttggtggacgagatgaatactccttagttgaagccctgaagcagggaaaaatcaacaagcctgttgttgcatgggttagtggaacttgtgctagactcttcaagtcggaagtacagtttggacatgcgggtgcgaagagcggtggtgaaatggagtctgcacaagcaaagaatcaagcactcaaagatgctggagccatggtccccacctcatatgaagcttttgaaggagcaatcaaagaagcatttgaacagctggtctcggatggcaaaacaactcctgtaaaggaaataacgcctccacaaattcctgaggatctcaacacagcaattaagagtgggaaagttcgagccccaactcatattatttccaccatatctgatgatagaggtgaagagccatgctacgctggtgtacccatgtcatntattgtggagcaaggattagtgtggtgatgtcatttctctgttgtggttcaaacgcagnctnccccnntattgtgcacgttttattgagatttgcattttgttgtgtgctgaccacggtccctgtgtctctggtgctcacaactccattgtaactgcaagggctggaaaagacttggtgtcatgtcttgtttccgggttgttgactatcggtccccgatttggtggtgctgtcgatgatgctgcccgatactttaaggatgcttatgacaggggtcttacaccatatgagttcgtcgaaagtatgaagaagaagggcatcagagtgcctggaatcggtcacaggatcaagagaggtgacaacagagataagagagtggaactactgcaactttatgcgagggaaaatttcccttctgttaagtacatggaatatgcagttcaggtagaaacctacacactctcaaaggcaaacaacctagtcctcaacgttgatggcgccattggttccctcttcttggatctccttgctggaagtggaatgttcaccaaaccagaaatcgatgaaatagtagagatcggttacctgaatggtctgtttgtgctggcacgttctattggtcttatcgggcacacatttgatcagaagagattgaagcagcctctataccgtcacccatgggaagatgttctctacaccaagtgaagacgctcccaatagcagcacgcagaaagtcgcctgcttcctatccagcattttatcgaaaagtgtttgtttagtcatttgttgtgatcattcttcttgttttctgctagtattttgtactcctaagaacttgctaagcatttctgtaagttgttataagagacaactcttttagtttcacaccaagagtttccttcaattcctatatatcaaagaaataacacattcattgctctaccttgcttattgagtcattgtaatatctacttactgcacaagatttgtttcaaagacttacttagataagtgtttttttggtgagcggccgcatga

SEQ ID NO: 2553 - DNA, 2982 bp, Theobroma cacao
tgaactttaaatgtagctttcgagagataaattttatgtaaattagaaaattttctttcacatatccaaattttaaagttcagagatgaagtcattgcgaattaaacaagtttaaatactggactccgactcgtaagtttaatgtacggtagtctgtgggctttgcctaaatagggatggccgcaggttgggttttgggtccttcccctgggcccgcactgctctcttggttccagttatggcccatagaaatacgaagatcgtccaacgttcaaagtcgaaactgaaacgaaaggagggcgtgcctaactaccgcgggagaagagatccaccaaagatgaaccaaaccaaccgcccctaccccccgtaacggccatctttccttttgttcttgttttggtgcttcaatatttcttcaccttcccttcccttctaaatcaatcaactaactactcataaacaacctctacattgttatttgcttatatctctttctgtattccagatttccagtccactctgtttcgtctcagggtcgatgctctttatttaattctccttccttcatttgattactctaaatttctcgctgggatctggttttagaatatggcgacagggcaactgttctcccggactacacaggcattgttctacaactacaagcagcttcctattcagcgaatgcttgattttgactttctttgtggtagggaaacaccttctgttgctggaattatcaacccaggttctgagggattccaaaagctcttttttggtcagcaagaaattgcaatcccagttaattcaaccattgaagcagcttgtgctgcccaccctactgctgatgtttttatcaactttgcatcattcagaagtgctgcagcttcatcattggctgctttgaaacagccgaccatcagagtggtggctataattgctgaaggtgttccggaatcagatactaagcagttggttgcatatgctcaagcaaataataaggttgttattggccctgccactgttggaggtatccaagcaggagcttttaagattggtgatacggctggaacaattgacaacatcatccactgcaaactttacagacctggatctgttggatttgtctctaaatcaggtggcatgtctaatgaactttacaacacaattgctcgtgttacagatggcatctatgaagggattgcaattggaggagatgtctttcctggctcaactctttctgaccacatattgcgattcaataacatcccacaggtcaagatgatggtggtgcttggggaacttgggggtcgagatgaatattcactagttgaagctctaaaacaggggaaagtaaacaaacctgtagttgcttgggttagtggaacgtgcgcaaggctattcaaatcagaagtgcagtttggtcacgctggtgctaaaagcggtggggaaatggaatcagcacaagcaaaaaatcacgcattgaaagaggctggtgctgttgttcccacttcatatgaagcatttgagactgcaattaaggagacatttgagaaacttgttgaagaggggaaaattactgcagcaaaagaattcaaccctccccagattcctgaggatcttaatagtgcaattaaaagtgggaaagttcgagctccaactcatattatatctaccatctctgatgacagaggtgaagagccacgttatgctggcgttccaatgtcctccattatagaacaaggtttaggagtaggtgacgtcatctctcttttgtggttcaagcgtagccttcctcattactgtactcgttttattgagatctgcatcatgttatgtgctgatcatggtccctgtgtctctggtgctcacaatgctatagtcactgcaagggctggaaaggatcttgtttctagccttgtctccggtttgcttacaattggtcccagatttggtggggccattgatgatgctgctcggtatttcaaggatgcttgtgatagaggactttcgccatatgagtttgttgaaggcatgaaaaagaagggtattcgtgttcctggtattggacacaggatcaagagaggagacaacagagataagagagtggagatactacaactgtttgcacgcacccatttcccttcagtgaagtacatggagtatgcagttcaagttgagtcatataccttgtcaaaggccaacaaccttgttctcaatgtagatggtgctataggctctcttttcttggatcttcttgttagcagcggaatgttcagtaaacccgagattgatgagattgttgaaattggttatctgaatggactatttgtgctagcgcgctccattggtttgatcgggcacacctttgaccaaaagagactgaagcagccgctgtaccgccatccatgggaggatgttctctacacaaagtgatgcatagcaagcgcgcatggtgctacttattcacagttaatctactcatcacccgaagagagaagttttgatttatgatttatttggttgtgagaagaacacattatttcctgtactctctaaacgcaattcctataattctgtttgttgtttcactttctttttcaaagttcttcagacaatatttaaatccaaaattaatggtgctacagttaattctgttgtgtactacagtttaaattctgtttccttgttcttggccaatattggtgctcaagctgttttcctattaacaacactctgcagaaatcattttcctgtaactttactttgtatctaaagaattgggtctgcggctctgcgctaaagtaacaggtgatccatggcatacacttacgtgctctgttccttagagtccggatttcaccattatggtcccgtcatcatcagttcaacacccattgattataggaaggccctagaaatgtacttccttcgtgtatgtgctgcattttggaggacacagaataatctttaaattaactg

SEQ ID NO: 2554 - DNA, 2371 bp, Tropaeolum majus
cggccggggaccaaagagggcaccaaaccaaccaaccacctccgggctacacccttctcattcccattataagaacacagttttacatcaatttttgtctgcaatttcatcaattcatccgtttttccccttcaaattaactccattttctcgatttccccatctgggaaagaacaaatcccatttttcatctgacttttcacgtgctacactgcaaacttttcgattatttaactccatttccatctacccccccttctttcccttccgttctgtttcttgaggggtactgttttcgctgtatattgaatccagtctctttcgatacagaactttgggctaacaaatatggcgacggggcaaatcttttcgcggactacacaagcattattctataactacaagcagcttcctattcaaagaatgcttgattttgacttcctatgcggaagagagataccatctgtggccgggattattaacccaggctctgagggatttcaaaagctgtttttcggtcaagaggaaatagccataccagttcattcaaccatagaagcagcttgtgcagctcatcctactgctgatgtttttatcaactttgcgtcattcagaagtgcggctgcttcatcattgtctgctttgaaacaaccaaccatcagagtggtggctattattgcagagggtgttccagagtcggataccaaacatttgattgcatatgctcgagcaaataataagatggttattggcccggctacggttggaggaattcaagctggagcttttaagattggtgatactgctggaacaattgacaatattatccagtgcaagctttacaggcctggatctgttggatttgtctcgaaatctggtggtatgtcgaatgaactttataacactattgctcgtgtaactgatggattatatgaaggtattgcaattggaggagatgttttccccggctcaactctttccgaccatgttctgcgatttaacaatattccacagatcaaaatgatagtggtgcttggggaacttggtggacgagatgagtactcactagtcgaggctttaaagcaagggaaaataagcaaaccagtagttgcttgggttagcggaacctgtgctcgtctcttcaaatcagaagtacaatttggtcatgctggggctaaaagtggtggtgacatggaatccgcacaagcgaaaaacgaagcattgaaagacgcaggtgctgttgttcctacttcatacgaagcgttcgaggatgcaattaaggaggcattcgagaaaattgtcgaagcgggaaatatcacaccagtgaaagaaattacacctccccagatcccagaggatctaaacatcgcaattaagagtggaaaagttcgcgcgccaactcatattatatccaccatttccgatgatagaggtgaagagccgtgttacgccggtgttcccatgtcttctattgttgagcaaggaatgggagtgggcgatgttatctctcttttgtggttcaagcgtagtcttcctcgttactgtacacagtttatcgagatctgcatcatgttatgcgctgaccatggtccctgtgtctctggggctcataataccatcgttacagccagggctggaaaggatctcgtttcatgccttgtatcaggtttgctaacaattggtccacgatttggtggagcaattgatgacgctgcacgatactttaaggatgcttgtgataggggacttgcaccttatgagtttgttgagtcgatgaagaagaagggcattcgtgttcccggaataggacacaggatcaagaatcgagataacagagacaagagagttgagctcctacaacgttacgcaaaaacacattttcctgcagtgaaatacatggaatatgcagttcaagtcgagacatatactttgtcgaaggccaacaacctggtcctcaatgtagacggtgccataggctcacttttcttggatctacttgctggaagtggaatgttcaccaaacccgagatcgatgacattatcggtattggttatcttaatgggctctttgtattggctcgctcaatcggtctgatcgggcatacgttcgaccagaagaggttgaagcagccactataccgtcacccatgggaggatgttctttataccaagtgaatctgatgatgatgtcgtcaaaacgaggtaacaagacatggaagtgttttgctgtttttttattcttaatagtttgatgtgatttagaggtttagcttctggtttctttgttgtattgtttatgtacttttagttgttttttttttaagtgttggaagaatgaataatttttttcttctcgaaataaaataatgtt

SEQ ID NO: 2555 - DNA, 2327 bp, Pseudotsuga menziesii
taactctctctctctctctgttttgggggttagctgaaacttgtagccttatacatacagattttggtgtgaattaccttctcagctctgtgtggactgtcttttgtgggcgcggagctttctgttctgttcaacaagagtaactgtcagcagttcccttgcaaaagatggcgacagggcaaattttctctcgctcaactcaagcattattttacaattataagcaacttcctattcaacggatgctagactttgactttctctgcggtagagagataccatctgttgctggaatcatcaatcctggttccgaaggatttcaaaaactattctttgggcaggaagaaattgccatacctgttcattcagctattgacgctgcatgcaaggctcatccaacagctgatgtcttcatcaattttgcatcgtttagaagtgcatttgcttcctccatgactgctctcaagcagccaacaatcagagtagtagctataatagcagaaggtgtcccagaaggagatacaaaacagttgattgcttatgctcgagctaataataaggttataattgggcctgctactgtaggtggtattcaagcaggagcattcaaaattggtgatacagctggcacgattgacaacgttattcagtgcaagctgtacaggccaggatctgttggctttgtttctaaatcagggggaatgtcaaatgaactctacaatactattgcacgtgtaactgatggaatatatgaaggtattgcaattggtggggatgtgtttccgggttcaacattgtctgatcatgtcctacgttttaacaatattccacaggttaaaatgatggttgtgcttggagaacttggtggcacagatgagtattctctggttgaagccttaaagcaggggaaggtgcaaaagcctgttgttgcctgggttagcggcacttgtgcacgcctctttaagtctgaagtacaatttggccatgcgggtgctaaaagtggaggtgatcttgagtctgcacaaggaaagaatcaagcactaagagaagcaggtgcagttgttccaacatcttatgaaggatttgaaacagccatacaacagacatttcagaaacttgttgaggaagggaagatcagtcctacacctgatgtgaagcctcctgctatacctgaagatctgaatatagcaattaagagtggcaaagtcagggctcccactcatattatttccacaatttgtgatgacagaggagaggagccgacttatgctggtgtgccaatgtctaccattgtagaacaaggctttggtttgggtgatgtcatctcactgttatggttcaaacgcagtcttccacgatactgtactaagttcattgagatatgtatcatgctttgtgccgaccatggaccttgtgtatctggtgcacacaatacaattgtaacagcaagggcaggaaaggatttagtatcaagtcttgtttcaggtctccttaccattggtccacgatttggaggggctattgatgatgctgcaagatacttcaaggatgcatatgacaggggtttatcgccttatgagtttgtggaaggaatgaagaagaaaggtatccgcgtggcagggattggtcacaggatcaagaggggagacaaccgtgacaagagagttgaacttctgcaggaatatgcacgcacacactttcctgctgtaaagtatatggactatgccgtgcaagtggagacctacactctttccaaagcaaacaatttggttctcaatgttgatggtgcaataggatcccttttcctggacctccttgttgtcagtggaatgtttagccagcaagagattgatgagatcgtggagattggttatctaaatggcctctttgtacttgctcgatccattggtttgattgggcacacatttgaccagaagcggctgaaacagcccttgtaccggcacccatgggaagatgttctgtataccaagtagtgtagtagcatgaaaatgtgtgcttgtttggaagacatgtttctggaggtgttttgagtagtgaaactaagatgtttcacaacgctaacagaagagtgaattctagatattaagggtgcagttggcaagtgtcgagccccggttgagtgaagattgtctaaaactatttattgctgaataattatatttgaattccatttattctctaggagctttactatagaatcccctataaattcttcatgaatcaatagtctttttgactcaattcaagagatcttcatcgagtcactggaaattttgcggtctctgaaattttatttgaaagtttgg

SEQ ID NO: 2556 - DNA, 2224 bp, Triphysaria pusilla
tttctcctgcaacacgaagatcgactgtagaaaatcatctgcaagacaacgccatggcgacgggtcaactgttctcgaaaaccactcaagcactgttttacaattacaagcaactgccaattcaacggatgcttgattttgatttcctttgtggcagagaaacaccttctgttgctggaattataaatcccggctcggagggattccagaaactattttttggccaggaggaaatagctattcccgtccatcctgctgttgaagcggcttgtgctgcgcatcctacagctgatgttttcattaacttcgcatcatttagaagtgctgctgcttcatctatgtccgctctcaagcagccaaccattaaagttgtggctattatagctgaaggtgtacctgaatcagacaccaagcagttgattgcgtatgcaaaagcaaacaacaaggttgtcattggcccagctactgttggaggtattcaagctggagcatttaagattggtgacaccgctggaacaattgataatataattcaatgcaagttatacaggcctgggtctgttgggtttgtctccaaatctggtggtatgtctaatgaactctacagttcaattgctcgtgtcaccgatggaatttatgaaggcattgcaattggtggagatgtgtttcctgggtcaacactttctgatcatgtcctgcggtttagcaatatccctcagatcaagatggtggttgttcttggagaacttggtgggcgtgatgaatattccctcgtcgaggccctaaaagagggcaaaatcaacaagcctgtggttgcctgggtcagtggaacctgtgccacactcttcaaatcggaagtgcaatttggtcacgcgggggccaagagtggtggggagatggagtctgctcaggccaagaatcaagcacttagggatgctggagctgttgttcccacatcttatgaagcttttgaaggagcaatcaaagaaacatttgcgaaacttgtcgaggcaggtaaaattcctgctgtgaaggaggtgaaaccacctcaaataccggaagatcttaaaacagctatcaagagtggaaaagttcgggctccaacacacattatttccacgatctctgacgatagaggtgaagagccaacttatgctggcgtcccaatgtcctccattgttgaacaaggcttaggtgttggtgatgtcatttcattattgtggtttaaacgaagccttcctcattattgcacacgctttattgagatttgcatcatgttgtgtgctgatcatggtccctgtgtctctggtgcccacaactccattgtaactgctagagctggaaaagacctggtttcttgtcttgtttcaggtttgttgacaattggtcctcgtttcggtggtgccatcgatgatgctgctcgatacttcaaagatgcttatgacaggagtcttactccttatgaatttgtggagagcatgaaaaagaggggcattcgtgttcccggtattgggcacagaatcaagagtgctgacaacagagataagagggtcgaactactacagctttttgcacgtaccaattttccatctgtgaagtacatggaatacgccgttgaagtcgagacatacacactctcaaaagcaaacaaccttgtactcaatgtcgatggtgccattggctccttattcttggatcttttatccggtagtggcatgttcactaagcaagaaattgatgagatcgtcgggattggatatctcaacggtctctttgtgctagctcgttctattggtctcatcgggcacacgttcgaccagaagagattgaagcaaccactataccgccacccatgggaggacgttctctacaccaagtaaaacttttgcagagatagaaaccggtcacattccgactccacttataatacccattcctcgagtcttttgttgtcaatttgctatgtcatttttcagttaataatatggtatttgttgtactgctgaaaagctgattaagtacttttgtaagatttaattaaccacagttgttgccaagagggctcttcgatgttttcatagtgccaatcagaatttacttgcctacgtgatgagtttattactagtcttctgaacaactcttcagaattcttctctttttcgtctcgttatagaatttttattcttccaagttgtgattgtctatcaatgtcacattcccttga

SEQ ID NO: 2557 - DNA, 2243 bp, Triphysaria pusilla
  misc_feature (32)..(32): n is a, c, g, or t
  misc_feature (206)..(206): n is a, c, g, or t
  misc_feature (317)..(317): n is a, c, g, or t
  misc_feature (323)..(323): n is a, c, g, or t
  misc_feature (440)..(440): n is a, c, g, or t
  misc_feature (587)..(587): n is a, c, g, or t
  misc_feature (2131)..(2131): n is a, c, g, or t
  misc_feature (2133)..(2133): n is a, c, g, or t
acatttctcctgcaacacgaagatcgactgtngaaaatcatctgcaaggaggttttacagacaacgccatggcgacgggtcaactgttctcgaaaaccactcaagcgctattttacaattacaagcaactgccaattcaacggatgcttgattttgatttcctttgtggcagagaaacaccttctgttgctggaattataaatccnggctcggagggattccagaaactattttttggccaggaggaaatagctattcccgtccatcctgctgttgaagcggcttgtgctgcgcatcctacagctgatgttttcatnaacttngcatcatttagaagtgctgctgcttcatctatgtccgctctcaagcagccaaccattaaagttgtggctattatagctgaaggtgtacctgaatcagacaccaagcagttgattgcntatgcaaaagcaaacaacaaggttgtcattggcccagctactgttggaggtattcaagctggagcatttaagattggtgacaccgctggaacaattgataatataattcaatgcaagttatacaggcctgggtctgttgggtttgtntccaaatctggtggtatgtctaatgaactctacagttcaattgctcgtgtcaccgatggaatttatgaaggcattgcaattggtggagatgtgtttcctgggtcaacactttctgatcatgtcctgcggtttagcaatatccctcagatcaagatggtggttgttcttggagaacttggtgggcgtgatgaatattccctcgtcgaggccctaaaagagggcaaaatcaacaagcctgtggttgcctgggtcagtggaacctgtgccacactcttcaaatcggaagtgcaatttggtcacgcgggggccaagagtggtggggagatggagtctgctcaggccaagaatcaagcacttagggatgctggagctgttgttcccacatcttatgaagcttttgaaggagcaatcaaagaaacatttgcgaaacttgtcgaggcaggtaaaattcctgctgtgaaggaggtgaaaccacctcaaataccggaagatcttaaaacagctatcaagagtggaaaagttcgggctccaacacacattatttccacgatctctgacgatagaggtgaagagccaacttatgctggcgtcccaatgtcctccattgttgaacaaggcttaggtgttggtgatgtcatttcattattgtggtttaaacgaagccttcctcattattgcacacgctttattgagatttgcatcatgttgtgtgctgatcatggtccctgtgtctctggtgcccacaactccattgtaactgctagagctggaaaagacctggtttcttgtcttgtttcaggtttgttgacaattggtcctcgtttcggtggtgccatcgatgatgctgctcgatacttcaaagatgcttatgacaggagtcttactccttatgaatttgtggagagcatgaaaaagaggggcattcgtgttcccggtattgggcacagaatcaagagtgctgacaacagagataagagggtcgaactactacagctttttgcacgtaccaattttccatctgtgaagtacatggaatacgccgttgaagtcgagacatacacactctcaaaagcaaacaaccttgtactcaatgtcgatggtgccattggctccttattcttggatcttttatccggtagtggcatgttcactaagcaagaaattgatgagatcgtcgggattggatatctcaacggtctctttgtgctagctcgttctattggtctcatcgggcacacgttcgaccagaagagattgaagcaaccactataccgccacccatgggaggacgttctctacaccaagtaaaacttttgcagagatagaaaccggtcacattccaactccacttataatacccattcctcgagtcttttgttgtcaatttgctatgtcattttcagttaataatatggtatttgttgtactgctgaaaagctgattaagtacttttgtaagatttaattaaccacagttgttgccaagagggctcttcgatgttttcatagtgccaatcagaatttacttgcctacgtgatgagttnantactagtcttctgaacaactcttcagaattcttctctttttcgtctcgttatagaatttttattcttccaagttgtgattgtctatcaatgtcacattcccttgattcca

SEQ ID NO: 2558 - DNA, 2220 bp, Prunus persica
ctcgttggtagcaaccttcgtctcagtgcctcaactcaacccctctctctcttcccttctcttctctatatatctctctctctatttaaacacttcctctatcctccctaaattccagcatttgcatttcccccaaatcccaaattccactctcacagcctcacagaaaccggaggttgccttgacctgaaaccatggccactggacaacttttctcgcgcaccacacaggcgttgttctacaactacaagcagctcccaatccagcgcatgctggattttgacttcctttgtgggagggaaacaccgtccgttgctggaatcattaaccccggtgctgagggatttcagaaactctttttcggtcaagaggagatcgccataccagtgcactcaaccattgaagcatcttgtgcagcacatcctaccgccgatgtcttcatcaactttgcttcctttagaagtgctgccgcttcctccatggctgctctgaagcaaccaacaattagagttgttgcaatcattgctgaaggtgtacctgagtcagacgctaagcaattgatcgcatatgcacgagcaaacaacaaggttgttattggcccagctactgttggaggaattcaagctggtgcttttaagattggtgacactgctggaacaattgataacataattcactgcaagctgtacaggcctggatctgttggttttgtctccaatctggtgggatgtctaatgaatatacatactgtggctcgtgtacagatggactttttgaaggtattgctattggaggagatgtgttcccaggttctactctttctgaccatgttctgcggtttaacaatatcccccaggttaaacttattgttgtacttggggaacttggtgggagagatgagtattctctagttgaagctttgaaacaggggaaagtttccaaaccagttgttgcttgggttagtggaacttgcgcaaggcttttcaaatccgaagtacaatttggtcatgctggcgcaaaaagtggtggtgagttggagtctgcacaagcaaagaatcaagccttgagggatgctggagctgttgttcccacttcatatgaagctttagaaactgctataaaggaaacctttgaaaaactggttgaacaagggaagattacaccagtgaaggaatttaagcctccacaaatacctgaagatcttaactctgcaattaagagtggaaaagttcgggctccaactcatattatatccacaatctctgatgatagaggtgaggaaccatgctatgctggtgtacctatgtcctccattgttgagcagggttacggtgtgggtgatgttatctctcttttgtggttcaagcgcagccttccccgttattgtactcagtttattgagatatgcatcatgttatgtgctgaccatggtccttgcgtctctggagctcaaacacaatagtactgctagggctggcaaggaccttgtttccagccttgtctcaggtttgctcacaattggtccccgatttggtggtgccgttgatgatgctgcccgatacttcaaggatgcatatgacaggaatcttacaccttatgaatttgtcgagagtatgaaaaagaaaggcattcgtgtgccagggattgggcacaggatcaagagaggggacaacagagataagagagtagagctcctacaagcgttcgcgcgcacacatttcccttctgtcaagtatatggaatatgccgtacaagttgaaacctacaccctctcgaaggcaaacaacctggtccttaatgtcgatggtgctattggaaccctgttcttggatcttcttgcaggcagtggaatgttcagcaagcaagagattgatgagattgttgatattggctatctgaatgggctatttgtgctggcacgttctatcggtttgattgggcacacttttgaccagaagagattgaagcagcccctataccgccacccatgggaggatgttctttacaccaagtgaaaggctctcagatagcaggtgcaaagccgacttacctgcttttgacgagcattgttgtcttcaaggtccttgagtctgcagattcgcttggaatgattgttcagttgttagaatagtgtttgtattgctaatgctggagttgagtatcttcatttgtaagttgtatccaaagttcataaagggacaaccctcgatcagtttacta

SEQ ID NO: 2559 - DNA, 2751 bp, Pinus taeda
gtcccttgtggcggcttctctgacatttacataatgtaatggcgatttttattattatagaaaattaacatattttgaaatttcaggtcctcaggcaataagtcaagtcagagaaggcatgcgcaaggtctgaggtaggtcttcattggcgacccaccaacccgcaagccaaccagctgagcctctgttcgcctcctcctgctgcgtgatccaacgtgttcacctgccccgttcaattattttaggctataaataacatgcctaccaaagaatgttgatgcaagatagatgcatacctgtgcttcccgtttcacgtgatttaactgagctgagctaaccctctttcttctatatctgtattgggggttagctgaaaagcacgggcttataacttatacacacggcttttgttgtgaattaccttctcagctctgtctggagtgtcttttgggggtgcggagctattagttttgatcaacaagagtaactgtcagcagttcccttgcaaaagatgtcgacagggcaacttttctctcgctcaactcaagcattattttacaattacaagcaacttccgattcaacgcatgctagactttgactttctctgcggtagagagacaccatctgttgctggaatcgtcaatcctggttccgaaggatttcagaaactgttctttgggcaggaagaaattgccatacctgttcattcagctattgaggctgcatgcaaagctcatccaacagctgatgtcttcatcaattttgcatcgtatagaagtgcatttgcttcctccatgtctgctctcaagcagccaacaatcagagtagtagctataatagcagaaggggtcccggaaggagatactaaacagttgattgcttatgctcgagctaataataaggttataattgggcctgctactgtaggtggcattcaggctggagcattcagaattggtgatacagctggcacaattgacaacattattcagtgcaagctgtacaggccaggatctgttggctttgtttcgaaatcggggggaatgtcaaatgaactctacaatactattgcacgtgtaactgatgggatatatgaaggtattgctattggtggggatgtgtttcctggttcaacattgtctgatcatgttctgcgttttaacaatattccgcagattaaaatgatggttgtgcttggagaactcggtggtagagatgagtattctctagttgaagccttaaagcaggggaaggtgcaaaagccagttgttgcctgggttagcggcacttgtgcacgcctctttaaatccgaagtacaatttggccatgctggtgctaaaagtggaggtgaccttgagtctgcacaaggaaagaatcaagcactaagagaagcaggtgcagttgttccaacgtcttatgaaggatttgaaactgttatacagcagacatttcagaaacttgttgaggaaggaaagatcagtcctacacctgattttaagcctcctgctatacctgaagatctgaacacagcaattaagagtggcaaagtcagggctcctactcatattatttccacaatttgtgatgacagaggtgaggagccaagctatgctggtgtgccaatgtctacaattgtagaacaaggctttggtttgggtgatgtcatctcactgttatggttcaaacgcagtcttccacgatactgtactaagttcattgagatatgtatcatgctttgtgctgatcatggaccttgcgtatctggtgcacacaatacaattgtaacagcaagggcagggaaggatttagtgtcaagtcttgtttcaggcctccttacaattggtccacgatttggaggggctattgatgatgctgcaagatacttcaaagatgcacatgacaggggtttatcaccgtatgaatttgtggagggaatgaagaagaaaggcattcgcgttgcagggattggtcacaggatcaagagaggagacaaccgtgacaagagagtagagcttctgcaggaatatgcacgtacacactttcctgctgttaagtacatggactatgccgtgcaagtggagacctacacactttccaaagcaaacaatttggttctcaatgttgatggtgcaataggatcccttttcctggacctccttgctgtcagtggaatgtttagccagcaagagattgacgagattgtggagattggttatctaaatggcctctttgtacttgcacggtccattggtttgattgggcacacatttgaccagaagcggttgaaacagcccctgtatcggcacccatgggaagatgttctgtataccaagtagtttgttcgcataaaagcgtgtgcttgtttgcaaaacatgtttctggaggtcttttatgtagtgaaaaattcatgtttctggaggtgctttatgtagtgaaactaagatgtttcacaacactaacaggagtgaattctagatataaagggtgcagttaaccagtgtcgaggcccggttgagtgaacattgtctaaagctatttattgctgaataattatatttgcattacattattctctaggagcattaccatagaattccctatgtattattcgagaaacagtaatctttttgactcaatttaagagatttggtttcatggagtcactggaaattttgcagttttttgaaattttcattgaatgtttggagtgatggagaataaaatatttttttaataccatttaagacct

SEQ ID NO: 2560 - DNA, 2139 bp, Zostera marina
cgtaataacctcaacactgacaagatcccgcgccatcgcagatctctcctgcgatcccaagttgactttattttgttttagaaaagatggcgacaggacaaattttttctagaaatacccaggcattattttataattacaagcagcttcccattcaaaggatgcttgatttcgacttcttatgtggtagggagataccttctgttgcgggaataattaacccgggttcagagggatttcagaaactattttttggtcaggaggagatagcaattccagttcattcaactgtggaagctgcttgcagtgcacattcgactgctgatgttttcatcaacttcgcttcatttagaagcgcagctgcctcttcaatggctgccttgaaacaaccaaccatcaaggttgtagcaataatagcagagggtgttccagaactggacaccaaaagactgattgcatatgcacaagctaataataaggttataattggtcctgcaactgttggaggaatccaagcgggagcctttaagattggagacactgctgggactcttgataacataattcagtgcaagctctataggccaggctctgttggatttgtttcaaaatcgggtgggatgtctaatgagctttataacacaattgcacgtgccacagatgggatatatgaaggcattgccattggtggagatgtatttccaggttctactctttcagatcacgtacttcgttataataatatcccacaggtcaaaatgattgttgttcttggagaacttggtggcaaagatgagtactccttgattgaagcattgaaagagggaaaaattcaaaaaccagtcgtcgcttgggttagtggtacatgtgctcggctcttcaagtcagaagtacaatttggtcatgctggagctaaaagtggtggtgaattggaatcagcacaagcaaaaaatcaagcattaaaagaagcaggagccattgttcccacttcatatgaaacttttgaaggtgctattaaagagacatttgagaaattggttgacgagggtaagattgttcccattcatgaagttacaccacctcccattcctgaggatctaagcactgctattaaaagtgggaaagttcgagctcctactcatattatctcaacaatatctgatgacagaggagaggaacctacttatgctggtgtcccgatgtcaacaattattgagcaaggatttggtgtaggtgacgttatatcacttctgtggttcaagcgtagccttcctcgttattgcacaaaatttatcgaaatctgcatcatgctctgtgctgatcatggcccatgtgtctctggtgcccacaacactattgtcacagcaagagctggaaaagacttagtatctagtcttgtatcaggcttactcacgattggtcctcgatttggtggtgcaattgatgatgctgctcgatactttaaggatgcagttgatcgggctatcacaccttatgaatttgtggaaggtatgaaaaagaagggcattagggtaccgggaatcggacataggattaagagagcagacaacagggacaagagagttgagttgttgcaagaatatgcacgtacacatttcccttctgtgaagcatatggaatatgctgttcaagttgagacgtataccttgtcaaaggcaaataacttggttctgaatgttgatggtgcaattgggtcacttttcttggatctgcttgctagcagtggtatgtttaacaagcaagaaatcgatgaaattgttgagattggatatcttaatggattgtttgtattggcgcggtcgattggtcttattgggcatacatttgatcagaaaagaatgaagcagcctctgtaccgccacccttgggaagatgttctctataccaagtaattaaactatttattgaaaccaataacgttatattttcccttctgcattattgctacagacaattttagctttgcccactataagttaaaatagcacattctagaaagcaaattctgggtagattttggcaagtatcgacctttgcttttgttttgatttcactggatgcctttaatatttattcgtaattttattcaatttacttggttcaaataaaagtataaaa

SEQ ID NO: 2561 - DNA, 2517 bp, Pinus taeda
  misc_feature (178)..(178): n is a, c, g, or t
  misc_feature (429)..(429): n is a, c, g, or t
  misc_feature (793)..(793): n is a, c, g, or t
  misc_feature (884)..(884): n is a, c, g, or t
  misc_feature (992)..(992): n is a, c, g, or t
  misc_feature (1046)..(1046): n is a, c, g, or t
  misc_feature (1148)..(1148): n is a, c, g, or t
  misc_feature (1274)..(1274): n is a, c, g, or t
  misc_feature (2446)..(2446): n is a, c, g, or t
ccgcaagccaaccagctgagcctctgttcgcctcctcctgctgcgtgatccaacgtgttcacctgccccgttcaattattttaggctataaataacatgcctaccaaagaatgttgatgcaagatagatgcatacctgtgcttcccgtttcacgtgatttaactgagctgagctaacnctctttcttctatatctgtattgggggttagctgaaaagcacgggcttataacttatacacacggcttttgttgtgaattaccttctcagctctgtctggagtgtcttttgggggtgcggagctattagttttgatcaacaagagtaactgtcagcagttcccttgcaaaagatgtcgacagggcaacttttctctcgctcaactcaagcattattttacaattacaagcaacttccgattcaacgcatgntagactttgactttctctgcggtagagagacaccatctgttgctggaatcgtcaatcctggttccgaaggatttcagaaactgttctttgggcaggaagaaattgccatacctgttcattcagctattgaggctgcatgcaaagctcatccaacagctgatgtcttcatcaattttgcatcgtatagaagtgcatttgcttcctccatgtctgctctcaagcagccaacaatcagagtagtagctataatagcagaaggggtcccggaaggagatactaaacagttgattgcttatgctcgagctaataataaggttataattgggcctgctactgtaggtggcattcaggctggagcattcanaattggtgatacagctggcacaattgacaacattattcagtgcaagctgtacaggccaggatctgttggctttgtttcgaaatcggggggnatgtcaaatgaactctacaatactattgcacgtgtaactgatgggatatatgaaggtattgctattggtggggatgtgtttcctggttcaacattgtctgatcatgtnctgcgttttaacaatattccacagattaaaatgatggttgtgcttggagaactnggtggtagagatgagtattctctagttgaagccttaaagcaggggaaggtgcaaaagccagttgttgcctgggttagcggcacttgtgcacgcctctttaantccgaagtacaatttggccatgctggtgctaaaagtggaggtgaccttgagtctgcacaaggaaagaatcaagcactaagagaagcaggtgcagttgttccaacgtcttatgaaggatttgaaacngttatacagcagacatttcagaaacttgttgaggaaggaaagatcagtcctacacctgattttaagcctcctgctatacctgaagatctgaacacagcaattaagagtggcaaagtcagggctcctactcatattatttccacaatttgtgatgacagaggtgaggagccaagctatgctggtgtgccaatgtctacaattgtagaacaaggctttggtttgggtgatgtcatctcactgttatggttcaaacgcagtcttccacgatactgtactaagttcattgagatatgtatcatgctttgtgctgatcatggaccttgcgtatctggtgcacacaatacaattgtaacagcaagggcagggaaggatttagtgtcaagtcttgtttcaggcctccttacaattggtccacgatttggaggggctattgatgatgctgcaagatacttcaaagatgcacatgacaggggtttatcaccgtatgaatttgtggagggaatgaagaagaaaggcattcgcgttgcagggattggtcacaggatcaagagaggagacaaccgtgacaagagagtagagcttctgcaggaatatgcacgtacacactttcctgctgttaagtacatggactatgccgtgcaagtggagacctacacactttccaaagcaaacaatttggttctcaatgttgatggtgcaataggatcccttttcctggacctccttgctgtcagtggaatgtttagccagcaagagattgacgagattgtggagattggttatctaaatggcctctttgtacttgcacggtccattggtttgattgggcacacatttgaccagaagcggttgaaacagcccctgtatcggcacccatgggaagatgttctgtataccaagtagtttgttcgcataaaagcgtgtgcttgtttgcaaaacatgtttctggaggtcttttatgtagtgaaaaattcatgtttctggaggtgctttatgtagtgaaactaagatgtttcacaacactaacaggagtgaattctagatataaagggtgcagttaaccagtgttgaggcccggttgagtgaacattgtctaaagctatttattgctgaataattatatttgcattacattattctctaggagcattaccatagaattccctatgtantattcgagaaacagtaatctttttgactcaatttaagagatttggtttcatggagtcactggaaattttgc

SEQ ID NO: 2562 - DNA, 2118 bp, Helianthus annuus
gcggggatccattgctcgtctctaaacccatcacacatttgacatttttcaacaaattcttacattccaaggttttttgagcgagcaccatggcgacagggcaacttttttcccgtacaacacaagcgttgttctataactataagcaactaccgattcagaggatgcttgattttgacttcctttgcgggagggaaacaccttcagttgctgggatcattaacccgggtgccgagggatttcagaaactattttttgggcaagaagagattgccattcccgttcattctactattgaagcagcttgtgcagcacatcctactgccgatgtttttataaattttgcatcatacagaagtgctgctgcttcgtccaatcttgctcttaaacaacccacaatccgagtagtggctattattgctgagggtgttcctgaagctgacaccaaggaattgatcgcatatgcaagagcaaacaacaaggttgtcattggccctgcgactgtcggtggtatccaagccggagctttcaaaatcggcgacactgccggaacaatcgataacatcatacaatgcaaactttacaggcctggatccgttggatttgtctccaaatctggtggcatgtcaaatgagttgtacaatacaattgcccgtgtgacggatggaatttatgaaggtattgctattggaggagacgtttttcccggttctactctttctgatcatgttttgcggttcaacaacattcctcaggtgaaaatgattgttgtgcttggtgaactcggtggtcgagatgagtactccttagttgaagcccttaaagccggaaaaattaataaacccgtatgcgcttgggtcagtggaacttgtgcccgcctcttcaagtccgaagtccaattcgggcacgcgggggccaagagtggaggtgaaatggagtctgcacaagctaaaaaccaagcacttggggacgctggggccattgtcccgacatcatatgaagcatttgaaacttcaatcaaggaaacgttccagaagttggctgaggagggcaagattagcccgattaaggagttcacgcctccacaaatccctgaggatcttaacagcgcgattaagagtgggaaagtgcgagcaccaactcatattatttcaactatttctgatgacagaggggaagagccgtgctatgctggtgtaccgatgtctaccattattgaaaaaggaatgggtgtcggtgatgttatttcacttttatggtttaaacgcagtctccctcgatactgcacacaattcatcgagatttgcatcatgttatgtgctgatcacgggccatgtgtatccggtgctcacaacacaatcgtgaccgcaagggcaggaaaagatctcgtctcgagccttgtttctggtttgctaacgattggtccgcgtttcggtggtgccattgatgatgctgctcggtacttcaaagacgcttacgataggaaactttcaccatatgagttcgttgaaagtatgaaaaagaagggtattcgtgtgcccggaataggtcacaggataaaaagaggggataacaaagataagagagtggagctattacaactatttgcgcgcacaaatttcccatcaacaaaatacatggaatacgcggttgaagtagaaacttacactctctcaaaggcaaacaacttagtgatgaatgttgatggtgccattggttcccttttcttggatcttcttgccggtagcgggatgttcaccaaacaagaaattgatgagattatttccatcggttaccttaacgggctctttgttttggcccgttccatcggtctaatcgggcatacattcgaccagaagagactgaagcaaccgctataccgtcacccatgggaagatgttctttacaccaagtaaagcaagcaatccaccattgttggcatctgcagatgactgtttgtgttttgtctgtttgtaacatttagcttattaaggtgtttttatattcatatattgtttgtctcctgaaaccaagcttattatgtagttctttttgttttatgttgaataaagacttcgttttagtagaaaaaagagccacaaaaaagaaaaaagaaaa

SEQ ID NO: 2563 - DNA, 2197 bp, Helianthus annuus
attgctcgtctcataaacccatcacacatttgacatttttcaacaaattcttacattccaaggttttttgagcgagcaccatggcgacagggcaacttttttcccgtacgacacaagcgttgttctataactataagcaactaccgattcagaggatgcttgattttgacttcctttgcgggagggaaacaccttcagttgctgggatcattaacccgggtgccgagggatttcagaaactattttttgggcaagaagagattgccattcccgttcattctactattgaagcagcttgtgcagcacatcctactgccgatgtttttataaattttgcatcatacagaagtgctgctgcttcgtccaatcttgctcttaaacaacccacaatccgagtagtggctattattgctgagggtgttcctgaagctgacaccaaggaattgatcgcatatgcaagagcaaacaacaaggttgtcattggccctgcgactgtcggcggtatccaagccggagctttcaaaatcggcgacactgccggaacaatcgataacatcatacaatgcaaactttacaggcctggatccgttggatttgtctccaaatctggtggcatgtcaaatgagttgtacaatacaattgcccgtgtgacggatggaatttatgaaggtattgctattggaggagacgtttttcccggttctactctttctgatcatgttttgcggttcaacaacattcctcaggtgaaaatgattgttgtgcttggtgaactcggtggtcgagatgagtactccttagttgaagcccttaaagccggaaaaattaataaacccgtatgcgctagggtcagtggaacttgtgcccgcctcttcaagtccgaagtccaattcgggcacgcgggggccaagagtggaggtgaaatggagtctgcacaagctaaaaaccaagcacttggggacgctggggccattgtcccgacatcatatgaagcatttgaaacttcaatcaaggaaacgttccagaagttggctgaggagggcaagattagcccgattaaggagttcacgcctccacaaatccccgaggatcttaacagtgcgattaagagtgggaaagtgcgagcaccaactcatattatttcaactatttctgatgacagaggggaagagccgtgctatgctggtgtaccgatgtctaccattattgaaaaaggaatgggtgtcggtgatgttatttcacttttatggtttaaacgcagtctccctcgatactgcacacaattcatcgagatttgcatcatgttatgtgctgatcacgggccatgtgtatccggtgctcacaacacaatcgtgacagcaagggcaggaaaagatctcgtctcgagccttgtttctggtttgctaacgattggtccacgtttcggtggtgccattgatgatgctgctcggtacttcaaagacgcttacgataggaaactttcaccatatgagttcgttgaaagtatgaaaaagaagggtattcgtgtgcccggaataggtcacaggataaaaagaggggataacaaagataagagagtggagttattacaactatttgcgcgcacaaatttcccatcaacaaaatacatggaatacgcggttgaagtcgaaacttacactctctcaaaggcaaacaacttagtgatgaatgttgatggtgccattggttcccttttcttggatcttcttgccggtagcgggatgttcaccaaacaagaaattgatgagattatttccatcggttaccttaacgggctctttgttttggcccgttccatcggtctaatcgggcatacattcgaccagaagagactgaagcaaccgctataccgtcacccatgggaagatgttctttacaccaagtaaagcaatcaatccaccattgttggcatctgcagatgagtgtttgtgttttgtctgtttgtaacatttagcttattaaggtgtttttatattcatatattgtttgttctcctgaaaccaagcttattatgtagttctttttgttttatgttgaataaagacttcgttttagtagaaatgtctagtttgagatgatggtatatgaaagatataagcttgaactcgaaaaaaaaaacaaaaagaactacataatacgcttggtttccggagaacaaacactctatgaatatcac

SEQ ID NO: 2564 - DNA, 2265 bp, Malus domestica
ccccaaatcccgaattccactctcacaatcagtgatcagaagccggaagctgccttgacccgaaaaccatggccaccggacaacttttttcgcgcaccactcaggcgctgttctataactccaaacagctcccaatccagcgcatgctcgattttgacttcctttgcgggagggaaacaccttcggttgctggaatcatcaaccccggttctgagggatttcagaagctctttttcggtcaggaggaaattgccataccagtgcactcaaacattgaagcatcttgcgctgctcatcctactgccgatgtcttcattaactttgcttcatacagaagtgctgccgcttcttccatggctgctctgaagcaaccaaccattagagttgtggcaatcattgctgaaggtgttcctgagtcggacactaagcagttgatagcatatgcacgggcaaacaacaaggttgtcattggcccagctaccgttggaggaattcaagctggagcttttaagatcggtgacactgctggaaccattgataacattattcactgcaagctatacaggcccggatctgttggttttgtctccaaatctggtggcatgtctaatgagttatacaatactgtagctcgtgtaacagatggactttatgaaggtattgctattggaggtgatgtgttcccaggttctactctttctgaccatgttctgcggtttaacaatatcccccaggttaaacttattgttgttcttggagaacttggtgggagagacgagtattctttagttgaagctttgaaacagggaaaagttaccaaaccagtggttgcttgggttagtggaacttgtgcaaggcttttcaagtccgaagtacaatttggtcatgctggcgcaaaaagtggtggtgagatggaatctgcacaagcaaagaatcaagccttgagggatgctggtgctgttgttcccagttcatatgaagctctggaaactgctatcaaggaaacatttgaaaacctggttgagcaagggaagattgcaccagtcaaggaattcaagcctccacaaatccctgaagatcttaactctgcaattaagagcggaaaagttcgtgctccaactcatattatatccacgatctctgatgacagaggtgaggaaccatgctatggtggtgtacctatgtcttccattgttgagcagggttatggtgtgggtgatgttatctctcttttatggttcaagcgcagccttcccagttactgtactaaatttattgagatttgcatcatgttatgtgccgaccatggtccttgcgtctctggtgctcacaacacaatagtaactgctagggctggcaaggatcttgtttccagccttgttgcaggtttgctcacaattggaccacgatttggtggtgccgttgatgacgctgctcgttacttcaaggatgcctatgacaggaaccttacaccttatgaattcgtcgaaagtatgaagaagaagggcattcgtgtgccagggattgggcacaggatcaagagaggggacaacagagataagagagtagagcttctacaagcgtttgcacgcactaatttcccttctgtcaagtacatggaatatgccgtacaagttgaaacctacacactctcgaaggctaacaatctggtcctcaacgttgatggcgcaattggaaccttgttcctggatcttcttgctggcagtggaatgttcaccaagccagagattgacgagatcgttgagattggatatctgaatgggctcttcgtgctggcacgttctattggtttgattgggcacacattcgaccaaaagaggttgaagcagcccctataccgccacccatgggaggacgttctatacaccaagtgagaaaatatcggatagcaggtgcaaaacccggcctacctgcttgcggacgagcattgttgtttgcaaggttctcaagtctatgatttcgccggggatgattattgttcatttgttaaaatagtgttttgtttcggtaatgctggagctggtaagtctgtatcgaaagttcataaaaagagagaaccctcgatcattttaccaagcagaagttatgttttcgcttaaatttcttggattcactttctggttttaggagagaagtagattgtagggcagctgggaattggatgtaccatggtccatgaatatgcgcaattgttctctcgagaaaaaaaacgaataaatacaaatctgtccctataaaaaaaaa

SEQ ID NO: 2565 - DNA, 2088 bp, Centaurea maculosa
  misc_feature (765)..(765): n is a, c, g, or t
  misc_feature (1105)..(1105): n is a, c, g, or t
  misc_feature (1345)..(1345): n is a, c, g, or t
  misc_feature (1387)..(1387): n is a, c, g, or t
  misc_feature (1393)..(1393): n is a, c, g, or t
  misc_feature (1432)..(1432): n is a, c, g, or t
  misc_feature (1480)..(1480): n is a, c, g, or t
  misc_feature (2017)..(2017): n is a, c, g, or t
tcggcggggacatttgacgtttttcacagattcttacatcatacatacatactcaggtatttttgagctagcccaatggcgacagggcaacttttttcccgtacgacacaagcattgttctataactataagcaattaccaattcagcggatgcttgattttgactttctttgtgggagggaaacaccttcagttgctggaatcattaaccctggtgctgagggatttcagaaactattttttggccaagaagagattgccatcccagtacattcgactgttgaagctgcttgtgctgcacatcctactgccgatgtatttataaatttcgcatcatacagaagtgctgctgcttcatctaatctggctctcaaacaacccacaatcagagttgtggctattatagctgagggcgttcctgaatccgacaccaaggaattgattgcgtacgcaagatcaaacaacaaggttgttatcggccctgcaactgttggtggtattcaagctggagcttttaaaattggtgacactgcaggaacaattgataacattattcaatctaaactttacaggccaggatctgttggattcgtctccaaatctggtggcatgtcaaatgagttatacaacacaattgcccgtgtaacagatggaatctatgaaggtattgctattggaggggatgtttttcccggttctactctttctgaccacgttttgcggttcaacaacattcctcaggtgaaaatgattgttgttctgggngaacttggtggtcgagatgagtactccttagttgaagcccttaaggccggaaaaatcagcaaccagtttgtgcttgggtcagtggaacttgtgcccgccttttcagtctgaagttcaatttgggcatgcgggggcaaagagtggtggtgaaatggagtctgcacaagctaaaaaccaagcacttcaggatgctggggccattgtcccaacatcatacgaagcattcgaagtttcgatcaaggaaacattcgagaagttggccgaggagggcaagattagtcccattaaggagatcaaacctccacaaatccccgaagatcttaacaccgcaatcaagagnggcaaagtacgagcaccgactcacattatttcaaccatctccgatgaccgaggtgaagagccatgctacgctggcgtaccaatgtctacgatcatcgaaaaaggactggggatcggtgacgttatttcgcttttatggttcaaacgcagtcttccccgctactgcactcagttcattgagatctgcgtcatgttatgtgctgatcacgggccgtgtgtttccggtgctcacaacacgatngtaactgcaagggcaggaaaagatctcgtatccagccttgtntccggnttgctgaccatcggtcctcgtttcggtggtgccgttgangatgctgctcgctacttcaaggacgcttacgataggaaactttcaccntatgagttcgttgaaagtatgaaaaagaagggtattcgtgttccgggtattggtcacaggattaagagaggtgataaccgagacaagagagtcgagctgctacaactatttgctcgcacgaatttcccatcaaccaaatacatggaatacgcagttgaagtagaaacctacactctctcaaaggcaaacaacttagtgatgaacgttgacggtgccatcggtacccttttcttggatcttcttgcgggtagcggaatgttcacgaaacaagaaatcgatgagatcgtcgcgattggttaccttaacgggctcttcgtgttggcccgttccattggtctcatcgggcatacgttcgaccaaaagagattgaagcagccgctataccgtcacccgtgggaagacgtgctttacaccaagtgattcgtgttgtttctgttgtttgtttgtatcattttaggttttggttcgattggagtcgagtcttgtttcggaactttagaaaagaaataacttggatggtgtcattggtagtgtccnctctgtactacttttttgtagtttatgtgtatgatacattgtacatgatcagcatagtatgattttgtagc

SEQ ID NO: 2566 - DNA, 2136 bp, Artemisia annua
acacaacccaaccaatttttatctaacactcacccaacaaaattctcacatacccaggtaactttgggtgagcactatggcgaccggacaaatattctcccgtacgacacaatcattgttctataactttaagcaattaccaatccagcggatgcttgattttgacttcctttgtgggagggaaacaccttcagttgctggaatcatcaaccctggtgccgaaggattccagaaactattttttggccaagaggagattgccataccagtacactcaaccattgaagctgcctgtgctgcacaccctactgctgatgtattcattaactttgcatcatttagaagtgcggctgcttcatcaaagcttgctctcaaacagcctaccatcagagttgtggctattatagccgagggtgttcctgaatctgacaccaaggagttgatttcctatgcaaggtcaaacaacaaggttgttattggaccagcaacggttggtggggttcaagctggagccttcaagattggtgacactgctggaacaatcgataatattatacaatgcaaattgtacaggcctggatctgtcggttttgtatccaaatctggtgggatgtctaatgaaatgtacaacactatcgcgcgggtgacagatggaatctatgaaggcattgctattggaggagatgtttttcccggttctactctttctgatcatgttttgcggttcaacaacattccacagatcaaaatgatcgttgtgcttggagaacttggtggtcgagatgagtattccttagttgaagcacttaaatcaggaaaaatcaataaaccagtatgtgcttgggtcagtggaacatgtgcgcgcctctttaaatctgaagttcaatttggtcatgcgggtgccaaaagtggtggtgaaatggagtccgcacaagctaaaaatcaggcacttaaagaagcaggggccattgtccccacgtcgtatgaagcgtttgaatcttcaattaaggaaacatttgcaaagctgtgtgaggatggcaagattacacctgttaaggagatcactcctccacaaatccctgaggatctaaactcagcaattaagagcgggaaagtacgagcacctactcatattatttcaaccatctctgatgacagaggtgaagagccatgctatgcaggggtaccgatgtccacaattgtagaaacgggaatgggcgttggtgatgttatttctcttttgtggttcaaacgtaatcttcctcgctactgcacacaatttatcgagatttgtgttatgttgtgtgctgatcacggtccatgtgtgtctggtgctcacaacacaatagtaactgcacgagctggaaaagatctcgtatcaagtcttgtttcaggtttgctaacaattggtcctcgttttggtggtgctgttgatgacgctgctcgatacttcaaggatgcttatgacagaaaactttcaccgtatgagtttgttgaaagcatgaaaaagcagggtatccgtgtgccaggaattgggcacaggattaagagaggtgacaacagagataagagagtcgagctgctacaactattcgcgcgcacacatttcccatcaacaaagtacatggaatatgctgtggaagtcgagacttacactctctcaaaagcaaacaacttagtgctgaacgttgatggtgccattggtacccttttcttggatcttcttgcgggtagtggaatgttcaccaagcaagaaatagatgaaattgttgccattggttaccttaatgggctcttcgtcttggctcgttccattggtctcatcgggcatacatttgaccaaaagaggttgaagcagcccctatacaggcacccatgggaagatgttctttacaccaagtaattcgtgtttgtgaacatttccaaagtacacacatcgttcttaaaaaccgatcttttagagtcttaagagtgttttctttttagagttttcttattcatgtgtgcaatctgttgtaatgaccttacgaccattaaactggtctttgcctggtttgtttgtatttgtcaccacaggttcatcggatattctccatttatattcataaagaagagtttatgtatcgagtttacacc

SEQ ID NO: 2567 - DNA, 2352 bp, Picea glauca
taatatatatgcatatctgtgcttcccatttcacgtgatttaactgagctgagctaaccctctttctctctatctctgtattgggggttagctgaaaagtctgggcttataacttatacatacagcttttggtgtgaattaccctctcagctctgtgtgaagtgtcttctgtgggtgtggagctatctgctccgttcaacaagagtaactgtcagcagttcccttgcaaaagatggcgacagggcaacttttctctcgctcaactcaagcattattttacaattacaagcaacttcctattcagcgcatgctagactttgactttctctgcggtagagagataccgtctgttgctggaatcatcaatcctggttctgaaggatttcagaaactgttctttgggcaggaagaaattgccatacctgttcattcagctattgaggctgcatgcaaagctcatccaacagctgatgtcttcatcaattttgcatcgtatagaagtgcatttgcttcctccatgtctgctctcaagcagccaactatcagagtagtagctataatagcagaaggtgtcccggaaggagatactaaacagttgattgcttatgctcgagctaataataaggttataattgggcctgccactgtaggtggcattcaggccggagcattcaaaattggtgatacagctggcacgattgacaacattattcagtgcaagctgtacaggccaggatctgttggctttgtttctaaatctggggggatgtcaaatgaactctacaatactgttgcacgtgtaaccgatgggatatatgaaggtattgcaattggtggggatgtgtttcctggttcaacattgtctgatcatgtcctgcgttttaacaatattccacaggttaaaatgatggttgtgcttggggaactcggtggtagagatgagtattctctagttgaagccttaaaacaggggaaggtgcaaaagccagttgttgcttgggttagcggcacttgtgcacgcctctttaagtctgaagtacaatttggtcatgctggtgctaaaagtggaggtgagcttgagtctgcacaaggaaagaatcaagcactaagagaagcaggtgcagttgttccaacatcttatgaaggatttgaaacagccatacagcaaacatttcagaaacttgttgaggaagggaagatcggtgctacacctgatgttaagcctcctgctatacccgaagatctgaacatagcaattaagagtggcaaagtcagggctcctactcatattatttccacaatttgcgatgacagaggtgaggagccaagctatgctggcgtgccaatgtctaccattgtagaacaaggctttggtttgggtgatgtcatctcactgttatggttcaaacgcagtcttccacgatactgtactaagttcattgagatatgtatcatgctttgtgctgaccatggaccttgcgtatctggtgcacacaatacaattgtaacagcaagggcagggaaggatttagtgtcaagtcttgtttcaggcctccttaccattggtccacgatttggaggggctattgatgatgctgcaagatacttcaaggatgcacatgacaagggtttatcggcctatgagtttgtggagggaatgaagaagaaaggtattcgcgtggcagggattggtcacaggatcaagagaggagacaaccgtgacaagagagtagagcttctgcaggaatatgcacgtacacactttcctgctgtaaagtacatggactatgccgtgcaagtggagacctacaccctttccaaagcaaacaatttggttctcaatgttgatggtgcaataggatcccttttcctggacctccttgttgtcagtggaatgtttagccagccagagattgatgagattgtggagattggttatctaaatggcctctttgtacttgcacgatccattggtttgattgggcacacatttgaccagaagcggttgaaacagcccctgtaccggcacccatgggaagatgttctgtataccaagtagtgtattagcatgaaagtgtgtgcttgtttgcaaaacatgttgctggaggtgttttaagtagtgaaactaagatgtttcacaacactaacagaagagtgaattctagatgtaagggtgcagttgacaagtgtcgagccccggttgagtgaacattgtctaaaactatttattgctgaataattatatttgcattaatttattctccaggagcattactatagaatcccctatttattcttcgagaaacagtagtctttttgactcaatttaagagatttggtttcatggtgtca

SEQ ID NO: 2568 - DNA, 2366 bp, Populus trichocarpa
gtaataatccacttcattaacattcccctctccttttcttcaaatcgaggccagaacataaaaagaaacaggagttgcaaagtccaattctggccagtttgagttttgtacaatatggcgacaggacaactcttctctcgaacaacacaagctctgttttacaattataagcagctgcctattcaacgcatgcttgattttgattttctttgtgggagggaattaccgtctgtagctggaatcattaaccctggtgctgagggatttcagaaactctttttcggtcaagaggaaatagcaatccctgtgcattcgactattgaggcagcttgtgctgctcatccaactgctgatgtgtttatcaacttcgcatcattcagaagtgcggctgcttcatccatgtctgctctgaagcagccaaccgttcgagttgtggctattatagctgagggtgttcctgaggcagacgccaaacaattgattgcatatgctcgggctaacaataaggcaaggacaatgatgcaatgctatttgaattgcaatgaacgaaaagttgtcattggtccagctactgttggaggcattcaagctggagcattcaagataggcgatactgctggaacaatcgataacataattgcttgcaagctgtaccggcctggatctgttggatttgtctccaaatcaggtggtatgtctaatgaactatacaatagcattgcccgtgtaaccgatggaatttatgaaggtattgcaatcggaggggatgtgttcccaggatctactctttctgatcatgtcctgaggtttaacaacatcccacaggttaaaatgatagttgtacttggggaacttggtggaagagacgagtattctcttgttgaagccctaaaacagggaaaggtaagcaaaccagtggttgcttgggtcagtggaacttgcgcgcgactctttaagtcagaagtgcaatttggtcatgctggtgctaaaagtggtggtgagatggagtctgctcaagcaaaaaatcaagcactgaaagatgctggagctgttgttcccacttcatatgaagcttttgagactgcaattaaggaaacatttgagaaactggttgaagaggggaagatatcatctgttaaggagtttacgcctccacaaatcccagaagatcttaacattgcaatcaagagtggaaaagttcgggcaccaactcatattatttctaccatctctgatgacagaggtgaggaaccatgctatgctggcgtgccaatgtcttccattgttgaacagggttatggtgtgggtgatgtcatctctcttttatggttcaagcgcagccttccacgttactgtacccattttattgagatatgcatcatgttgtgtgctgaccatggtccctgtgtctctggtgctcacaacactatagtaactgcaagggcaggaaaggacctagtttccagccttgtctcaggtttgctcacaattggtccccgatttggtggtgccattgatgatgctgctcggtactttaaggatgcatatgacaggggtctaacaccctatgagtttgttgaaagcatgaaaaagaagggaatacgagttcctggtattgggcacaggatcaagagaggggacaacagggataaaagagtggagcttctacagctgttcgctcgcacacatttcccttctgtgaagtatatggagtatgctgttcaagttgaaacttacactctctcaaaggccaataacttggtccttaacgtcgatggcgcgattgggtcccttttcttggatctccttgcaggcagtggaatgtttactaaacaagagattgatgagattgttgggattggttatttgaatgggctctttgtgttggcgcgttccattggtttgattgggcacacctttgaccagaagagattgaaacagcctctataccgtcacccatgggaggatgttctctactccaagtgagagaataacaggtagcaggtgcagctctcacgtgctctacacaagccttttgtttttcaaatttcttgagtctctgctgaaatgtctgttcagttgttagattagtgttgagctgcggcgaggtcaagcgttccattgtgtttggaagttataagtagccttttatcatttattaaacagatgttgctataagatgctagtttcagatttcaagaaggaataactatgttgctgggatgtatgggtaaagaacattaaccatcacccaaatgtaagagaatttgtcctttcttggtattccctttggatttttggtcacattctcctgttgtggatgctaataaagtaaatgaaataaggttttttttttttcatagcta

SEQ ID NO: 2569 - DNA, 2314 bp, Sequoia sempervirens
ccaactatcacgtcaagtgtgtccagacatctcacaccatgttttctagttagactaaggaaaaccagtatctgaaatagagaagtaagagaaacaatttcaacacatgatcctgtagaggctgaaccgataaaaggatctttcgtaagggtgatcgccaaatttccgtttgctaaacatggcaacagggcagcttttctctcgcacaactcaggcattattttacaactacaaacagcttcctatccagcgcatgctggattttgactttctctgtggcagagagaccccatctgttgctggaatcattaatcctggttctgaaggatttcagaaactcttctttgggcaggaggaaattgccatacctgttcattcagccattgaggccgcatgcacagcccatccaacagctgatgtcttcattaattttgcatcttatagaagtgcatatgcatcttccatgtctgccctgaagcagccaacaattagagtagttgctataatagctgagggtcttccagaaagagatacgaagcagttaattgcttatgcacgagctaataataaggttataattggacctgctactgtaggtggaattatggctggggcatttaaaattggtgatacagcaggcaccattgacaatattattcactccaagctgtacaggccaggatctgttggatttgtctccaaatctgggggaatgtcaaatgaaatgtataatacaattgcacgtgttacagatgggatatatgaaggtattgcgattggtggggatgggtttcctggttcaacattgtctgatcatattttgcggtttaacaatattccacaggttaaaatgatggttgtacttggggaacttggtggtagagatgagtattctctagttgaagccttaaaacaagggaaggtgcaaaagccggttgttgcttgggttagcggcacctgtgcacgcctcttcaagtctgaagtacaatttggccatgcaggtgcaaaaagtggaggtgaccttgagtctgcacaaggaaaaaatcaagcactaagagaagcaggtgcaattgtccccagctcttatgaagcattggaggatgctataaagcagacgtttgagtctcttgttgaggcaggaataattggtcaaactcatgaatataagcctcctcaaataccggaagacctgaacacagcaattaagagtggcaaagtcagggcaccaactcatgttatttccactatctgtgatgacagaggcgaggaacccacttacgcgggtatacccatgtcaactattgtagagaaaggttatggtgtgggtgatgttatctcactattgtggttcaaacgcagtcttccacgatattgtacaaaatttattgagatatgcattatgctttgtgctgaccatgggccttgcgtatctggtgcacataatacaattgtaacagcaagagcagggaaggatttggtctcaagtcttgtgtcaggtctcctgactattggcccaagatttggtggggctattgatgatgctgcaagatacttcaaagatgcatatgacaagggtttatcaccttatgaatttgttgaagggatgaagaaaaaaggtattcgtgtgccagggattggtcacaggatcaagagaggagacaaccgtgacaaaagagtagagctcctgcaattatacgcacgcacaaattttcctgctgtgaagtatatggattatgcggtacaagtggaaacctacactctttccaaagcaaacaatctggtcctcaatgttgatggtgcaatagggtcccttttcttggaccttcttgttgttagtggaatgtttaaccaacaagagattgatgagattgtggagattggttatttaaatggtctctttgtacttgcacgatcaattggtttgattgggcacacatttgatcagaagcggttgaaacagccattgtaccgacatccatgggaagatgttctgtataccaagtagattttcttagcatgaaatagtttactagtttgccaaagcattgtcccggggaattttttagtagtgaaactacaatgtttcccaatttctgtgttctgggagcagttaagaaggtcttgaggcctagttttgagcataccttgtcatctaatacactgatgaataattatatttgtactagagttgctctgcatggacaaatggttaggttatctatgtcaatggtgttttttcaaataataatgtgccttcctgtaaaaggacgcatgttaatgcagttgcagtttttgattgtaaattgacgattta

SEQ ID NO: 2570 - DNA, 2175 bp, Cichorium intybus
gaaataattttgtcactaaaacgcactacgttaacaaaaatcattttttattttttagttacacttttggataaagaatatttccaattttgcttatttacaggtgttttctgagtgagcaccatggcgacagggcaacttttctcccgtacaacacaagcattgttctataactataaacagttaccaattcagcggatgcttgattttgacttcctttgtgggagggaaacaccttcagttgctggaatcattaaccctggtgcagagggatttcagaaactgttttttggtcaagaagaaattgcaattccagttcattccactgtcgaagcagcttgcgccgcacatcctactgcagatgtatttataaatttcgcatcctacagaagtgctgctgcttcttccaatcttgccctcaaacagcccacaatcagagttgtggctattattgctgagggtgttcctgaatctgacaccaaggaattgattgcgtacgcaagatcaaacaacaaggttgttataggcccagcaactgttggtggtattcaagctggagctttcaagattggtgacactgcaggaacaattgacaacattattcaatgcaaactttacaggcctggatctgttggatttgtctccaaatctggtggtatgtcaaatgagttgtacaacacaattgcccgtgtgacagatggaatttatgaaggtattgctattggaggagatgttttccccggttctactctttcagaccatgttttgcggttcaacaacattcctcagatcaaaatgattgttgtacttggagaacttggaggtcgagatgagtactccttagttgaagccctaaaagcaggaaaaatcaataaacccgtatgcgcttgggtcagtggaacttgtgcgcgcctcttcaagtctgaagtccaattcgggcatgcaggtgccaagagtggcggtgaaatggagtccgcacaagccaaaaaccaagcacttacggatgccggtgccattgtcccaacatcatatgaatcatttgaaacatccatcaaggaaacattcgctaaattggccgaagagggcaaaattagtccggttaaggagttcacgcctccacaaatccctgaagatcttaactctgcaattaagagcgggaaagtacgggcaccaactcatattatttcaaccatctccgacgacagaggtgaagagccatgttatgccggcgtaccgatgtcttcaattgtggaaaaaggaatgggtgtcggtgatgtcatttcacttttatggttcaaacgcagtcttccacgttactgcacacaattcatcgagatttgcatcatgttatgtgccgatcacgggccgtgtgtatctggtgctcacaacacgattgtaaccgcaagggcaggaaaagatctcgtatccagccttgtttccggtttgcttactattggtccacgtttcggtggtgccattgatgatgctgctcgctacttcaaggatgcttacgataggaaactttcaccatacgagttcgttgaaagtatgaaaaagaagggaatccgtgtgcctggaattggtcacaggattaagagaggagataaccgtgacaagagagtggagcttttacaactatttgcacgcacaaacttcccgtcaaccaagtacatggaatacgcggttgaagtagaaacttacactctctcaaaagcaaacaacttagtgatgaatgtcgatggtgccatcggtacccttttcttggatcttcttgcgggaagcggaatgttcaccaaacaagaaatagacgagattgttggcatcggttaccttaacggtcttttcgtcttggcacgttccatcggtctcatcgggcatacattcgaccagaagaggttgaagcaaccactataccgtcacccatgggaagacgttctttacaccaagtgattctttgtgttgtattgtaatgcgttgttgttggatgtttggcttttgtttgtttgtatcattttagcttaaagcttacggttttatatttcgattgttgtggagggagtcttgttttcggaactttagaagaaataacacaatcatggagcattctttgttctcttgtactatgtctctatgtagttagtggcatctttgttttctgttgaatgaagacattga

SEQ ID NO: 2571 - DNA, 2066 bp, Centaurea maculosa
  misc_feature (829)..(829): n is a, c, g, or t
  misc_feature (864)..(864): n is a, c, g, or t
  misc_feature (885)..(885): n is a, c, g, or t
  misc_feature (915)..(915): n is a, c, g, or t
  misc_feature (962)..(962): n is a, c, g, or t
  misc_feature (979)..(979): n is a, c, g, or t
  misc_feature (1319)..(1319): n is a, c, g, or t
  misc_feature (1529)..(1529): n is a, c, g, or t
  misc_feature (1559)..(1559): n is a, c, g, or t
  misc_feature (1604)..(1604): n is a, c, g, or t
  misc_feature (1624)..(1624): n is a, c, g, or t
  misc_feature (1691)..(1691): n is a, c, g, or t
  misc_feature (1709)..(1709): n is a, c, g, or t
  misc_feature (1778)..(1778): n is a, c, g, or t
  misc_feature (1790)..(1790): n is a, c, g, or t
  misc_feature (1799)..(1799): n is a, c, g, or t
  misc_feature (1960)..(1960): n is a, c, g, or t
  misc_feature (1964)..(1964): n is a, c, g, or t
  misc_feature (1993)..(1993): n is a, c, g, or t
  misc_feature (2001)..(2001): n is a, c, g, or t
  misc_feature (2003)..(2003): n is a, c, g, or t
cacatacatactctatagctcacacatctgacagtttcaaccaattcatacatacccaggaacctttgggtgagcaccatggcgaccggacaaattttctcccgaacaacacaagcgttgttctataattataagcaattaccaattcaacggatgcttgattttgacttcctttgtgggagggagacaccatcagttgctggaatcattaaccctggtgctgagggatttcagaaactcttttttggccaagaggagattgccatacctgtacattcaaccattgaagcagcttgtgctgcacatcctactgctgatgtattcataaatttcgcatcattcagaagtgctgctgcgtcatccaagcttgctctcaagcagcctaccattagagttgtggctatcatagccgagggtgttcccgaattcgacaccaaggagttgatttcctatgcaaggtcaaacaacaaggttgttattggcccagcaacagttggtggaattcaagctggagctttcaagattggtgacactgctggaacaatcgataacattatacaatgcaaactatacaggcctggatctgtcggatttgtctccaaatctggtggcatgtctaatgagttatacaacaccattgcccgtgtgacagatggaatctatgaaggcattgctattggaggagatgtttttcccggttctactctttctgatcatgttttgcggttcaacaacatcccacagataaaaatgatcgttgtgcttggggaacttggtggtcgagatgagtattccttagttgaagcactgaaatcaggaaagatcactnaacccgtatgtgcttgggtcagtggaacttgtgcncgcctcttcaaatccgaagtncaattcggccatgcgggggccaaaagtggnggtgaaatggagtctgcacaagctaaaaatcaagcactcaaagatgncggtgctgtcgtccccncttcgtacgaagcatttgaaacttcgatcaaggaaacctttgcgaagttggctgaggagggcaagattacccaagttaaggagatcacccctccacaaatccctgaggacctaaactcagcaattaagagcggcaaagtacgagcaccgactcatattatttcaaccatctctgatgacagaggtgaagagccatgctatgctggggtaccaatgtccacaattgtcgaaaaaggatgggcattggtgacgttatttctcttttgtggttcaagcgtagtcttccccgctactgcacacaattcattgagatttgtgtcatgttatgtgcggaccacggnccgtgtgtctctggtgctcacaacacaatagtaactgcaagggcaggaaaagatctcgtatcgagtcttgtttcgggtttgctaacaattggtccacgttttggtggtgccgttgatgatgctgctcgatacttcaaggatgcttacgacaggaaactttcaccgtatgagtttgttgaaagcatgaaaaagaagggtattcgtgtgccnggaatcggccacaggatcaagagaggaganaatagagataagagagtggagctgctacaactgtttgctcgcacncatttcccgtcaaccaagtncatggaatatgccgtggaagtcgaggcttacactctttcaaaagcaaacaatttggtgatgaacgtngatggtgccattggtacncttttcttggatcttcttgcgggtagcggaatgttcacaaagcaagaaatcgacgaaattgtggcaatngggtacctcaanggcctcttngtcttggcccgttccatcggtctcatcgggcatacatttgaccagaagaggttgaagcagccactatacaggcacccatgggaagatgttctttacaccaagtgatgatgattcaaaatcatttttcatatgaaaattgttgtaatgaaatatttgttctntgcnttgtttgtttgtatggagaaatttctccntttatatntncataaactagggtttacttttgaggttttgttcctaggtttcggaagtttacataacaatgtc

SEQ ID NO: 2572 - DNA, 1962 bp, Cynara scolymus
  misc_feature (1117)..(1117): n is a, c, g, or t
  misc_feature (1613)..(1613): n is a, c, g, or t
  misc_feature (1893)..(1893): n is a, c, g, or t
ttgacgagttgcaaccagttcttacttacccaggaacctgtgggtgagcaccatggctactggacaattttctcccgaacacacaagcattgttctataactataagcaattaccaattcaacggatgcttgattttgacttcctttgtgggagggaaacgccgtcagttgctggaatcattaaccctggtgccgagggatttcagaaactcttttttggccaagaggagattgccataccagtgcattcaaccattgaagcggcttgtgctgcacatcctactgctgatgtattcataaacttcgcatcattcagaagtgctgctgcttcatccaagcttgctctcaaacagcctaccatcagagttgtggctattatagctgagggtgttcccgaattcgacaccaaggagctgatttcctatgcaaggtcaaataataaggttgttattggcccagcaacagttggtgggattcaagccggagctttcaagattggtgacactgctggaacgatcgataacattatacaatgcaaactatataggcctggatctgtcggatttgtctctaaatctggtggcatgtctaatgagttatacaacacaatcgctcgtgtgacagatggaatctatgaaggtattgctattggaggagatgtttttcccggttctactctttctgatcacgttctgcggttcaacaacatcccacagataaaaatgatagttgtgcttggagaacttggtggtcgagatgagtattccttagttgaagcactcaaatcaggaaaaatcaataaacccgtatgtgcctgggtcagtggaacttgtgcacgcctcttcaatccgaagttcaatttggtcatgcgggggccaaaagtggcggtgaaatggagtctgcacaagctaaaaatcaagcactcaaagatgccggggctgtcgtccccacttcgtatgaagcatttgaagcttcgatcaaggaaacgtttgcgaaactggctgaggagggcaaaattacccaagttaaggagatcaccccgccacaaatccctgaggatcttaactcggcaatcaagagcggaaaagtacgagcacctactcatattatttcaacnatctctgacgacagaggtgaagagccatgctatgctggggtaccaatgtccacaattgtcgaaaaaggaatgggcattggtgatgttatttctcttttgtggttcaagcgtagtcttccccgctactgcacacattttattgagatttgtgtcatgttatgtgccgaccacggtccatgtgtctctggtgctcacaacacaatagtaactgcgagggcaggaaaagatcttgtatcaagtcttgtttcaggtttgctaacaattggtccacgttttggtggtgccgttgatgatgctgctcgatacttcaaggatgcttacgaccgcaaactttcaccatatgagtttgttgaaagcatgaaaaagaagggtattcgtgttccgggaatcggccacaggatcaagagaggtgataatagagataagagagtggagcttctacaactgtttgctcgcacacatttcccatcaaccaagtacatggaatatgccgtanaagtcgaggcttacactctttcaaaggcaaacaatttggtgatgaacgtcgatggtgccattggtacccttttcttggatcttcttgcgggtagtggaatgttcacaaagcaagaaatcgacgaaattgttgcaattggttacctcaacggcctcttcgtcttggcccgttccatcggtctgatcgggcatacatttgaccaaaggaggttgaagcagccactatacaggcacccatgggaagatgttctttacaccaagtgattcacatatgcaatttngtgtattgattatatgttggtgggaattgcctgcttttgttcgtttgtttgatggagacaattctccct

SEQ ID NO: 2573 - DNA, 2445 bp, Gnetum gnemon
agagaccaggcagtccttggcggggagcacgattttttggactacccagtgacttacccaccgctcacctaccttttctctgaatctgttttatgccccgtctcagtccgtgggcggacctgcctgctgagaatttagtgttgcaataactccctctaacactccgccgtgtggtcttagagatccccgtctgctggttccagaagcacgcagagcattgtgactggttctgggtttgggcctttgttgatcctgtagaagtggattttgagttttctggcttcttttgcaggtaacaagtgtaaggggaaagatggcatcagggcagcttttctcccacacaactcaagctctcttctacaattacaaacaacttcctattcagcgaatgttagattttgattttctgtgtggcagagagacaccctcagttgctgggatcatcaatcctggttctgaagggtttcagaaacttttttttggccaggaagagattgccatacctgttcattcaaacattgagtctgcctgtgtagcacatccaactgctgatgtattcattaactttgcatcctatagaagtgcattcgcctcttcaatgactgctttgaaacagcctaccgtccgtgttgtggctattattgctgaaggggtacctgaaggtgatactaaacagttgattgcatatgcacgagcaaataacaaggttatcattgggcctgctactgtaggaggtattcaagctggtgcatttaagattggtgatacagctggcacaattgaaaatattgttcgatgcaaactgtataggccaggatctgtcggttttgtttccaaatcgggagggatgtccaatgagctctacaatactatttcacgtgtgacagatggcatatacgaaggtattgccattggaggtgatgttttccctggatcaacactttcagatcatgttctccggttcaacaatattcctcaggttaaaatgatggttgtccttggggaacttggtggaagagatgaatattccttagtggaagcacttaagcagggtaaggtacaaaagccagtagtggcatgggtcagtggcacttgtgcacgtcttttcaaatcggaagtacaatttggccatgctggtgcaaaaagtggaggtgaccttgaatctgcacaagctaaaaatcaggcattaaaggatgcaggtgccattgttcccatttcttacgaaggtctagaagcagccatccaagagacctttcagaaacttgctgaagaaggaaagatcagtcctacacctgatgtgaagcctcctcctatacctgaagatttgagcgttgcaattaagagtggcagggttagggctcctacacatgtcatttccacgatttgtgacgatagaggagaggagccaacatatgctggagtggcaatgtctaccatcatagaatcaggatttggtgttggagatgttatttccttgctgtggttcaagcgcagtcttccaagatattgcacaagatttattgagatgtgtattatgctctgtgctgatcatggcccatgcgtatctggtgctcacaacaccattgtgacagcaagagctggaaaggatctggtatcaagtctggtgtcaggtcttctgaccattggtccacgctttggtggggctattgatgatgccgctagatatttcaaggatgcatttgacaagggattaacaccatatgaatttgtggaagggatgaagaagaagggaattcgtgtacctggaattggtcacaggatcaagagaggagataaccgtgacaagagagtggagcttctacaagcttatgcacgaacccactttccttctgtgaagtacatggagtatgctgtgcaggtggaaacatacaccctttctaaagccaacaatcttgttctgaatgttgatggagctattggctcccttttcttggatcttctcgccgggagtgcaatgtttacgcagcaagagattgatgagattgttcagattggttatctgaatggcctctttgtgctagcacgatccattggtctaattgggcacacatttgatcagaagaggttgaaacagcctctgtaccgacacccatgggaagatgttttgtacaccaagtagcatgcttcttgtgtgaacatgatcataaaattagttctttaattagttttttaaacaagaatgcagaggttggcaattgaccctgcagtgacaatcttcaggcaccaagtataaagctcccgtagaatgtcacagtatatggtgattgtcttttggcattttgttaatgtagttttttgtttgcattcaatttgcattgtaccagagacccaaatctaacgacaattctgtccttggtgcaaaaatgcgtgtcttttgatgtggaaaaaagggcagttagaatttaaatgaattgaaatggttga

SEQ ID NO: 2574 - DNA, 2146 bp, Mimulus guttatus
cacacccaccattgtataaatcccacttcctctctcccaaagcagcatacagacacattctcgtgttttcgcctatttgtatacttgttcaaaaaggggttgttttcagacagaaccatggcggcgactggacaaattttctcgagaaccactcaggcactgttttacaattacaagcaactcccgattcagcggatgcttgatttcgacttcctctgtgggagagaaacaccctctgttgccggaattataaatccaggttccgagggattccagaaactattttttggtcaggaggagattgctattccagttcactctgccgttgaagctgcttgtgcagcacatcctacagcagatgttttcattaactttgcatcattcagaagtgctgctgcttcatcaatggcagctctgaagcagccaaccataagagttgtggccattatagccgaaggtgtacccgaatcagacaccaaacaattgattgcctatgcaaaggcaaacaataaggttttgattggccctgctactgttggaggtgtacaagctggagctttcaagattggtgatacagctggaacaattgataacataattcaatgcaagctgtacaggcctggatctgttggctttgtctcgaaatctggtggtatgtctaacgaattatataactcaatcgctcgggttactgatggaatctatgaggggattgcaattggaggagatgtgtttcccggatcaacactatccgatcacgtccttcggtttaacaatatccctcagattaaaatgatggttgttcttggagaacttggtgggcgtgacgaatattccttagtcgaggccctcaaaacggggaaaatcaacaagcccgttgttgcatgggtcagtggaacttgtgctacacttttcaagtctgaagtacaatttggtcatgcgggggctaagagcggtggcgaaatggagtctgcacaggccaagaacgaagcactcagacaagctggagctatcgttcccacttcttatgaagcattcgaaggagcaataaaagaaacattctcgaaactggtggaggggggcaaagttacaacggttaaagaggtgaaaccccctcaaataccagaggatctgagcacagcaatcaagagtggaaaagttcgagctccaacgcatattatttccacaatatctgatgataggggtgaagagccaacctatgctggtgtgccaatgtcttcgatcgttgagcaaggattaggtgtaggcgatgtcatttctttattgtggttcaaacgaagccttcctcattattgctcgcgtttcattgagatttgcatcatgttgtgtgctgaccatggtccctgtgtatctggtgctcacaacaccattgtaactgctagggctggaaaagacctagtctctagtctcgtttctggtttattgacaattggtcctcgattcggtggggccattgacgatgctgctcggtacttcaaggatgcttatgacaagggtcttacaccttatgaatttgtggaaagcatgaaaaagaagggcattcgtgtacctggtatcggacacaggatcaagaggggtgacaacagagataagagagtggagttgttacaactatttgcacgatccaattttccgtcggtcaagtacatggaatatgcggttgaagtagaaacatacacgctttcaaaagcaaacaacctagtactcaatgtagatggtgcaattggttccctattcttggatcttctagcgggcagtggaatgttcactaaacaagaaatagacgagattgttggtattggttatcttaacggtctctttgtgcttgcacgttccattggtctcatcggacacacgttcgaccagaagagactgaagcaaccattgtaccgccatccatgggaagatgttctgtacaccaagtgaataaagaatttcttgccttactcacacattgcacatttttgttcagttgctttctttctttctttttcttcctcagttgtcactttgtttattatgcctttcttttttcaattgtactgccaaagaaacacagatttgaaaactttagtttgtgggttttaacatttaatttagtcactccttcacaacaattacttcc

SEQ ID NO: 2575 - DNA, 2139 bp, Mimulus guttatus
cccacacccaccattgtataaattccattctcgtgttctcgcctatttgtatacttgttgataaaggggctgttttcagacagaaccatggcggcgaccggacaaattttctcgagaaccactcaggcactgttttacaattacaagcaactgccgattcagcggatgcttgatttcgacttcctctgtgggagagaaacaccttctgttgccggaattataaatccaggttccgagggattccagaaactatttttcggtcaggaggagattgccattccagttcactctgccgttgaagctgcttgtgcagcacatcctacagctgatgttttcattaactttgcctcattcagaagtgctgctgcttcatcaatggcagctctgaagcagccaaccataagagttgtggccattatagccgaaggtgtacccgaatcagacaccaaacaattgattgcctatgcaaaggcaaacaacaaggttttgattggcccggctactgttggaggtgtacaagctggagctttcaagattggtgatacagctggaacaattgataacataattcaatgcaagctttacaggcctggatctgttggcttcgtctcgaaatctggtggtatgtctaacgaattatataactcaattgctcgggttactgatggaatctatgaggggattgcaattggaggagatgtgtttcctggatcaacactatccgatcacgtccttcggtttaacaatatccctcagattaaaatgatggttgttcttggagaacttggtgggcgtgacgaatattccctagtcgaggcccttaaaacggggaaaatcaacaagcccgttgttgcatgggtcagtggaacttgtgctacacttttcaagtctgaagtacaatttggtcatgcgggggctaagagcggtggcgaaatggagtctgcacaggccaagaacgaagcactcagacaagctggagctatcgttcccacttcttatgaagcattcgaaggagcaataaaagaaacattctcgaaactggtggaggggggcaaagttacaacggttaaagaggtgaaaccccctcaaataccagaggatctgagcacagcaatcaagagtggaaaagttcgagctccaacgcatattatttccacaatatctgatgataggggtgaagagccaacctatgctggtgtgccaatgtcttcgatcgttgagcaaggattaggtgtaggcgatgtcatttctttattgtggttcaaacgaagccttcctcattattgctcgcgtttcattgagatttgcatcatgttgtgtgctgaccatggtccctgtgtatctggtgctcacaacaccattgtaactgctagggctggaaaagacctagtctctagtctcgtttctggtttattgacaattggtcctcgattcggtggggccattgacgatgctgctcggtacttcaaggatgcttatgacaagggtcttacaccttatgaatttgtggaaagcatgaaaaagaagggcattcgtgtacctggtatcggacacaggatcaagaggggtgacaacagagataagagagtggagttgttacaactatttgcacgatccaattttccgtcggtcaagtacatggaatatgcggttgaagtagaaacatacacgctttcaaaagcaaacaacctagtactcaatgtagatggtgcaattggttccctattcttggatcttctagcgggcagtggaatgttcactaaacaagaaatagacgagattgttggtattggttatcttaacggtctctttgtgcttgcacgttccattggtctcatcggacacacgttcgaccagaagagactgaagcaaccattgtaccgccatccatgggaagatgttctgtacaccaagtgaataaagaatttcttgccttactcacacattgcacatttttgttcagttgctttctttctttctttttcttcctcagttgtcactttgtttattatgcctttcttttttcaattgtactgccaaagaaacacagatttgaaaactttagtttgtgggttttaacatttaatttagtcactccttcacaacaattacttccattggtcaagagtttttctttct

SEQ ID NO: 2576 - DNA, 2106 bp, Lactuca sativa
cttcattgctcgtctcgataaacccactcacgcatttgacgtgtttcaacaaattcttacataccaaggtgtttttgaacaagcaccatggcgacagggcaacttttctcccgtacaacacaagcgttgttctataattacaagcagttgccaattcagcgcatgcttgatttcgacttcctttgtgggagggaaacgccttcagttgctggaatcattaaccctggcgctgagggatttcagaaactattttttggccaagaagagattgcaattccagttcattccactgttgaagctgcttgtgctgcgcatcctactgcagatgtatttataaatttcgcatcctacagaagtgctgctgcttcatccaatcttgccctcaaacagcccaccatcagagttgtggccattatagctgaaggtgttcctgaatctgacaccaaggaattgattgcatacgcaagatcaaacaacaaggttgttattgggccagcaactgttggtggtattcaagctggagctttcaagattggtgacactgcaggaacaattgataacattattcaatgcaaactttacaggcctggatctgttggatttgtctccaaatctggaggcatgtcaaatgagttgtacaacacaattgcgcgtgtcacggatggactttatgaaggtattgcaattggaggagatgtttttccaggttctactctttcggatcatgttttgcggtttaacaacattcctcagatcaaaatgattgttgtgcttggggaacttggtgggcgagatgagtactctttagttgaagctcttaaagctggaaaaatcaataagccagtatgtgcttgggtcagtggaacttgtgcccgtcttttcaagtctgaagtccaatttgggcatgcgggggctaaaagtggaggtgaaatggagtctgcacaagctaaaaaccaagctcttatggatgccggtgccattgtcccaacatcatatgaatcatttgaaacctccatcaaggaaacattcgccaaattggcggaagagggaaagattagtcctgttaaggagatcacgcctccccaaatcccggaggatcttaactctgcaatcaagagcgggaaagtacgagcaccgactcatattatttccaccatctccgacgacagaggtgaagagccatgctatgctggcgtaccgatgtcttccattattgaaaaaggaatgggagtcggtgatgtcatttcacttttatggttcaaacgcagtcttcctcgctactgcacacaattcatcgagatttgtatcatgttatgtgccgatcatgggccgtgtgtctccggtgctcacaacaccattgtaaccgctagggcaggaaaagatctcgtatccagccttgtttccggtttgctgactattggtccacgttttggtggtgctgttgatgatgctgctcgatacttcaaagatgcttacgataggaaactttccccatatgagtttgttgaaagtatgaaaaagaagggtattcgagtgcccggaattggtcacaggatcaagagaggggataacagagataagagagtggagctactacaactatttgcacgaacaaatttcccatcaacaaagtacatggaatatgcggttgaagtggaaacatacactctctcaaaagcaaacaacttagtgatgaatgttgatggtgccattggtacccttttcttggatcttcttgcgggtagcggtctcttcaccaaacaagaaatcgatgagattgtcagcatcggttacctcaacggtctctttgtcttggcacgttccattggtctcatcgggcatacgtttgaccagaagaggttgaagcaaccactataccgtcacccatgggaagatgttctttacaccaagtgattcttctgtgttgtattgtaatagtaatactaatgcatcattgttggatgtatttccttttgtttgtttgtatcatttagcttatggctttatatttcgattgttatgtggagggagtcttgagtcttgagtcttgtttcggaacttcacaaaaaataacacaatcatatggagcatttttcgttctcttgt

SEQ ID NO: 2577 - DNA, 2379 bp, Mimulus guttatus
taacaacccacactctctcttcctatatatatacatacacattacatacactatacatatatatatatatacacacacactcacccgtcaccctactcttctcctaccttcatcataacaagattaccttcccgattcttcgttcatagggataattgtctgaaaggtagctgcattttggcgataatttacggatttatcgaggtgtttcaggcaaacaccatggcgactggacaacttttctcgaaaaccactcaagcactattttacaattacaagcagctgccgatccagcgtatgcttgattttgatttcctttgcggccgagaaactccttctgttgccggaattataaatcctggttctgagggatttcagaaactattttttggtcaagaggaaatagccattccggtccattctgatgttgcagcagcttgtgcagcgcaccctacagctgatgttttcattaactttgcatcgtatagaagtgctgcagcttcatctatgtctgctctcaagcagccaactattaaagttgttgcaattatagctgaaggtgtccctgagttagacaccaaacagttgattgcttatgcaaaagcaaacaacaaggttgtcattggtccggctactgttggaggtattcaagctggagcatttaagattggtgatactgctggaacaattgataatataattcaatgtaaattgtaccggcctggatctgttggctttgtctcgaaatctggtggtatgtctaacgaattatacaactcgattgcccgtgtcactgatggaatttatgaaggcattgctattggaggagatgtctttcccgggtcaactctttctgaccatgtcctgcggtttaacaatatccctcaggtcaaaatgattgttgttcttggagaactcggtgggcgtgatgaatattccctagttgaggcccttaagcaggggaaaatcagcaaacctgtggttgcctgggtcagtggaacttgtgctacactcttcaaatcagaagttcaattcggtcatgcgggggctaagagtggtggagagatggaatctgcacaggccaagaacgaagcactcagagaagctggagctattgttcccacttcttatgaagcatttgaaggtgcaatcaaagaagcatttgcaaaattggttgaggcaggtaaaactactccagtgaaggagataacaccccctcaaatacccgaggatcttagctcagctattaagagtggaaaagttcgcgctccaacacatattatttccacaatctctgatgatcggggtgaagagccaacctacgctggagttccaatgtcctccattgttgaacagggattgggtgtcggtgatgttatttctttattgtggttcaaacgaagtcttcctcgttactgcacacgttttattgagatttgcatcatgctatgtgctgaccatggtccttgtgtgtctggtgctcacaacaccattgtaaccgctagagctggaaaagaccttgtctcgagtcttgtttcaggtttgttgacaattggtccgcgatttggtggggctattgatgatgctgctcgatacttcaaggatgcttacgataagggtcttacaccttatgaatttgtcgaaagcatgaagaagaagggcattcgtgttcctggaatcgggcacagaatcaagaggggtgataacagagataagagagtggaattactacaggagttttcgcgctccaatttcccttcagtaaagtacatggaatacgcagttgaagtcgaaacctatacactctcaaaagcaaacaacctcgtactcaatgttgatggtgccattggttccctattcttggatcttcttgcaggcagtggaatgttcactaagcaagaaatcgacgagattgtcggaattggataccttaacggtcttttcgtgctcgctcgttccatcggtctcatcgggcatacatttgaccaaaagagactgaagcagccactgtaccgccacccgtgggaagatgttctgtacaccaagtgaaaacttctacaaataaaaacaacagattcataataagttgtgcctgccttgcaatggccagtcttccaagttttagtttctcattttttttttatttttttttttaatgatgtgaatttgttgtgtcaatgttgggttaaattcggtatttaatttgtacctgctaaaaagcagatttatgagtgtgcttcttttgtaagatttaactctttcacaaagtgccaatcaagaattttactttacttctcgaatgattctaatcatgtataacgaactgatgattctagaatcctagattatgatggtgaccgtgtaagaatttatttgtgg

SEQ ID NO: 2578 - DNA, 2260 bp, Lactuca sativa
cgggaaatatttatgtcgaatcactgaatccatgaccccatatctccaattcctcttatatatatagcacacccgttggtattcttcacacttcattgctcgtctcgataaacccactcacgcatttgacgtgtttcaacaaattcttacataccaaggtgtttttgagcaagcaccaatggcgacagggcaacttttctcccgtacaacacaagcgttgttctataactacaagcagttgccaattcagcgcatgcttgatttcgacttcctttgtgggagggaaacaccttcagttgctggaatcattaaccctggtgctgagggatttcagaaactattttttggccaagaagagattgcaattccagttcattccactgttgaagctgcttgtgctgcgcatcctactgcagatgtatttataaatttcgcatcctacagaagtgctgctgcttcatccaatcttgccctcaaacaacccaccatcagagttgtggctattatagctgaaggtgttcctgaatctgacaccaaggaattgattgcatacgcaagatcaaacaacaaggttgttattgggccagcaactgttggtgggattcaagctggagctttcaagattggtgacactgcaggaacaattgataacattattcaatgcaaactttacaggcctggatctgttggatttgtctccaaatctggaggcatgtcaaatgagttgtacaacacaattgcccgtgtcacggatggactttatgaaggtattgcaattggaggagatgtttttcccggttctactctttcggatcatgttttgcggttcaacaacattcctcagatcaaaatgattgttgtgcttggggaacttggtgggcgagatgagtactctttagttgaagctcttaaagctggaaaaatcaataagccagtatgtgcttgggtcagtggaacttgtgcccgtcttttcaagtctgaagtccaatttgggcatgcgggggctaaaagtggaggtgaaatggagtctgcacaagctaaaaaccaagctcttatggatgccggtgccattgtcccaacatcatatgaatcatttgaaacctccatcaaggaaacattcgccaaattggcggaagagggaaagattagtcctgttaaggagatcacgcctccccaaatcccggaggatcttaactctgcaatcaagagcgggaaagtacgagcaccgactcatattatttccaccatctccgacgacagaggtgaagagccatgctatgctggcgtaccgatgtcttccattattgaaaaaggaatgggagtcggtgatgtcatttcacttttatggttcaaacgcagtcttcctcgctactgcacacaattcatcgagatttgtatcatgttatgtgccgatcatgggccgtgtgtctccggtgctcacaacaccattgtaaccgctagggcaggaaaagatctcgtatccagccttgtttccggtttgctgactattggtccacgttttggtggtgctgttgatgatgctgctcgatacttcaaagatgcttacgataggaaactttccccatatgagtttgttgaaagtatgaaaaagaagggtattcgagtgcccggaattggtcacaggatcaagagaggggataacagagataagagagtggagctactacaactatttgcacgaacaaatttcccatcaacaaagtacatggaatatgcggttgaagtggaaacatacactctctcaaaagcaaacaacttagtgatgaatgttgatggtgccattggtacccttttcttggatcttcttgcgggtagcggactcttcaccaaacaagaaatcgatgagattgtcagcatcggttacctcaacggtctctttgtcttggcacgttccattggtctcatcgggcatacgtttgaccagaagaggttgaagcaaccactataccgtcacccatgggaagatgttctttacaccaagtgattcttctgtgttgtattgtaatagtaatactaatgcatcattgttggatgtatttccttttgtttgtttgtatcatttagcttatggctttatatttcgattgttatgtggagggagtcttgagtcttgagtcttgtttcggaacttcacaaaaaataacacaatcatatggagcatttttcgttctcttgtaatagtttccttgtaattgttaatgatatctttgtttctgttgaatgaagatctataacagcc

SEQ ID NO: 2579 - DNA, 2574 bp, Taxus baccata
cctcgactccgccttctcttttttaatcaggacaaacgattctaatgggccggcgctatagatctataaaatctccccagacttcaggagcgaaattggaagtcctttttcctggcactcccccaacgtgtttacctgtcaagatttattcctaatataaattcctcaccaactagccaataaaaccgtagtttcaatctacccatctgtgcttcctcacttactcacgtgtatttagtgagctacctgattgtggttagataggcttgttttaattgaagctgtgtgggcatcgtgctctcttctcaaaccagaccagatctctttctggagttgctgtttcttcttattctgtttcaagggtgattgtcatattttcccttgcaaaacatggcaacggggcagcttttctctcgctcaactcaggcattattttataactataagcagcttcctattcaacgcatgctggattttgatttcctctgtggcagagagaccccatctgttgctggaatcattaatcctggttctgaaggatttcagaaacttttctttgggcaggaggaaattgccatacctgttcattcagctatcgaggctgcatgcaaagtccatccaacagctgatgtcttcatcaattttgcatcctataggagtgcatatgcatcttccatgtcggctctgaagcagccaacaattagagtagtagctataatagccgaaggtgttccagaaggagatgcaaagcagttaattgcttatgcacgagctaataataaggttataatcggacctgctactgtaggtggaattcaggccggtgcatttaaaattggtgacacagcaggcactattgacaatattattcagtgcaagctgtataggccaggatctattggatttgtctcaaaatcagggggaatgtcaaatgaaatgtataatacaattggacgtgttacagacgggatatacgaaggtattgcgattggtggggatgtgtttcctggctcaacattgtctgatcatgttttgcggtttaacaatattccacagattaagatgatggttgtgcttggggaacttggcggcagagatgagtattctctagttgaagccttaaaacaagggaaggtgcaaaagccggttgttgcttgggttagcggcacctgcgcacgcctctttaagtctgaagtacaattcggccatgcaggtgctaaaaagtggaggtgaccttgagtctgcacaaggaaagaatcaagcactcaaagaagcaggtgcaattgttcccacctcatatgaaggattggaatcggctataaagcagacatttgaacaacttgttgaggaaggaaagataggtcaaactcgtgaatttaagcctcctcaaatacccgaagacctgaaaatagcaattaagagtggcaaagtcagggcaccaactcatgttatatccactatctgtgatgacagaggtgaggaaccaacttattcaggtgtagcaatgtcaactattgtagagcaaggctacggtgtgggcgatgttatctcactattgtggttcaaacgcagtcttccacgatactgtacaaagttcattgagatatgtattatgctttgtgctgaccatgggccttgtgtatctggtgcacataatacaattgtaacagcaagagcagggaaggatctagtctcaagtcttgtttcaggtcttcttaccattggcccaagatttggtggggctattgatgatgctgcaagatactttaaagatgcgtgtgacaagggtctatcaccttatgaatttgttgaagggatgaagaagaaaggcattcgtgtgccagggattggtcacaggatcaagagaggagacaaccgtgacaaaagagtagagctccttcaattatatgcacgcacacattttcctgctgtgaagtacatggattatgctgtacaagtggaaacctacactctttccaaatcaaacaatctggtcctcaatgttgatggtgcaatagggtcccttttcctggatctccttgctgttagtggaatgtttacccaacaagagattgatgagattgtggagattggttatttaaatggcctctttgtacttgcacgatcaattggtttgatagggcacacatttgatcagaagcggttgaaacagcccttgtaccgacatccatgggaagatgttctgtataccaagtagcttttcttagcatgaaaaaatttactagtttgctgaagcacggttctggggatttttcaggagtgaaactaaaatgtttcatgatttctctgttacgggtgcagttaacaagtctagagccccggtttcaagcaaaccttgtcatttaatatttattgacgaataaatatttttgtactagagttgttctgcataagcttcatgtttaagctgaaggatatgcacgttcacttcatatttatattttctcatttcatatttccacacaagcaaattgttaagttattagttatttttaaataataaatgcattccagtagaaggatgcataaaaagtttgtctctggaatgcgaag

SEQ ID NO: 2580 - DNA, 2347 bp, Mimulus guttatus
aacaacccacactctcttcctatatatatacatacagattacatacactatacatatatatatatacatacacactcacccgtcaccctactcttctcctaccttcatcataacaagattaccttcccgattattcgttcatagggataattgtctgaaaggaggtgtttcaggcaaacaccatggcgactggacaactgttctcgaaaaccactcaagcactgttttacaattacaagcagctgccgatccagcggatgcttgattttgattttctttgcggccgagaaactccttctgttgccggaattataaatcctggttctgagggatttcagaaactattttttggtcaagaggaaatagccattccggtccattctgatgttgcagcagcttgtgcagcgcaccctacagctgatgttttcattaactttgcatcgtacagaagtgctgcagcttcatctatgtctgctctcaagcagccaactattaaagttgttgccattatagctgaaggtgtccctgagttagacaccaaacagttgattgcttatgcaaaagcaaacaacaaggttgtcattggtccggctactgttggaggtattcaagctggagcatttaagattggtgatactgctggaacaattgataatataattcaatgtaaattgtaccggcctggatctgttggctttgtctcgaaatctggtggtatgtctaacgaattatacaactcaattgcccgtgtcactgatggaatttatgaaggcattgctattggaggagatgtctttcccgggtcaacactttctgaccatgtccttcggtttaacaatatccctcagtcaaaatgattgttgttcttggagaactcggtgggcgtgatgaatattccctagttgaggcccttaagcaggggaaaatcagcaaacctgtggttgcctgggtcagtggaacttgtgctacactcttcaaatcagaagttcaattcggtcatgcgggggctaagagtggtggagagatggaatctgcacaggccaagaacgaagcactcagagaagctggagctattgttcccacttcttatgaagcatttgaaggtgcaatcaaagaagcatttgcaaaattggttgaggcaggtaaaactactccagtgaaggagataacaccccctcaaatacccgaggatcttagctcagctattaagagtggaaaagttcgcgctccaacacatattatttccacaatctctgatgatcggggtgaagagccaacctacgctggagttccaatgtcctccattgttgaacagggattgggtgtcggtgatgttatttctttattgtggttcaaacgaagtcttcctcgttactgcacacgttttattgagatttgcatcatgctatgtgctgaccatggtccttgtgtgtctggtgctcacaacaccattgtaaccgctagagctggaaaagaccttgtctcgagtcttgtttcaggtttgttgacaattggtccgcgatttggtggggctattgatgatgctgctcgatacttcaaggatgcttacgataagggtcttacaccttatgaatttgtcgaaagcatgaagaagaagggcattcgtgttcctggaatcgggcacagaatcaagaggggtgataacagagataagagagtggaattactacaggagttttcgcgctccaatttcccttcagtaaagtacatggaatacgcagttgaagtcgaaacctatacactctcaaaagcaaacaacctcgtactcaatgttgatggtgccattggttccctattcttggatcttcttgcaggcagtggaatgttcactaagcaagaaatcgacgagattgtcggaattggataccttaacggtcttttcgtgctcgctcgttccatcggtctcatcgggcatacatttgaccaaaagagactgaagcagccactgtaccgccacccgtgggaagatgttctgtacaccaagtgaaaacttctacaaataaaaacaacagattcataataagttgtgcctgccttgcaatggccagtcttccaagttttagtttctcatttttttttttatttttttttttaatgatgtgaatttgttgtgtcaatgttgggttaaattcggtatttaatttgtacctgctaaaaagcagatttatgagtgtgcttcttttgtaagatttaactctttcacaaagtgccaatcaagaattttactttacttctcgaaggattctaatcaggtataacgaactgatgattctagaatcctagattatgatggtgcccgtgtaaaaatttttttttggggggggcc

SEQ ID NO: 2581 - DNA, 2228 bp, Populus trichocarpa
ggccagtttggtgttttgtacactatggcgacaggacaactcttctctcgaacaacacaagctttgttttacaattataagcagctgcctattcaacgcatgcttgattttgattttctatgtgggagggaattaccttctgtagctggaattattaaccctggcgctgaggggtttcagaaactctttttcggtcaagaggaaattgcaatccctgtgcattcgactgttgaggcagcttgcactgctcacccaactgctgatgtgtttatcaacttcgcatcattcagaagtgcggctgcttcatccatggctgctctgaagcagccaactgttcgagttgtggctatcatagctgagggtgttcctgaggcagacaccaagcaattgattgcatatgctcgggctaacaataaggttgtcattggtccggccactgttggaggcattcaagctggagcattcaagataggtgaaactgctggaacaattgataacataattgcttgcaagctttaccggtctggatctgttggatttgtctccaaatccggtggcatgtctaatgagctgtataacgccattgcccgtgtaactgatggaatttatgaaggtattgcaattggaggagatgtgttcccaggatctactctttctgatcatgttctgcggttcaacaacatcccacaggttaaaataatggttgtacttggggaacttggtggacgagatgagtattctctagttgaagccttaaaacagggaaaggtaaacaaaccagtggttgcttgggttagcggaacttgtgcacgactctttaaatcagaagtacaatttggtcatgctggtgctaaaagtggtggtgagatggaatccgctcaagcaaaaaatcaagcaataaaagatgccggagctgttgttcccacttcatatgaagcttttgagactgcaattaaggaaacatttgagaaactggttgacgaaggaaagattacacctgtaaaggagtttacgcctccacaaatccctgaagatcttaacattgcaatcaagagcggaaaagtccgggcaccaacccatattatttctaccatctctgatgaaagagggacgttcaaccaatacttcctgagtgaggaaccgtgctatgctggcgtgccaatgtcttccattgttgaacagggttatggtgtgggtgatgtcatctctcttttatggttcaagcgcagccttccacgttactgtacccattttatggagatatgcatcatgttgtgtgctgaccatggtccctgtgtctctggtgctcacaacactatagtaacagcaagggcaggaaaggacctagtttccagccttgtctcaggcttgctcacaattggtccccggtttggaggcgccattgatgatgcttctcggtacttcaaggatgcttatgacaagggtctaacaccctacgagtttgttgaaggcatgaaaaagaaggggattcgtgttccaggtatcgggcacaggatcaagagaggggacaacagggataaaagagtagagcttctacaacggtttgctcgcacacatttcccttctgttaagtatatggagtatgctgttctagtcgaaacctacactctttcaaaggccaataacttggtccttaacatcgatggcgcgatagggtcccttttcttggatctccttgcaggtagcagaatgttcactaaaccagagattgatgagattgttgggattggctatttgaatgggctctttgtgttggcacgttccattggtttgattgggcacaccttcgaccagaagagattgaaacaacctctataccgtcacccatgggaggatgttctctacaccaagtgagagacttacagatagcaggtgcaatgcttacctgctctgcacaagccttttctttttcaaatttctgttcagttgttagattagtgttgcactgcagctaggtgaagcgtgccattgtgtacaaagtagactcttatcatttatcaaacagatgtttctataaggcctaagctttgggtatcgaggaggaataataacagagttgctgggatttagaagcaaagaatatagttaaccatcaccctaatgtatgggaatttgtcagttcttgttattccctttggattgtttggtcaccttctcttgttgtgggatgctaataaaggaaatgaaattagggttctttttttttt

SEQ ID NO: 2582 - DNA, 2167 bp, Populus trichocarpa
ggccagtttggtgttttgtacactatggcgacaggacaactcttctctcgaacaacacaagctttgttttacaattataagcagctgcctattcaacgcatgcttgattttgattttctatgtgggagggaattaccttctgtagctggaattattaaccctggcgctgaggggtttcagaaactctttttcggtcaagaggaaattgcaatccctgtgcattcgactgttgaggcagcttgcactgctcacccaactgctgatgtgtttatcaacttcgcatcattcagaagtgcggctgcttcatccatggctgctctgaagcagccaactgttcgagttgtggctatcatagctgagggtgttcctgaggcagacaccaagcaattgattgcatatgctcgggctaacaataaggttgtcattggtccggccactgttggaggcattcaagctggagcattcaagataggtgaaactgctggaacaattgataacataattgcttgcaagctttaccggtctggatctgttggatttgtctccaaatccggtggcatgtctaatgagctgtataacgccattgcccgtgtaactgatggaatttatgaaggtattgcaattggaggagatgtgttcccaggatctactctttctgatcatgttctgcggttcaacaacatcccacaggttaaaataatggttgtacttggggaacttggtggacgagatgagtattctctagttgaagccttaaaacagggaaaggtaaacaaaccagtggttgcttgggttagcggaacttgtgcacgactctttaaatcagaagtacaatttggtcatgctggtgctaaaagtggtggtgagatggaatccgctcaagcaaaaaatcaagcaataaaagatgccggagctgttgttcccacttcatatgaagcttttgagactgcaattaaggaaacatttgagaaactggttgacgaaggaaagattacacctgtaaaggagtttacgcctccacaaatccctgaagatcttaacattgcaatcaagagcggaaaagtccgggcaccaacccatattatttctaccatctctgatgaaagagggacgttcaaccaatgcttcctgagtgaggaaccgtgctatgctggcgtgccaatgtcttccattgttgaacagggttatggtgtgggtgatgtcatctctcttttatggttcaagcgcagccttccacgttactgtacccattttatggagatatgcatcatgttgtgtgctgaccatggtccctgtgtctctggtgctcacaacactatagtaacagcaagggcaggaaaggacctagtttccagccttgtctcaggcttgctcacaattggtccccggtttggaggcgccattgatgatgcttctcggtacttcaaggatgcttatgacaagggtctaacaccctacgagtttgttgaaggcatgaaaaagaaggggattcgtgttccaggtatcgggcacaggatcaagagaggggacaacagggataaaagagtagagcttctacaacggtttgctcgcacacatttcccttctgttaagtatatggagtatgctgttctagtcgaaacctacactctttcaaaggccaataacttggtccttaacatcgatggcgcgatagggtcccttttcttggatctccttgcaggtagcagaatgttcactaaaccagagattgatgagattgttgggattggctatttgaatgggctctttgtgttggcacgttccattggtttgattgggcacaccttcgaccagaagagattgaaacaacctctataccgtcacccatgggaggatgttctctacaccaagtgagagacttacagatagcaggtgcaaaatttctgttcagttgttagattagtgttgcactgcagctaggtgaagcgtgccattgtgtacaaagtagactcttatcatttatcaaacagatgtttctataagaataacagagttgctgggatttagaagcaaagaatatagttaaccatcaccctaatgtatgggaatttgtcagttcttgttattccctttggattgtttggtcaccttctcttgttgtgggatgctaataaaggaaatgaaattagggttctttttttttttc

SEQ ID NO: 2583 - DNA, 2447 bp, Aristolochia fimbriata
agctaactaacatgcgccacgtgatccgcttacctccctgttcttcttcttcttctctctcaggtagctggcgtgtttagaattaagttttactgtctgcgtctataaatgccccctccgctccgagatttctgcgagcctggttcgtgtatctcccacggatttcattgaacgggcgcttcctaccgcgcctcgccttattaacggaaaaaaccgagttcctgattcaggtttgcattgtttcaccgcaaacaagatggctacaggacaattattttcacggaatacccaagcattgttctacaactataagcaacttcctatccagagaatgctggattttgatttcctctgtggaagggaaataccatctgttgctgggattattaatcctggtgctgaggggttccaaaaactattttttggtcaagaggaaattgctataccagttcattcaagcattgatgcggcttgtagtgcacatccaactgcggatgtcttcatcaactttgcttcatttagaagtgctgctgcttcttccatggctgcattaaagcaaccaaccatccgggttgtggctatcatagctgagggtgtccctgaatctgataccaagcaattgattgcatatgcacgttccaacaataaggtggttattggccctgctactgtgggaggcattcaggctggtgcctttaaaattggggacactgcaggaaccattgacaatattatccagtgcaaactattcaggcctggatctgtgggatttgtttccaaatcaggtggcatgtcaaatgaactatacaacacaattgcacgtgttactgatggaatatatgaaggcatagcaattggaggagatgtttttcctggctccactctctctgatcatgtcctacgtttcaataacataccacaggtcaagatgatggttgtgcttggagagcttggtggacaagatgagtactcccttgttgaagcactgaaacaaggaaaggttcagaagccagttgtggcatgggtcagtgggacatgcgctcgccttttcaagtcagaagtgcaatttggccatgctggtgccaaaagtggtggtgaattggaatccgcacaggccaaaaatcaagcactaagaggagctggagctgttgttcctacttactttgaggcatttgaggatgcaatcaaagagacatttgagaaacttgtatgataatcttgttcttcagaattataagtgacaatgagattgtacagaggttggttttgaggtgaaaattaacctaccatacatttgttcattttaggttgacgaagggaagattagccctgtttctgaagtgaaacctccccagatccctgaggatcttaattttgcacttaagagtgggaaggttcgggctccgacacatataatctccaccatttcggatgatagaggggaggaaccatgttattctggtgtcccaatgtctactattgttgagcgtggctatggagtgggggatgttatctcccttctgtggtttaagcgtagtctaccgcgttattgtacacagtttattgagatttgtatcatgttatgtgctgaccatgggccttgtgtgtctggtgctcacaataccatagtcactgccagggctgggaaagatctcgtctccagccttgtctctgggttgctgacaattggtccccgatttggtggtgctattgatgatgctgcccgctatttcaaggatgcttacgacagaggtctttcggcttatgaatttgttgagagtatgaaaaagaagggtatccgtgtaccaggaattggccacaggatcaagagaggagacaatagagacaagagggtcgagctgcttcagaagtatgctcacacgcatttcccatccgtgaagtacatggagtatgccgttcaagttgagacatatacactatccaaagctaataacttggtcctcaacgttgatggtgcgatagggtctcttttcttggatctccttgcaggcagtggtatgttcagcaagcaagagattgacgaaattgtggagatagggtacctaaatgggctctttgtactggctcgctccatcggtcttatcggccataccttcgaccagaagagattgaagcagccactgtaccgtcacccttgggaagatgttctgtacaccaagtgaaaaaatctttgtatgtgctgaagcactcgtcgtgaattttgtattggaaagctattgatccggcgtttgtactgctcatagttggtggttatttttattagaaactgaatggataattccttaatattaatcataattaatgttaagtgattataaaaatgtttttaggcttcttgcctcttggtgtgtgataacaatgctgttttatagacactaaaagaagtgccagaggcatggtttcgagccgcctcagctgcctttaac

SEQ ID NO: 2584 - DNA, 2143 bp, Artemisia annua
agaacacagtctctctcattacatacaaaaacccacaaacacacacatttgacgtgtttcaacaaactctcacccaaaggtgtttttgagagagcaccgatggcgacaggtcaacttttctcccgtacgacgcaagcattgttttataactataaacaattaccaattcagcggatgcttgattttgacttcctatgtgggagagaaacgccttcagttgcggaatcattaaccctggtgccgagggatttcagaaactattttttggtgctattccagttcattcaactatcgaagcagcttcagccgcgcatcctacagctgatgtattcataaactttgcatcatacagaagtgctgctgcttcatccaatcttgctctcaaacagcctacaatcagagttgtggctattatagctgagggtgttcctgaatctgataccaaggaattgatcgcgtacgcaagatcaaacaacaaggttgttattggcccagcaactgtaggtggtattcaagcaggagcttttaagattggtgacactgcaggaacaattgataacattatacaatgcaaactttacaggcctggatctgttggatttgtctccaaatctggtggcatgtcaaatgagttatacaatacaattgcccgtgtgacggatggaatttatgaaggtattgccattggaggagatgtttttcccggctctactctttccgatcatgttttgcgattcaacaacattcctcagatcaaaatgattgttgtgcttggggaacttggtggtcgagatgagtactccttagttgaggcccttaaagctggaaaaatcagtaaaccagtatgcgcatgggttagtggaacctgtgcccgtctcttcaagtctgaagttcagttcggtcatgcgggtgccaagagtggtggtgaaatggagtctgctcaagcgaaaaaccaagcacttatggatgcaggggccgttgtcccaacatcatatgaagcattcgaaacttcaatcaaggaaacttttgcgaaattggccgatgagggcaagattagtcccgttaaggagatcacacctccacaaatccctgaggatcttaacaccgcaattaagagtgggaaagtacgagccccaactcatattatttcaaccatatctgatgatagaggcgaagagccatgctcaatgtcctcgattgtcgaaaaaggaatgggggtcggtgatgtaatttcacttttagtcttcctcgctactgcacacaattcattgagatttgcatcatgttatgtgccgatcacgggccttgtgtatccggtgctcacaacacaattgtaactgcaagggcaggaaaagatcttgtatcgagccttgtttctggtctgttgactattggtccacgttttggtggtgccgttgatgatgctgctcggtacttcaaagacgcttacgataggaaacttacaccatatgaattcgttgaaagtatgaaaaagaagggtattcgtgtgccaggaattggtcacaggatcaagagaggcgataaccgtgataagagagtagagctactacaactatttgctcgcacaaacttcccatcaacaaagtacatggaatatgcagttgaagtagaaacctacactctttcaaaggcaaacaacttagtgatgaacgttgatggtgccattggtactcttttcatggatcttttagccggtagtggaatgttcaccaaacaagaaattgacgagattgtcagcatcggctaccttaatggtctctttgtcttggcccgctccattggtctcatcgggcatacatttgaccagaagagattgaagcagccactataccgtcacccatgggaagacgttctttacaccaagtgatttgtgttgtaattcaccattgttggccggcctcggcttcttaccagaagcagatggttgattgccatttgtctgtttgtatcatttagcgtaaagcttatggtctatatttctattgttacatggatgagcacgtttcagaactttagaagaaataacacaattgcggaacattgttgtgcattatcttttacttactatgtttttgtagctgttaatgtaatgtttttcttatgttgaatgaatatcacgttt

SEQ ID NO: 2585 - DNA, 1930 bp, Lactuca sativa
  misc_feature (1210)..(1210): n is a, c, g, or t
  misc_feature (1228)..(1228): n is a, c, g, or t
  misc_feature (1255)..(1255): n is a, c, g, or t
  misc_feature (1267)..(1267): n is a, c, g, or t
  misc_feature (1291)..(1291): n is a, c, g, or t
cgggaaatatttatgtcgaatcactgaatccatgaccccatatctccaattcctcttatatatatagcacacccgttggtattcttcacacttcattgctcgtctcgataaacccactcacgcatttgacgtgtttcaacaaattcttacataccaaggtgtttttgagcaagcaccgatggcgacagggcaacttttctcccgtacaacacaagctttgttctataactacaagcagttgccaattcagcgcatgcttgatttcgacttcctttgtgggagagaaacaccttcagttgctggaatcattaaccctggtgctgagggatttcagaaactattttttggccaagaagagattgcaattccagttcattccacagttgaagctgcttgtgctgcgcatcctactgcagatgtatttataaatttcgcatcctacagaagtgctgctgcttcatccaatcttgccctcaaacaacccaccatcagagttgtggctattatagctgaaggtgttcctgaatctgacaccaaggaattgattgcatacgcaagatcaaacaacaaggttgttattgggccagcaactgttggtggggttcaagctggagctttcaagattggtgacactgcaggaacaattgataacattattcaatgcaaactttacaggcctggatctgttggatttgtctccaaatctggaggcatgtcaaatgagctgtacaacacaattgcccgtgtcacggatggactttatgaaggtattgcaattggaggagatgttttccccggttctactctttcggatcatgttttgcggttcaacaacattcctcagatcaaaatgattgttgtgcttggggaacttggtgggcgagatgagtactcgttagttgaagctcttaaagcgggaaaaatcaataagccagtatgtgcttgggtcagtgggacttgtgcccgccttttcaagtctgaagtccaattcgggcatgcgggggctaaaagtggaggtgaaatggagtctgcacaagctaaaaaccaagctctgatggatgccggtgccattgtcccaacatcatatgaatcatttgaagcctccattaaggaaacattcgccaaattggcggaagagggaaagattagccctgtcaaggagatcacgcctccccaaatcccagaggatcttaactctgcaatcaagagngggaaagtacgagcaccnactcatattatttccaccatctccgangacagaggtgangagccatgctatgctggcgtaccnatgtctaccattgttgaaaaaggaatgggggtcggtgatgtcatttcacttttatggttcaaacgcagtcttccccgctactgcacacaattcatcgagatttgtatcatgttatgtgccgatcatgggccgtgtgtctccggtgctcacaacaccattgtaaccgctagggcaggaaaagatctcgtatccagccttgtttccggtttgttgactattggtccacgtttcggtggtgctgttgatgatgctgctcgatacttcaaagatgcttatgataggaaactttcaccatatgagtttgttgaaagtatgaaaaagaagggtattcgtgttcccggaattggtcacaggatcaagagaggggacaacagagataagagagtggagcttctacaactattcgctcgcacaaattttccatcaactaagtacatggaatacgcagttgaagtagaaacttacactctctcaaaagcaaacaacttagtcatgaatgtcgatggtgccattggtacccttttcttagatcttcttgcgggcagcggactcttcaccaaacaagaaatcgacgacattgtcaacatcggttacctaaacggtctctttgtcttggcacgttccattggtctcatcggg

SEQ ID NO: 2586 - DNA, 2413 bp, Physcomitrella patens
gaaactttataattctgaaggcgcgtcgaggtttggctgcattcctgttgcgggacttgactagattgcattcctctgtgcagcttcccgcaccgtctcgcgtcgtagcttgcagatccggatctccttgaggcgtggtatttgaagtggcggtatcgcttaggcggttttgttgaggagtttgaagagttcgaaccgcgttggttcctcagccccgcgggggttacgtactttaagtgccatggcaacggggcagttgttctcgcgtacaacgcaggccctgttctataactacaagcccagtcctgtgcagcgcatgctcgatttcgacttcctgtgtggaagagagactccttctgtggctggtgtaatcaacccaggatctgatggtttccaaaagctcttttttgggcaagaggaaattgcagtccccgtgcatggcagcattcccagtgcttgcaaaattcacccgacagcagatgtttttatcaacttcgcatcttttcgcagtgcttatgcatcatccatggaagctctgaagcaaccaactatcagggtggttgcaatcattgccgaaggagttcctgaagcggacgccaagagacttatagcttttgcccgtgcgaacaataaggtcgtaattggccctgccacagtaggtggcattcaggctggtgcattcaaaattggtgatacagccggcacattggacaacatcatccactgcaaactttacagacctggatccgttggatttgtatctaaatcaggaggtatgtcaaatgagatgtacaatgtccttgctcgtgttacagatggtctatatgaaggcatcgccattggtggagatgtctaccctgggtccacgctttcagatcatgtgttgcggtttaacaacattccacagatcaagatgattgttgttttaggagagttaggagggagggacgaatattccctagtcgatgctctgaaagagggcaaggttggtaagccagtagtggcttgggtcagtggcacatgtgcccgactcttcaagtccgaggttcagtttggccatgctggtgccaagagtggcggtgatgaagagtctgcacaagctaagaataaagctttggctgatgctggagccattgtaccaacttctttcgaaggtttagaggccactgtcaaagctacgtatgactcactggtggacaagaaggtgattatcccagtcaaggatttcgttccacctacagtcccagaagacctcaactcagcaattaagagtggaaaagtacgggcgcccactcacattgtgtccaccatttgtgatgacagaggtgaagagcctacatatgcgggtgtgccaatgtcaacaatcattgaaaaggattatggtgttggtgatgtcatttcactcctttggtttaagcgcagtttgcctcgatactgcaccaagttcatcgagatgtgcgtcatgctctgtgctgaccatggtcccgctgtgtctggagctcacaacaccattgtcactgctcgtgcaggaaaagacttggtttcgagtcttgtatctggactgctcacaattggcccccgatttggtggagctatcgatgatgctgctcgttactttaaggaagctcatgacaagggcttgacaccttatgactttgtggagagcatgaaaaagaaaggaatccgagttcctggaattggccacagaatcaagagccgtgataacagggacaagagagtggagcttttgcagaagtatgcacgcacgcaattccccaatgttaagtacatggaatacgctgtaacagtagagacgtacacactgagcaaagcgaacaacctcgtgctaaatgtcgatgggtgtatcgggtctctcttcctggatctgctatcaagttgcgcaatgttcactccccaggaaattgatgaaatcatcgagattgggtaccttaatggactttttgtcctggcaaggagcatcggtctgattggtcacacattcgatcagaagcgtctgaagcagcctctgtaccgtcacccgtgggaggatgttctgtacactaagtacacgtaaatttatatcaagctcaaagcatggtaaggattcatttgtgcctgtagtgcttaccgatcagcaaaatttcttatccaagcagctcttttcaccatttaatagtagcccttagaatgggatacgtattgcaagacgttaattctttcagggcttcaataggtaagccctgaccaagtccagagtcgagagaattcggatttttagaggatttgtggttccgtcgccactcattcatttgccaggggcttgatcagtactttcaaatgaccctccatttgctctcatattctaatttataaagaggcaaccttcatagtgttaattgtatcgtttttctct

SEQ ID NO: 2587 - DNA, 2384 bp, Ceratodon purpureus
ggacggtcttcgctcggactccgcgtcgcagctccatcgccatcgcctggcgtcccacgcatccccgcattcgccccgctcgccccagatctcgccgtcccatctcgccacctttccaacgagatctggttgaggtcgtggtgctggaggacgaggacgtaggctgagagggttatttggaggtggaggagtttgagttcgtagcgcggggagcgccatggcgacggggcagttgttctcgcgctcaacgcaggctctgttttataactacaagcagagtccggtgcagcgcatgctcgatttcgacttcctttgtggaagagagacgccatctgtggctggtgtgattaacccgggttccgatgggttccagaagcttttctttggacaggaggaaatcgctattcctgtgcacggcagcattctttctgcctgcaagctgcatccaacagcagacgttttcatcaacttcgcatctttccgcagtgcctatgcttcatccatggaagctctcaagcagccaacaatcagagtgatcgcaatcattgctgaaggagttcctgaagcagatgcaaagagacttattgcgtatgctcgtgcaaataacaaggtcgtcattggccctgctactgtaggaggcattcaggctggtgcattcaaaattggtgatacagcaggcacactggacaacatcattcactgcaaactttacagacctggctctgtaggatttgtgtccaaatctggaggcatgtcaaatgagatgtataatgtcctcgctcgtgttactgacggcctctatgaaggcattgctattggtggagatgtctaccctggatccaccctttcagatcatgtgttgcgcttcaataacattccacagataaaaatgattgttgttctgggagagctgggagggagggacgagtactctctggttgacgccctaaaacagggaaaggttagcaagcctgtagtggcttgggttagtggcacttgtgccactcttttcaagtcggaggttcaatttggccatgcgggtgccaaaagtggtggtgatgaagagtctgctcagactaagaataaggctttggctgatgccggagctattgtgcctacatcctttgagggtttggaagccactatcaaagctacgtatgactcactggttgagaagaaggttattaccccagttaaggattttgttccaccgacggttccagaggacctcaatgctgcaatcaagagtggaaaagtgcgggcgcccacacacattgtgtccaccatctgtgatgatagaggtgaagaaccaacgtacgcgggtgtgccgatgtccacaatcattgagaaggattatggtgttggtgatgtcatttctctcctttggttcaagcgcagtttacctcgatactgcactaaattcattgagatgtgcatcttgctctgtgcagaccacggtcctgctgtgtctggagcacacaattctattgtcactgctcgtgcaggaaaggacttggtctcatgtcttgtatctggtttgctcacgattggccctcgtttcggtggagctattgatgatgctgctcgctatttcaaggatgctcatgataagaaattgtcaccttacgagtttgtggagagcatgaagaagaagggcattcgagttcctggaattggccacaggattaagagccgtgataacagggacaagagagttgaattactacagaagtacgcacgtacgcattttcctaacgtgaagtacatggaatatgctgtgactgtggaaacttacacattgaccaaagcgaacaacctcgtgctgaatgtcgatgggtgcattgggtctctcttcctggatcttctgtcgagttgtcaaatgttcaccgcacaagaaatcactgagatcattgagattggttatcttaacggactttttgttcttgcaaggagcatcggtcttattggacacactttcgatcagaagcgtttgaagcagcctttgtaccgccacccatgggaggatgttctgtacaccaagtacacataggttcagaacaagctgaggcctgtcaagggttcttagtgtgcatctagtgcttacaatcagcaacaattttcctatcttgtcttacagcagttatgtacacaaaatgggacaacaccgaatgcctatctttcagggcttcaattggtcagccccgacgaggtttattcttccaggcccagtagtacaggttctagaaagctggctcttccctgtggtcagccatagtttatttttcttcacattatttctatttgcccatcaccaagggcttggtcaccactgttacatgacttaccatttgtagtcaattattttaacattgataaagaaccag

SEQ ID NO: 2588 - DNA, 4651 bp, Physcomitrella patens
aagagttcccaccagtcgtctgcctcgttccccatgcccacgctttgctagtctcctctgctccgcttgtcctcctcgctcgctgaggcttttaactctgcattcgcgtggaaagtcttcgcagtccgctcccgaggcttatgaacatcgcctctcgggctcacttgacgtctccagtcggacggtgtttttgtgtatgctgttgcgtctttgggagagctttcgagcgaggtgagaagtggatagtgtggtgcaatacggagggaattagacggggaggacatcgggttttggtggtttgagagctgcaggggaaagcgttgttgcggagtacaaatgagtcaatgcggagttgttctttcatgcagttgagcttcttctttgcttttcttttttccttcttgaaggaaattcggtgaatgtagcggttgaagatttggtgcagcgttgaggcctgtggttgtgaatcttgtctattttctggcactcagggaagggctaggcttgtaggatttaagcggaaggatttgaagggtccggagcttgttgtttacacggtcccgtgaagagaagacgatttgagcgccatggcgactggacagttgttctctcgcacaacgcaggccttgttttataactacaagcagagtccggtgcagcgcatgcttgatttcgatttcctttgcggaagggagacgccatctgtggctggtgtgatcaacccaggatctgatggttttcagaagctctttttcgggcaagaggagatcgctgtacctgtccatggcagcattccatctgcgtgcaaagttcatccaacggcagatgttttcatcaactttgcatcttttcgcagtgcttatgcttcatccatggaagctctcaagcagtcaacaatcagagtggttgcaatcattgctgagggagttcctgaagcggatgccaagagactcatcgcttatgctcgtgcaaacaacaaggtcgtcattggcccagccactgtaggaggtatacaggctggtgcattcaaaattggtgatactgcaggcacgttggacaatatcattcactgcaagctttatagacctggatctgttgggtttgtgtctaaatcagggggtatgtcaaatgagatgtacaatgttcttgctcgtgttactgacggcctctacgaaggcattgccattggtggtgatgtctatcctgggtcaacgctttcggatcatgttttgcgcttcaacaacattccacagatcaagatgattgttgtcttgggagagttgggaggaaaggatgaatactccctagttgatgctttaaaggaaaagaaggtcagcaagccagttgtggcttgggttagtggcacatgtgctcgacttttcaagtctgaggttcaatttggccatgctggcgcaaagagtggtggagatgaggagtctgctcaagccaaaaacaaagctttggctgatgctggagctatcgtgcctacttcttttgagggtttggaagctgtagtcaaagctacgtatgactcaatggttgagaagagcgtcatcatcccagtgaaggatttcatacctcccactgtcccagaggacctaaatgcagccatcaagagtggaaaagtgcgggcacctacacacattgtgtctactatttgtgatgatagaggtgaagagccaacatatgccggcgtggcaatgtccacgattattgagaaggattactgcgttggtgacgttatttcactgctttggttcaggcgtagtttgcctcgctactgtactaagttcatcgagatgtgcataatgctctgtgcagatcatggccctgctgtgtctggagcacacaacactattgtcactgctcgtgcaggaaaggacttggtatcaagtcttgtgtctggtcttctcacaattggccctcgttttggtggagctattgatgatgctgctcgctattttagagaagcccatgacaacggattatcgccttacgcatttgtggaaagcatgaagaagaagggtatccgtgttcctggaattggccacaggatcaagagtcgagataacagagataagagagtggagcttttgcaaaagtacgcacgcacgcaattcccaaatgtgaagtacatggaatatgctgtgacggtggagtcttacacattgacgaaagcgaacaacctcgtgctcaatgttgatgggtgcattggagcccttttcttagacctgttgtctagttgtgcaatgttctctaagcaagaaattgacgaaattatccagatcggttaccttaatgggctttttgttttagcaagaagcatcggcttgattggacatacattcgaccagaagcgtctgaagcagcctctgtaccggcacccatgggaggatgtgttgtacaccaagtacacataaattcataacacgatctagtagaggatctaaatcttattagagtgattcttggtcggctacaattttagtggctgatcttgtggaaacaccatttagctgtagcaatgcacaaaatatttgagatcacataatgtacctactttttcagagcttcgtatgtacctgctcgataaattccatcacctgggtacaggaacctgccttccgcaacaaactattatttttttgccacactatgttctgtaccactcgaccgtcaagcactccatcagcattgtagcagaacacgtcatttgtagtcatctatgaattagtgaagtagcagtatagatgaagacatacaatctggtgagcaaggtagtttgccaagatgacgttctggcgtcaattgtaactaatatgtagtcatcaagagtattaaatccaccgcattcaagatattatctgtagtggatattttcacgctctgcaccgggaaaagatcttggtctagggcttgaacccccagacaacatcaacgtttagactgaacatcaatcccttttgttacttgacattgaaactcactgcagatgccagcaaaccaacgtgcctgccatggttgtctttccagcgtcctataatcaaccagtgggacaagccccgatctatgacgtcttcagctaaggaatcttgtcacttgaaatttacctcgatgagtccactacacctggagtaacgaaataactgaatttcaacattgttacctgaaattagttacgagtaacccattcaatcgctcatgggaggtagcccacatagagaatgaattttggaggcaattgttgccacctgcttaggtgtgtattgcgtgccaaaacctggtaaatgcttggcagcaacttttcggtcgaagtaaaattccccattttgaagctttgcgcgtggttgcaacgccaaccaagtaattgtatctgctccttcatttaagaacctcagtgatttttgaaaggttgagtggaagtcgggcatgcttttcttcaagcccccagtatcaacccaacctggatgcatagagtagaatccaacagcgtctttatgcttctgaacccagtactctgttaatgcgacctgcacgcgcttgttgcgcgcatattgagtcgttccatcaaaaacattcttgtcctcgtactgcagattttcattgaggttttcagttaacatgcccccagatgaaactgttatcacacgagactcgggtgaagctcgtttcaatgcaggcatcaagagttccgtcatagcatacacaccagcaacgttcactgcgaaatttgtctccaacccatccacagtttgagtgcgctcggtttccattaaccctgcattgttcaccagtatgtgaagaggtcgaccagatgatgtgtattcagcagcaaagtctttgacttgctgtagcgatgacaaatcacagacctgaagggacacatttgggttcccagttttggccttgatctccccaacagccttctcccctttctccttcgatcgacacaccaagtgcacggttgcgcccctggccgcaagtgcttctgcagaggcatatccaatgcctgtattggcacctgtcaccaggcactgtttgtctgttaagtccactgccatttcctgatccttaaactccttctggtgcttcaggaaagatccccgagtccagttcatgtatccataggagacgaaggtagcagtcttgtatgcctgccgcagaaacattgctacagcgcagaagaattgatgatcacgaggggctgaaccagcgatccaagcatagaaacaaaccctacaccaaacccaagcctctttcacaagcaagcctaatttcaaatgctgtcaatctggcctttcgttcgatctccttgagcgaacaagggcaaaacccaaataagatcaggatgaagcagcaataacaacgacgcaggattaaagttgcgatctttccaggtatggtgttgaggaatccccgagggtaacttcacgactccgacaatttccaaaaggtgacgatgtgatgtgtggggtccaggcaggtaaattgcaaaccaggggatggacctcagcctcgccacaggaggtggcttcacatcttacgagcaccaattgtcaattgcgtcgccgaccatgatctagacaaagcaatatcgtcgtcgtcgtcgtcgaggccacactttgaacgctgcgccttcgacaccaccact

SEQ ID NO: 2589 - DNA, 1826 bp, Carthamus tinctorius
  misc_feature (828)..(829): n is a, c, g, or t
  misc_feature (1318)..(1318): n is a, c, g, or t
  misc_feature (1355)..(1355): n is a, c, g, or t
  misc_feature (1760)..(1760): n is a, c, g, or t
ggcggggatcttcgtctcaagaactcctcacacatttgacgtgtttcaacagattcttacatactctggtatttttgagtgagcccaatggcgacagggcaacttttttcccgcacgacacaagcgttgttctataactataagcaattaccaattcagcggatgcttgattttgactttctttgtgggagagaaacaccttcagttgctggaatcattaaccctggtgctgagggatttcagaaactattctttggccaagaagagatcgccatcccagtacattcgactgtcgaagctgcttgtgccgcacatcctactgccgatgtatttataaattttgcatcatacagaagtgctgctgcttcatccaatcttgccctcaaacaacccacaatcagagttgtggctattatagctgagggcgttcctgaatccgacaccaaggaattgattgcgtacgcaagatcaaacaacaaggttgttatcggccctgcaactgttggtggtattcaagctggagcttttaaaattggtgacactgcaggaacaattgataacattattcaatctaaactttacaggccaggatctgttggatttgtctccaaatctggtggcatgtcaaatgagttatacaacacaattgcccgtgtaacagatggaatatatgaaggtattgctattggaggggatgtttttcccggttctactctttctgaccacgttttgcggttcaacaacattcctcaggtgaaaatgattgttgttctgggagaacttggtggtcgagatgagtactccttagttgaagcccttaaagccggnnaaatcagcaaaccagtttgcgcttgggtcagtggaacttgtgccggctcttcaagtctgaagttcaatttgggcatgcgggggccaagagtggtggtgaaatggagtccgcacaagctaaaaaccaagcacttcaggatgctggggccattgtcccaacatcatacgaagcattcgaagtttcgatcaggaaacattcgagaagttggccgaggagggcaagattagtcccattaaggagatcacacctccacaaatccctgaggatcttaacagcgcaatcaagagtggcaaagtacgagcaccgactcacattatttcaaccatctccgatgaccgaggtgaagagccatgctacgctggcgtaccaatgtctacgatcgtcgaaaaaggactggggattggtgacgttatttcgcttttatggttcaaacgcagtcttccccgctactgcactcagttcatcgagatttgtgtcatgttatgtgcngatcacgggccgtgtgtttccggtgctcacaacacgntcgtaactgcaagggcaggaaaagatctcgtatccagccttgtttccggtttgctgactatcggtcctcgttttggtggtgccgttgatgatgctgctcgctacttcaaggacgcttacgataggaaactttcaccatatgagttcgttgaaagtatgaaaaagaagggtattcgtgttccgggtattggtcacaggatcaagagaggtgataaccgagacaagagagtcgagctgctacaactatttgctcgcacgaatttcccatcaaccaagtacatggaatacgcagttgaagtagaaacctacactctctcaaaggcaaacaacttagtgatgaacgttgacggtgccattggtacccttttcttggatcttttctgcggtagcggaatgttcacgaaancagaaattgatgagatcgtcgcgatgggttaccttaacggctcttcgtgttggcccgttccatggt

SEQ ID NO: 2590 - DNA, 1713 bp, Zea mays
tttgcatccttccggagtgctgctgcttcttcaatgtcagctttgaagcagccaacaataagggttgtagccattatcgctgagggtgttcctgaatcagatgcaaagcagctaattagttatgcacgtgctaataataaagtcatcattggacctgcaacagttggaggaattcaagctggtgctttcaagattggtgatactgctggaaccattgataacataattcagtgcaagctttacaggcctggatctgttggttttgtgtctaaatcgggtggcatgtcaaatgagatgtacagcaccattgccagagtgacagatggtatttatgaaggaattgcaattggaggggatgttttccctggatcaactctgtcagaccacattctgcgttttaataacataccacaggttaaaatgatggttgttcttggggagcttggtggaaaagacgagtattcacttgtggaagcattgaaacaaggaaaggtccagaaaccagttgttgcatgggttagtgggacatgtgcacgtctattcaaatcagaagtgcagtttggtcatgctggtgccaagagtggtggtgagttggaatcagcacaagctaagaatcaggcactaagggaagctggtgcagttgtgcctacatcatatgaagctctagagagtgcaattaaggaggtatttgacaaactggttgaggaaggaaaaatttctcctgtgactgaaattacacctcctcccattcccgaggaccttaaaactgcaattaagagtgggaaggtccgagctcctacccacatcatttccaccatctccgatgacagaggcgatgaaccatgctatgctggtgtccctatgtctacaattattgaacagggttatggagttggtgatgttatttctcttttgtggttcaagcgcagccttcctcgctattgcactcagtttattgagatatgcgtcatgctttgtgctgaccatggtccctgtgtatctggtgctcataactctatagttactgctagggccggaaaggaccttgtttccagcttggtgtctggattattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttgagacctacaccttgtcaaaagccaacaatttggttatgaatgtcgatggtgcgatcgggtcccttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactttacaccaagtgagaaagccattctttgcaaggcataataaagtattattatcgcctagagcttccagttgcctgtacacttcattaaatcgagcacttgcaaaaaagaaagccagagagaggaagacgaacatcactagtcagcactaga

SEQ ID NO: 2591 - DNA, 2206 bp, Quercus alba
cattgattcaaccgccaccgccttaccaaaccaattccaacgaggcctttcactcaacccccgccccccttttcttctccgccaggtgtgtaaaggcctctttgactctacaccatggccactggacagctattttcccgcaccacacaagctttattttacaattacaagcaacttccgattcagcggatgcttgattttgacttcctttgcgggagggaaacaccatcagttgctggaatcattaaccctggtggcgatggatttcagaaacttttttttggtcaagaggaaattgctatccctgtgcactcagccattgatgcagcttgtgctgcacatcccactgctgatgtctttatcaactttgcatcatttagaagtgctgctgcttcatctatggctgctttgaagcaaccaaccattcgagttgtggctatcattgctgaaggtgttcctgagtcagacactaagcaattgattgcatatgcacgggcaaacaataaggttgttattggcccagcaactgttggaggaattcaagccggagcttttaagataggcgacactgctggaactattgataatataattcaatgcaagctgtacaggcctggatccgttggttttgtctccaaatctggtgggatgtctaatgaattatacagtactattgcccgtgtttctgatggaatttatgaaggtattgcaattggaggagatgtgttcccaggctctactctatctgatcatgttttgcggtttaacaacatcccacagattaaaatgatagttgtacttggggagcttggtgggcaagatgaatattccttagttgaagccctgaagcagggaaaagtaactaaaccagtggttgcttgggttagtggaacttgtgcacgactcttcaaatctgaagtacaatttggtcatgctggtgctaaaagtggtggtgacatggagtctgcacaaggcaaaaatcaagcactaagagaagctggagctgttgttcccacgtcatatgaagctttagaagctgcgattaaggaaacttttgagaaactggttgaaggagggaatattacagcagtaaaggaagttatacctccacaaatccctgaggatcttaacacagccattaagagtgggaaagttcgtgctccaactcacgttatttccacaatctctgatgataggggtgaggagccatgctatgctggtgtacctatgtcttccattgttgaacaaggttatggtgttggtgatgttatctctcttttatggttcaaacgcagccttccccgttactgcacaaaatttattgagatatgtatcatgttatgtgccgaccatggtccttgtgtctctggtgctcacaacactatagtaacagcaagagctggaaaggaccttgtttcgagcctagtctcaggtttgcttacaattggtccccgatttggtggtgccatcgatgatgctgctcgatacttcaaggatgcttatgacaggaatttgacaccttatgagttcgttgaaagcatgaaaaagaagggcattcgtgtaccaggaattgggcacaggattaagagaggtgacaacagagataagagagtagagctgctacaactgtttgcacgcacaaattttccttctgtgaagtacatggaatatgctgtgcaagttgaaacctacactctctccaaggcaaacaacctggtgctcaatgtagatggtgcaattgggtcccttttttttggatctccttgcaggcagtggaatgttcaccaagcaagagattgatgagattgttgagattggctatctgaatggactcttcgtgctggcacgctccattggtctgattgggcacacctttgaccagaagagattgaaacagccactataccgccacccatgggaggatgttctctacaccaagtgaaagcattttcaatttgctggaacagctccaacggtccaacctgcttttaagtagtaatttattgttcaagtttctacaattggctgaaatgatcgtctgtcgttagactagtgtttgtactttgtaccactaatgtcaggttaagtatcttcatttgtaagctgtatcaaaattcataagagtgaactctcaaaccaccttgttcaacgaagttacatttccattaagaaatcctgctttctgttttgtatcaagaagatataa

SEQ ID NO: 2592 - DNA, 1790 bp, Triticum aestivum
ggactggacaagttctgagccgttgctggtgcgcgctctttcctgacagcaatatgatgttcaagtttcttgttacagtgttgcggtagcagcattgagcaacggtggtaggtaggcggcagcggcactcctacctaaccctccccccttctaaagcggaaccaaggagcgacgattgtttgacttctccccaccagaatctgcacaggcagcaaaccagtaggcaactctccagcaatggctgccgctgcatcgtcgccctcccctccggcggtcatcacctgccgagcggcggtggcatgggggccggggcaggcgctggtgatggaggacgtggaggtcgccccgccggggccactggagatccgcgtcaaggtcgtctccacctccatctgccgcagcgacgtcacccagtggcagtccacggcgcagcccgatctgttccccagaattttcgggcacgaagcatccggggtggtcgagagcgtcggggaaggagtgaccgagttccaagtgggagaccacgcgctcaccgtcttcatcggggaatgcatgagctgcaagcactgcgtgtcggggaaaagcaacatgtgccagacgctcggtctggagaggaagggcgtcatgcacagcgaccagaccacccgcttctccatcggcgggaagcccgtgtaccattactgcgccgtgtcgagcttcagcgagtacgcggttgtccactcgggctgcgcggtcaaggtcagccccaccatgcccatggacaggatatgcctgctcagctgcggcgcgtccgcaggccttggtgcggcttggaatgttgctgatgtatccaaggggtcaagtgtagttatatttggtctgggaactgtaggactttcggtagctcaaggtgctaagctacggggagcttccaagattattggagtagataccaatcctgctaagcaagaaaaggggaaggcttttggtgttacagattttattaatcctgccgaattgaatgaacctgttcagcaggtagtaaaacggcttactgatggaggggctgattactcttttgaatgtgtgggtgataccggagtagtctcgactgcattgcaatcatgttctgatggatggggactgactgtaactcttggtgtaccaaaagcaaaaccagaagtttctgctcattatggattgcttctctctggaagaacactgaaggggtctttgtttggaggatggagacccaaaactgatatacctttgttagtggagaagtacgcaaacaaggaaatccaagttgatggccttgtcacacatgatatgccattcagtgacatcaacaaagcgcttgaactgatgctacaaaacaggtgtttgcgatgcgtgattcacatgccaaagtgacaggattgatttatacatcagtgccatcatacctgtacaattttggtggttttctcatcagtaatttttcacttgatctgctcctggctcgagttttcatgacaccaacatattgaagctccagtgtgattctctattggtgtctcaccttagagttatggtgttatagttgttgaggagattacaaatcatactgatattcccttggaattcctcatatgtccgacctcaagaattattcgtgtaatctaacttgttaaaaattgatctgttagtgattataatggtgtatgcatgttcggtgcattgtgcaatattgttctaatattgagcttcttgattgggatgaattatgtaaaattgaatgttctaaaaatgtaaacaaaatatttcttctt

SEQ ID NO: 2593 - DNA, 1811 bp, Triticum aestivum
ggactggacaagttctgagccgttgctggtgcgcgctctttcctgacagcaatatgatgttcaagtttcttgttacagtgttgcggtagcagcattgagcaacggtggtaggtaggcggcagcggcactcctacctaaccctccccccttctaaagcggaaccaaggagcgacgattgtttgacttctccccaccagaatctgcacaggcagcaaaccagtaggcaactctccagcaatggctgccgctgcatcgtcgccctcccctccggcggtcatcacctgccgagcggcggtggcatgggggccggggcaggcgctggtgatggaggacgtggaggtcgccccgccggggccactggagatccgcgtcaaggtcgtctccacctccatctgccgcagcgacgtcacccagtggcagtccacggcgcagcccgatctgttccccagaattttcgggcacgaagcatccggggtggtcgagagcgtcggggaaggagtgaccgagttccaagtgggagaccacgcgctcaccgtcttcatcggggaatgcatgagctgcaagcactgcgtgtcggggaaaagcaacatgtgccagacgctcggtctggagaggaagggcgtcatgcacagcgaccagaccacccgcttctccatcggcgggaagcccgtgtaccattactgcgccgtgtcgagcttcagcgagtacgcggttgtccactcgggctgcgcggtcaaggtcagccccaccatgcccatggacaggatatgcctgctcagctgcggcgcgtccgcaggccttggtgcggcttggaatgttgctgatgtatccaagggatcaagtgtagttatatttggtctgggaactgtaggactttcggtagctcaaggtgctaagctacggggagcttccaagattattggagtagataccaatcctgctaagcaagaaaaggggaaggcttttggtgttacagattttattaatcctgccgaattgaatgaacctgttcagcaggtagtaaaacggcttactgatggaggggctgattactcttttgaatgtgtgggtgataccggagtagtctcgactgcattgcaatcatgttctgatggatggggactgactgtaactcttggtgtaccaaaagcaaaaccagaagtttctgctcattatggattgcttctctctggaagaacactgaaggggtctttgtttggaggatggagacccaaaactgatatacctttgttagtggagaagtacgcaaacaaggaaatccaagttgatggccttgtcacacatgatatgccattcagtgacatcaacaaagcgcttgaactgatgctacaaaacaggtgtttgcgatgcgtgattcacatgccaaagtgacaggattgatttatacatcagtgccatcatacctgtacaattttggtggttttctcatcagtaatttttcacttgatctgctcctggctcgagttttcatgacaccaacatattgaagctccagtgtgattctctattggtgtctcaccttagagttatggtgttatagttgttgaggagattacaaatcatactgatattcccttggaattcctcatatgtccgacctcaagaattattcgtgtaatctaacttgttaaaaattgatctgttagtgattataatggtgtatgcatgttcggtgcattgtgcaatattgttctaatattgagcttcttgattgggatgaattatgtaaaattgaatgttctaaaaatgtaaacaaaattatttcttcttaatggatgggttatacatca

SEQ ID NO: 2594 - DNA, 1571 bp, Brachypodium distachyon
gacttctctccatcagaatctctgcaccggcagcaaaccagtacgcaaatctgctggaatggacgctgcgccctccgctccggcggccatcacctgccgagcggcggtggcatggggtccggggcaggcgctggtgatggaggacgtggaggttgccccgccgggggccatggagatccgcgtcaaagtcgtctccacctccatctgccgcagcgacgtcacccagtggcagtccacggcgcagcctgatctgttccccaggattttcgggcacgaagcatccggagtggttgagagtgttggtgaaggagtgaccgagttccaagtcggagaccacgcactcaccgtcttcattggggaatgcatgagctgcaagcactgtgtgtcggggaaaagcaacatgtgccaaaagctcggcctggagaggaagggtgttatgcacagcgatcagaagacccgcttctcgattggagggaaacctgtgttccattactgtgcagtgtcaagcttcagcgagtacacggttgtccactcgggctgtgctgtgaaggtcagccccactgtgccaatggacaggatatgcctactgagctgcggtgtgtcggcaggccttggtgcagcttggaatgttgctgatatatcaaaggggtcaagtgtagttatatttggtcttggaactgtaggactttctgtagctcaaggtgctaagctgcggggagcttccaagattattggagtagatactaatcctgataaggaagaaaaggggaaggcttttggtgttacagattttattaatccaggtgaactgagtgaacccgttcagcaggtaataaaacggcttactgatgggggggctgattactcctttgaatgtgtgggtgacaccggagtagtctcgactgcactgcaatcatgttctgatggatggggactgactgtaactcttggtgtaccaaaaacaaagccagaagtttcttctcattatggactacttctttctggaagaacactgaaggggtctttgttcggaggatggagacccaagtcggatataccttcgttagtggacaagtatacaaataaggaaatccaagttgatggccttgtcacacatgacatgtcattcagtgatatcaacaagggacttgaactgatgctagaaaacaggtgtttgcggtgtgtgattcatatgccccattgacatgattgagcaactacacatagtgctatcatcttatttttacaggtttggggtcatctcagtaatttccacttgatctgactcctggctcgagactctcacatcaccctctactcctgtagtggtgtttcacattggaaattctgatgatgttatcaagaagattacaatcttacaccgacatgtccttcagaccctcatatgtcctatcttatcccaagaactattcatgtactctatcttcttgcaagttgattttgtagtaatcctaatgttgtatgtttgagtttcttggtctgggatgaatcatgtaaagctgagtgatgaaaatatataaagcaaatcacatctacttattagtattgct

SEQ ID NO: 2595 - DNA, 1720 bp, Oryza sativa
ggtgctctggagaagccattgcacaatgatgttacagaggctgttttgagtcttcacaatgctggcgggtagcaactgtggtaggtagtgggagttcctacctacccctccctgtcttcctactaatttggtggtgcgcatcatgggttcaaggagcaatccggcggtttgacttctccgtccgcacctactctagcctttgttcagtggtacgaggcgccgcgcgagcctgccggaatggccgcggcgtcgtctccggcggcggccatcacctgccgagcggcggtggcgtgggcgcccggtcaggcgctggtgatggaggaggtggaggtggcgccgccggaggccatggagatccgcgtcaaggtcgtctccacctccatctgccgcagtgacgtcacccagtggcaatccacggctcaaaccgatctgttccccagaattttcgggcacgaagcatccggtgtggttgagagtgttggtgaaggtgtgaccgagttcgaagtgggagaccatgtgctcaccgtcttcatcggagagtgcatgagctgcaagcactgcgtttcagggaagagcaacatgtgccagaagctcggcctggagaggaggggtgtcatgcacagcgatcagaagacccgcttctcgctcagggggaaacctgtgtaccattactgtgcagtgtcaagcttcagcgagtacacggttgtgcactccggttgcgcggtgaaggtcggcccaaccgtgccgatggacaggatatgcctgctgagctgtggtgtatctgcagggcttggtgcagcctggaaggttgctgatatctcgaaggggtcgagtgtggttatatttggccttggaactgtagggctttctgttgctcaaggtgctaagctgcgcggggcttctataattatcggtgttgatactaatcctgaaaagcaagaaaaggggaaagcttttggtgtcacagattttattaatccagaagaattgaatgaacctgttcagcaggtggtgaagcggctgaccaatggaggtgcagattactcttttgagtgcgtgggtgatacaggagtagtgtcgactgcactgcaatcatgttctgatggttgggggctgactgtaactcttggtgtgccaaaagcaaagccagaggtttctgctcattatgcactacttctgtctggaagaacattgaaggggtctttgtttggaggatggagacctaaatctgatctacctttgttagtggacaagtatgcaaacaaggaaatccaagtcgatgaccttgttacacatgatttgtcattcgattacatcaacaaggcacttgaactgatgctagaaaacaagtgtttgcgatgtgtgattcacatgcctcagtgacagggttggacaactaagtgttatcgtatctctacaattttttcgctttatctcagtcgtgaagttttcatcagcaaatcagattatcacatcattctatgtttccaccttggaagttttgatgctgtctaactttgtgtacctatctcaagaattattcatgctatttatcttgctgtaaaattagtttgtaatgactgcaattttgtattgatgttccatgtataggccaagatctatcttcttccagagcttcctgcttcaaatgaatcatgtaaaactgaaggacagcgtaaaggaaatgaaattacattcactgattttcatccgtcaagtt

SEQ ID NO: 2596 - DNA, 769 bp, Hordeum vulgare
gtcctcctctctacagttaatacagtaccatggcccccgccgtgatggcttcgtcggctaccaccgtcgcacccttccaggggctcaagtccacagctggtctccctgtcagccgccgctccagcgccagcctcggcagcgtcacaatggcggaaggatcaggtgcatgcaggtgtggccgattgagggtatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgtttgggtgcaccgacgctacacaggtgcttaacgaggtggaggaggtcaagaaggagtaccctgacgcttacgtacgtatcatcggcttcgacaacctgcggcaggtgcagtgcgtcagcttcatcgccttcaggccaccgggttgcgaggagtccggcaaggcataaactacgaggtgaaagaatggcctatgtcgtatgaaggtcttttgtgaacttcacttttgtccacgactctgctttccgacgagagcataattttcttctctatgatctgtgtatgtacgagcataggttgtggagcatatatgcatatgtaaattctagcaccgcctacacatatacaacacctgtgtcatatttataatatacaacaagcggacc

SEQ ID NO: 2597 - DNA, 1445 bp, Triticum aestivum
tctctgatatatataatcctaagactcaatacatttttgttctagactcaacaacgattagtgattcgatcaagcagggggctcctaagtcggggatggctctgataccaacttgtaacactcacgatgcggctatatctaccacgtgtcgaggcacgacttagaggcataaccgcattgtggttttgtcgcaagaagggtcatcttcgcacaatcccatgtaatgaacaagaaagagataaagagggttggcttacaatcgccacttcacacaatacttaagtaattctacatcatccaaaatacacatgtagaccgactacagtcaaaaccaaatgaaaagaagataaccccaaatgctagatcctcgatcgtcccaactggactccactactgatcatcaggaaacaaaacatagtaacgaccaaggtcctcgtcaaactcccacttgagctcgattgcgtcacctgcactggtatcatcggcacctgcaactgagatcccgcaagtaagaagaacgagtccatgaagaagagaaacggatgtagtcgaacgaatcctgacaactccgaaacgaaaccgaagctaacaagagaagcaaactggaaagaagcaagcaacatggtaaacacacaagcataaaccctcgtgccgaattcggcacgaggggcatcctcctctcctccgataatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctttccgaccagagcatatttctcgttccatatgatctgtgtttgtacgaacataggttgtggagcatgcacggctacacatatacaacaccagtgtgatatttattatatacaacaagcggaccattgtcctgctgttaattctcggaaaa

SEQ ID NO: 2598 - DNA, 869 bp, Triticum aestivum
ggcatcctcctctcctccagttaatagaataccatggcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgacgcctatgtccgtgtcatcggcttcgacaacctgcgccaggtgcagtgcgtcagcttcatcgccttcaggccaccgggttgcgaggagtccggcaaggcctaaactacgagttgaaacaatggcctatctcgtatgaaggtcttttgtgaacttcacttttgtccacaactctgctgcacgactctgctttcggaccggagcataccttttgttctatatgatttgtgtatgtatgtacgaacataggttcttgagcatgcatacgtaattcctcataggtctatatgcaccggctacacatatgcaaaacctgtgtaatatttattatatacaacacgcggaccattgtcttgctgttattaattcatggaaaagtttctttatttggcactgcaatggatatgtctcacagc

SEQ ID NO: 2599 - DNA, 668 bp, Triticum aestivum
gcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgacgcctatgtccgtgtcatcggcttcgacaacctgcgccaggtgcagtgcgtcagcttcatcgccttcaggccaccgggttgcgaggagtccggcaaggcctaaactacgagttgaaacaatggcctatctcgtatgaaggtcttttgtgaacttcacttttgtccaccactctgctggacgaccagagcatatttttcattctatatggtctgtgtatgtatgtacgaacataggttctcgagcatgca

SEQ ID NO: 2600 - DNA, 663 bp, Triticum aestivum
gcccccgccgtgatggcttcgtcggctaccaccgtcgcacccttccaggggctcaagtccacagccggtctccccgtcagccgccgctccagcgccagcctcggcagcgtcagcaacggcggaaggatcaggtgcatgcaggtgtggccaattgagggcatcaagaagtttgagaccctgtcttacttgccacccctctccacggaagccctcctgaagcaggtcgactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagtttcatcgccttcaggccaccaggttgcgaggagtccggcaaggcctaaactacaagttgaaacaatggcctacgccaccccccgtcatttgtgaacttcacttttgtccacgactctgctttccgaccagagcatatttctcgttccatatgatctgtgtttgtacgaacataggttgtggagcatgca

SEQ ID NO: 2601 - DNA, 842 bp, Triticum aestivum
cggcatcctcctctcctccgataatacaaataccatggcccccgccgtgatggcttcgtcggctaccaccgtcgcacccttccagggtctcaagtccacagccggcctgcccgtcagccgccgctccagcggcagcctcggcagcgtcagcaacggcggaaggatcaggtgcatgcaggtgtggccaattgagggcatcaagaagtttgagaccctgtcttacttgccacccctctccacggaagccctcctgaagcaggtcgactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtccggcaaggcctaaactatgagttgaaacaatggcctatctcatatgaagatcttttgtgaacttcacttttgtccacgacctctgttgcacgactctgctttccgaccggagcataccttttgttctatatgatttgtgtatgtatgtaggaacctatgttctcgagcatgcatacataattcctcataggtctatatacaccggctatccatatgcaaaacctgtgtaatatttgttatatacaacacgcggaccattgtcttgctgttattaattcttttttcccgcaaaaaaa

SEQ ID NO: 2602 - DNA, 771 bp, Zea mays
actgtagccggcatcctcctctcctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtccggcaaggcctaaactatgagttgaaacaatggcctatctcatatgaagatcttttgtgaatttcacttttgtccacgacctctgttgcacgactctgctttccgaccggagcataccttttgttctatatgatttgtgtatgtatgtaggaacctatgttctcgagcatgcatacataagtcctcataggtctatatacaccggctatccatatcc

SEQ ID NO: 2603 - DNA, 778 bp, Pseudoroegneria spicata
ccggcatcctcctctcctccgataatacaataccatggcccccgccgtgatggcttcgtcggctaccaccgtcgcacccttccaggggctcaagtccacagccggtctgcccgtcagccgccgctccagcggcagcctcggcagcgtcagcaatggcggaaggatcaggtgcatgcaggtgtggccaattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgttagcttcatcgccttcaggccaccgggttgcgaggagtccggcaaggcctaaactacgagttgaaacaatggcctatttcgtatgaagatcttttgtgaacttcacttttgtccacgactctgctttccggttctatatcgagcatgcatatgtaaattctagaaccggctacacatatacaaaacctgtgtgatatttattatatacaacacgcggaccattgtcttgctgttattaatttatggaaaagtttctttatttggcactgca

SEQ ID NO: 2604 - DNA, 839 bp, Triticum aestivum
tcggcacgagggcatcctcctctcctccgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcctccgggtactacgacggtcgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttaaaacaatggcctatgtatgattgtcttttgtgaacttcacttttgtccaggactctgcttcccgaccagagcatatttttccttcggtatgatctgtgtttgtacgaacataggttgtggagcatgcatatgtaaattctagcaccggctacacatatacaacaccagtgtgatatttattatatacaacaagcggaccattgtcctgctgttaattctcggaaaaactttctttatttggcactgcaatggatatgtctc

SEQ ID NO: 2605 - DNA, 793 bp, Hordeum vulgare
ggaagtcaagtgtagcctgccaagctagctatcggctccccacctagcaatttacgtaccaccatggccccagccgtgatggcttcgtcagccaccaccgtcgcccccttccaggggctcaagtccaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccctggatattacgacggccgatactggacaatgtggaagctgcctatgtttgggtgcaccgacgccacacaggtgctcaacgaggtggaagaggtcaagaaggagtaccctgacgcctacgtccgcatcatcggctttgacaacctgcggcaggtgcagtgcgtcagcttcatcgccttcaggccaccgggttgcgaggagtccggcaaggcataaagtgcaagttgaagtaaccgatatacatgctatgttagttcacattggttggtcggcagctctgctttctcaattttacttctcgttccaatcatatgtgaatatacgagcatatgtatttaagcacctaccaacgtaggccgagaaggatgcatatgagaatcatagcaccggctatacatactttgtttgcagctggaaa

SEQ ID NO: 2606 - DNA, 846 bp, Hordeum vulgare
aagtcaagtgtagcctgccaagctagctatcggctccccacctagcaatttacgtaccaccatggccccagccgtgatggcttcgtcagccaccaccgtcgcccccttccaggggctcaagtccaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggccgatactggacaatgtggaagctgcctatgttcgggtgcaccgacgccacacaggtgctcaatgaggtggaggaggtcaaaaaggagtaccctgacgcctacgtccgtatcatcggcttcgacaacctgcggcaggtgcagtgcgtcagcttcatcgccttcaggccaccgggttgcgaggagtccggcaaggcataaagtgcaagttgaagtaaccgatatacatgccatgttagttcacattggtcggtcggtagctctgctttctcaattttacttcttgttccaatcatatgtgaatatacgagcatatgtatgtaagcacctaccaacgtaggtcgaggaagatgcatatgagaatcatagtaccggctatacatactttgtttgcagctggaaatgcctatgtcttgtattgttttcttctcatgcattttttgctcaatcatatgttg

SEQ ID NO: 2607 - DNA, 681 bp, Triticum aestivum
tccgataatacaataccatggcccccgccgtgatggcttcgtcggctaccaccgtcgcacccttccaggggctcaagtccacagccggtctccccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcaccgacgccacgcaggtgctcagcgaggtggaggaggtcaagaaggagtaccctgacgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcttttgtgaacttcacttttgtccacgactctgctttccgaccagagcatatttttcgttccgtatgatctgtgtttgtacgaacataggttgtggagcatgca

SEQ ID NO: 2608 - DNA, 661 bp, Triticum aestivum
gcccccgccgtgatggcttcgtcggctaccaccgtcgcacccttccaggggctcaagtccacagccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagctcccccgggtactacgacggccgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttgaaacaatggcctatgtatgattgtcttttgtgaacttcacttttgtccaggactctgctttccgaccagagcatatttttcgttcggtatgatctgtgtttgtacgaacataggttgtggagcatgca

SEQ ID NO: 2609 - DNA, 585 bp, Triticum aestivum
gcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtccggcaaggcctaaactatgagttgaaacaatggcctatctcatatgaagatcttttgtgaacttcacttttgtcca

SEQ ID NO: 2610 - DNA, 885 bp, Triticum aestivum
gtatttttgtgacacgtctctccctcgtgccgaattcggcacgagggcatcctcctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaaggcctaaactacgagttgaaacaatggcctatctcgtatgaaggtcttttgtgaacttcacttttgtccaaaactctgctgtacgactctgctttctgaccggagcataccttttgttctatatgattttgtgtatgtatgtacgaacataggttcttgagcatgcatacgtaattcctcataggtctatatcttcttcttcggcacaacccccgaatacatcaatggacgagatctgtctataccttttcataataaagagtaggatggtctttcaagaaaaaaaaaa

SEQ ID NO: 2611 - DNA, 842 bp, Triticum aestivum
ctcctctcctccagttaatagaataccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaaggcctaaactacgagttgaaacaatggcctatctcgtatgaaggtcttttgtgaacttcacttttgtccacaactctgctgcacgactctgctttcggaccggagcataccttttgttctatatgatttgtgtatgtatgtacgaacataggttcttgagcatgcatacgtaattcctcataggtctatatgcaccggctacacatatgcaaaacctgtgtaatatttattatatacaacacgcggaccattgtcttgctgttattaattcatggaaaagtttctttaaaaaaaaaa

SEQ ID NO: 2612 - DNA, 729 bp, Leymus cinereus x Leymus triticoides
  misc_feature (68)..(68): n is a, c, g, or t
  misc_feature (74)..(74): n is a, c, g, or t
  misc_feature (77)..(77): n is a, c, g, or t
  misc_feature (105)..(105): n is a, c, g, or t
  misc_feature (603)..(603): n is a, c, g, or t
ccatggcccccactgtgatggcttcctcggccacctccgtcgcacccttccaggggctcaagtccacngccggnctncccgtcagccgccgctccagcagcgccngcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggccgatactggacaatgtggaagctgcctatgttcgggtgcaccgacgccacgcaggtgctcaaggaggtggaggaggtcaagaaggagtaccctgacgcctatgtccgcatcatcggcttcgacaacctgcgccaggtgcagtgcgtcagcttcatcgccttcaggccaccgggttgcgaggagtccggcaaggcctaaactacgagttgaaacaatggcctatgtatgaaggtcttttgtgaacttcacttttgtccacgactctgctttncgaccagagcatatttttcgttctatatgatctgtgtatgtatgtacgaacataggttctcgagcatgcatatgcaaattctagcgccggctacacatatacaaaacctgtgtgatatttattata

SEQ ID NO: 2613 - DNA, 839 bp, Triticum aestivum
gaattcggcaccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatgaaggtcttttgtgaacttaacttttgtccaccactctgctggacgaccagagcatatttttcattctatatggtctgtgtgtgtatgtacgaacataggttctcgagcatgcatatgtaaattctagaaccggctacacatatacaaaacctgtgtgatatttattatatacaaacacgcggaccattgtcttgctgttattaattcaggaaaagtttctttatttggcactgcaatgaatatgtcaca

SEQ ID NO: 2614 - DNA, 858 bp, Triticum aestivum
ggcctagctagctatcgcctccccacctagcaattcacgtactccgccatggccccagccgtgatggcttcgtccgccaccaccgtcgcacccttccaggggctcaagtcgaccgccggcctcccagtcagccgccgctccggcagcgccggcctcagcagcgtcagcaatggcggaaggatcagatgcatgcaggtgtggccaattgagggcatcaagaagtttgagaccctgtcttacttgccacccctctctacggaggccctcctaaagcaggtcgactacttgatccgctccaagtgggtaccctgcctcgagttcagcaaggttggctttgtcttccgtgagcacaacagctcccccgggtactacgacggtcgatactggacaatgtggaagctgcctatgttcgggtgcaccgacgccacacaggtgctcaacgaggtggaggaggttaagaaggagtaccctgacgcctatgtccgcgtcatcggcttcgacaacatgcgccaagtgcaatgcgtcagcttcattgccttcaggccaccaggttgcgaggaatctggcaaggcctaaagtgcaagttgaaataactgatatacatgtcatgttagttcacatttgtcggcagctctgctttctcagttttacttctcgttctactcatatgtgaatatatgagcatatgtatgtaagcgcctaccaacgtaggtcgaggaggatgcatatgagaattatagcaccggctatacatacacatatatattatatgcaatcaacggattagtgtcttgccatcaatcgatggaatggttactttgtttgcagctggaaatgcctatgtcttgcattgttttc

SEQ ID NO: 2615 - DNA, 849 bp, Triticum aestivum
gccatggccccagccgtgatggcttcttccgccaccaccgtcgcgcccttccaggggctcaagtcgaccgccggcctccccgtcagccgccgctccggcagcgccggcctcagcagcgtcagcaatggcggaaggatcagatgcatgcaggtgtggccaattgagggcatcaagaagttcgagaccctgtcttacttgccacccctctccacggaggccctcctgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggttaagaaggagtaccctgatgcgtatgtccgcgtcatcggcttcgacaacatgcgccaggtgcaatgcgtcagcttcattgccttcaggccaccaggctgcgaggaatccggcaaggcctaaagtgcaagttgaagtaaccgatatacatgtcatgttagtcacatttgtcggcggctctgctttctcagttttacttctcgttctactcatatgtgaatatatgagcatatgtatgtaagcacctaccaatgtaggtcgaggaggatgcatatgagaattatagcaccggctatacatatacatatatattatatgcaatcaacggattagtgtcttgccatcaatcgatggaaatgttactttctttgcagccggaaatgcctatgtcttgcattgttttcttctcatgcattttttgctcaatcatatgttgtgtat

SEQ ID NO: 2616 - DNA, 654 bp, Triticum aestivum
ccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctttccgaccagagcatatttctcgttccatatgatctgtgtttgtacgaacataggttgtggagcatgca

SEQ ID NO: 2617 - DNA, 964 bp, Triticum aestivum
atgtcttatcctgccacgtacgctcctccaacaccatggcccccactgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcattgccttcaggccaccgggttgcgaggagtctggcaaggcctaaactacgagttgaaacaatggcctatgtatgaaggtcttttgtgaacttcacttttgtccacgactctgctggacgaccagagcatatttttcattctatatggtctgtgtatgtatgtacgaacatagattctcgagcatgcatatgtaaattcttagagccggctaaacatatacaaaaccggtgtgatatttattatgtaaaacatgggaacaattgtcttgccggtaataatcaaaaaaaaaaaaaaaggggcgcccgcctagagtttcccttaaggggcccattcttacacgtacccagctttctgttaaaaagggcccccaaaatggagtggaattataaacaaggccatggccggtgttttacaacgggcgaaatgggaaaacgtgccagcgggg

SEQ ID NO: 2618 - DNA, 759 bp, Triticum aestivum
gccccagccgtgatggcttcgtccgccaccaccgtcgcacccttccaggggctcaagtcgaccgccggcctcccagtcagccgccgctccggcagcgccggcctcagcagcgtcagcaatggcggaaggatcagatgcatgcaggtgtggccaattgagggcatcaagaagtttgagaccctgtcttacttgccacccctctctacggaggccctcctaaagcaggtcgactacttgatccgctccaagtgggtaccctgcctcgagttcagcaaggttggctttgtcttccgtgagcacaacagctcccccgggtactacgacggtcgatactggacaatgtggaagctgcctatgttcgggtgcaccgacgccacacaggtgctcaacgaggtggaggaggttaagaaggagtaccctgacgcctatgtccgcgtcatcggcttcgacaacatgcgccaagtgcaatgcgtcagcttcattgccttcaggccaccaggttgcgaggaatctggcaaggcctaaagtgcaagttgaaataactgatatacatgtcatgttagttcacatttgtcggcagctctgctttctcagttttacttctcgttctactcatatgtgaatatatgagcatatgtatgtaagcgcctaccaacgtaggtcgaggaggatgcatatgagaattatagcaccggctatacatacacatatatattatatgcaatcaacggattactgtcttgccatcaatcgatggaa

SEQ ID NO: 2619 - DNA, 656 bp, Triticum aestivum
cgtgatggcttcgtcggctaccaccgtcgcacccttccaggggctcaagtccacagccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtccggcaaggcctaaactacgagttgaaacaatggcctatgtatgaagatcttttgtgaacttcacttttgtccaccactctgctggacgaccagagcatatttttcattctatatggtctgtgtatgtatgtacgaacataggttctcgagcatgc

SEQ ID NO: 2620 - DNA, 775 bp, Triticum aestivum
gccccagccgtgatggcatcgtccgccaccaccgtcgcgcccttccaggggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcaacgaggtggaggaggtcaagaaggagtaccctgacgcctatgtccgtgtcatcggcttcgacaacatgcgccaggtgcagtgcgtcagcttcattgccttcaggccaccaggctgcgaggaatctggcaaggcctaaagtgcaagttgaagtaacacatatacatgccatgttagttcacatttgtcggcagctctgctttctcggttttacttctcgttctactcatatgtgaatatatgagcatatgtatgtaagcacctaccaacgtaggtcgaggacgatgcatatgagaattacaacactggctatacatacacacatatattatatgcaatccgtgaattattgtcttgccatcaattgatggaaatgttactttgtttgc

SEQ ID NO: 2621 - DNA, 866 bp, Triticum aestivum
ggcctaactagctatcgcctccccacctagcaattcacgtactccgccatggctcccgccatgatggcttcctccgccaccaccgtcgcgcccttccaggggctcaagtcgaccgcgggcctccccgtcagccgccgctccggcagcgccggcctcagcagcgtcagcaatggcggaaggataagatgcatgcaggtgtggccaattgagggcatcaagaagttcgagaccctgtcttacttgccacccctctctacggaggccctcctaaagcaggtcgactacttgatccgctccaagtgggtaccctgcctcgagttcagcaaggttggcttcgtcttccgtgagcacaacagctcccccgggtactacgacggtcgatactggacaatgtggaagctgcctatgttcggctgcaccgatgccacacaggtgctcaacgaggtcgaggaggttaagaaggagtaccctgatgcctatgtccgcgtcatcggcttcgacaacatgcgccaggtgcaatgcgtcagcttcattgccttcaggccaccaggttgcgaggaatccggcaaggcctaaagtgcaagttgaagtaaccgatatacatgtcatgttagtcacatttgtcggcggctctgctttctcagttttacttctcgttctactcatatatatgtgaatatatgagcatatgtatgtaagcacctaccaatgtaggtcgaggaggatgcatatgagaattatagcaccggctatacatatacatatatattatatgcaatcaacgcattagtgtcttgccatcaatcgatggaaaaggttggtttgtttgcagccggaaatgcctatgtcttgcattgttttcttct

SEQ ID NO: 2622 - DNA, 833 bp, Triticum aestivum
agtcaagtgtggcctagctagctatcgcctccccacctagcaattcacgtactccaccatggccccagccgtgatggcgtcttccgccaccaccgtcgcgcccttccaggggcttaagtcgaccgccggccttcccatcagccgccgctccggcagcgccggcctcagcagcgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgcctcgagtttagcaaggttggcttcgtcttccgtgagcacaacagctcccccgggtactacgacggtcgatactggacaatgtggaagctgcctatgttcgggtgcactgacgccacgcaggtgctcaatgaggtggaggaggtcaagaaggagtaccctgacgcctatgtccgcgtcattggcttcgacaacatgcgccaggtgcagtgcgtcagcttcattgccttcaggccaccaggctgcgaggaatccggcaaggcctaaagtgcaagtccgatatacatgccatgttagttcacatttgtcagcagctctgctttctcggttttatttctggttctactcatatgtgaatatatgagcatatgtaagcacctaccaacgtaggccgaggaggatgcatgtcagaattatagcaccggctacacatacacatatatattatatgcaatccgcggattattgtcttgccatcaattgatggaaaagaaactttgtttgcaactggaaa

SEQ ID NO: 2623 - DNA, 868 bp, Triticum aestivum
agagagagagagagagagagagagaggcctccccacctagcaattcacgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcagcgaggtggaggaggtcaagaaggagtaccctgatgcctatgtccgcgtcatcggcttcgacaacatgcgccaggtgcagtgcgtcagcttcattgccttcaggccaccaggctgcgaggaatctggcaaggcctaaagtgcaagttgaagtaacgcatatacatgccatgttagttcacatttgtcggcagctctgctttctcggttttacttctcgtactactcgtatgtgaatatatgagcatatgtatgtaagcacctaccaacgtaggtcgaggaggatgcatatgagaattatagcaccggctatacatacacacatatattatatgcaatccgcggattattgtcttgccatcagttgatggaaatgttactttgtttgcagctggaaatgcctatgtcttgcattgttttcttctc

SEQ ID NO: 2624 - DNA, 846 bp, Triticum aestivum
tccgcctccccccctagcaattcacgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcagcgaggtggaggaggtcaagaaggagtaccctgatgcctatgtccgcgtcatcggcttcgacaacatgcgccaggtgcagtgcgtcagcttcattgccttcaggccaccaggctgcgaggaatctggcaaggcctaaagtgcaagttgaagtaacgcatatacatgccatgttagttcacatttgtcggcagctctgctttctcggttttacttctcgtactactcgtatgtgaatatatgagcatatgtatgtaagcacctaccaacgtaggtcgaggaggatgcatatgagaattatagcaccggctatacatacacacatatattatatgcaatccgcggattgttgtcttgccatcaattgatggaaatgttactttgtttgcagctcgagatgcctatgtcttgcattgttttcttctca

SEQ ID NO: 2625 - DNA, 748 bp, Triticum aestivum
gccccagccgtgatggcttcttccgccaccaccgtcgcgcccttccaggggcttaagtcgaccgccggccttcccatcagccgccgctccggcagcgccggcctcagcagcgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgccttgagttcagcaaggttggcttcgtcttccgtgagcacaacagctccccagggtactacgacggtcgatactggacaatgtggaagcttcctatgttcgggtgcactgacgccacgcaggtgctcaacgaggtggaggaggtcaagaaggagtaccctgacgcctatgtccgcgtcattggcttcgacaacatgcgccaggtgcagtgcgtcagcttcattgccttcaggccaccaggctgcgaggaatccggcaaggcctaaagtgcaagtccgatatacatgccatgttagttcacatttgtcagcagctctgctttctcggttttatttctggttctactcatatgtgaatatatgagcatatgtaagcacctaccaacgtaggccgaggaggatgcatgtcagaattatagcaccggctacacatacacatatatattatatgcaatccgcggattattgtcttgccatcaattgatggaaa

SEQ ID NO: 2626 - DNA, 902 bp, Triticum aestivum
aagcgtagcctgccaccttctctcctccaacaccatggcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaagcaggtcgactacttgatccgctccaagtgggtgccctgcctcgagttcagcaaggttggtttcgtcttccgtgagcacaatagctcccccggatactatgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatgaaggtcttttgtgaacgtcacttttgtccacgactctgctggacgaccagagcatatttttcattctatatggtctgtgtatgtatgtacgaacataggttctcgagcatgcatatgcaaattctagaaccggctacacatatacaaaacctgtgtgatatttattatatacaacacgcggaccattgtcttgctgttattaattcatgaaaaaggttctttatttggcactgcaatgaatatgtctcacaactagttgtggaagcattcagtatttgacattaagatcccctgatttgcagtgcaaatt

SEQ ID NO: 2627 - DNA, 813 bp, Secale cereale
  misc_feature (5)..(5): n is a, c, g, or t
  misc_feature (8)..(9): n is a, c, g, or t
aatanccnnagctgggcctagctagctatcgcctccccacctagcaatttacgcactccaccatggccccagccgtgatgacttcgtccaccaccaccgtcgcacccttccaggggctcaagtcgaccgccggcctccccgtcagccgccgctccggcagcgccggcctcagcagcgtcagcaatggcggaaggatcagatgcatgcaggtgtggccaattgagggcatcaagaagttcgagaccctgtcttacttgccacccctctccacggaggccctcctgaagcaggtcgactacctgatccgctccaagtgggtgccttgcctcgagttcagcaaggttggcttcgtcttccgtgagcacaacagctcccccgggtactatgacggtcggtactggacaatgtggaagttgcctatgttcgggtgcaccgacgccacgcaggtgctcaacgaggtggaggaggtaaagaaggagtaccctgacgcttatgtccgcgtcatcggcttcgacaacatgcgccaggtgcagtgcgtaagcttcattgccttcaggccaccaggctgcgaggaatccggcaaggcctaaagtgcaagttgaagtaacccatatacatgccaagtccgttcacatttgtcggcaccctgctttctcggttttacttctcgttctactcatatgtgaatatgtgagcatatgtatgtaaccacctaccaacgtaggtcgaggaggacacatatgagaattatagcaccggctatacatacacacatatattatatgcaatccgcggattattgtcttgccatca

SEQ ID NO: 2628 - DNA, 882 bp, Triticum aestivum
ggcctagctagctatcgcctccccacctagcaatttacgtactccgccatggccccagccgtgatggcttcttccgccaccaccgtcgcgcccttccaggggctcaagtcgaccgccggcctccccgtcagctgccgctccggcagcaccggcctcagcagcgtcagcaatggcggaaggatcagatgcatgcaggtgtggccaattgagggcatcaagaagttcgagaccctgtcttacttgccacccctctccacggaggccctcttgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggttaagaaggagtaccctgatgcgtatgtccgcgtcatcggcttcgacaacatgcgccaggtgcaatgcgtcagcttcattgccttcaggccaccaggctgcgaggaatccggcaaggcctaaagtgcaagttgaagtaaccgatatacatgtcatgttagtcaaatttgtcggcggctctgctttctcagttttacttctcgttctactcatatgtgaatatatgagcatatgtatgtaagcacctaccaatgtaggtcgaggaggatgcatatgagaattatagcaccggctatacatatacatatatattatatgcaatcaacggattagtgtcttgccatcaattgatggaaatgttactttctttgcagccggaaatgcctatgtcttgcattgttttcttctcatgcattttttgctcaatca

SEQ ID NO: 2629 - DNA, 807 bp, Triticum aestivum
gcccccaccgtgatggcctcgtcggccacctccgtcgctcctttccaggggctcaagtccaccgccggcctccccgtcagccgccgctccaacggcagcctcggcagcgtcagcaacggtggaaggatcaggtgcatgcaggtgtggccaattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgcaacgcaggtgctcaacgaggtggaggaggtcaagaaggagtaccctgatgcctatgtccgcgtcatcggcttcgacaacatgcgccaggtgcagtgcgtcagcttcattgccttcaggccaccaggctgcgaggaatctggcaaggcctaaagtgcaagttgaagtaacgcatatacatgccatgttagttcacatttgtcggcagcgctgctttctcggttttacttctcgtactactcatatgtgaatatatgagtatatgtatgtaagcacctaccaacgtaggtcgaggaggatgcatatgagaattatagcaccggctatacatacacacatatattatatgcaatctgcggattgttgtcttgccatcaattgatggaaatgttactttgtttgcagctggagatgcctatgtcttgcattgttttcttc

SEQ ID NO: 2630 - DNA, 707 bp, Hordeum vulgare
tccttctagcaagctatatacctacatagtacagccatggcccccaccgtgatggcctcatcggccacctccgtcgctcctttccaggggctcaagtccaccgccggccttcccgtcagccgccgctccaacggcgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccggcaaggcataaacagctcactgacgatgggccacatataaagtgccattgcagttttgtcaactctgacattgctttgggttttccttctccattatctttcttatttgttcctaaaaatgtgtgtatgcccatgttcatgtaccaacatggct

SEQ ID NO: 2631 - DNA, 891 bp, Hordeum vulgare
gaggaagggcccaagggttatataagccttgctgacccaacgcaccagtcctcaagccagagtgcctccttctagcaagctatatacctacatagtacagccatggcccccaccgtgatggcctcatcggccacctccgtcgctcctttccaggggctcaagtccaccgccggccttcccgtcagccgccgctccaacggcgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccggcaaggcataaacagctcactgacgatgggccacatataaagtgccattgcagttttgtcaactctgacattgctttgggttttccttctccattatctttcttatttgttcctaaaaatgtgtgtatgcccatgttcatgtaccaacatggctcgagaaagcatgctcgtatgtgaatgctatcggtggctatgtatatgcacatgcacataatattatacaatctgtcgactatgtaatatgtattcgagtaattaatgagaaacatctt

SEQ ID NO: 2632 - DNA, 1337 bp, Hordeum vulgare
agcggggtgagaggaaagttgcaaacggatttagactccgtatgccaaagctacctgttttttgaggttgtatgcaaacgctacctagctattgaaactatccgcggacattattgtcgtggctaaaatctggactagaggacatctgaggcggatggagaggagggaggaagagacggtcatgagtgattcagaccctctcctcgagaggaaggatcagtcaggctcattgccccagctctcgccacctcagccggcaaccgtgacggtgttggagattgaggatgaggagaccgatggttcttatgccgcgtgctgccgcatttgccttgaggccgagtcggagataggtgatgagctaatatcaccttgcatgtgcaagggaactcagcagtttgttcaccgttcgtgcctagaccattggaggtctgtgaaggaaggatttgcattctcacactgcacaacatgcaaagctcagttccatcttcgagtggaatctctggaagataactcatggcgcaaaataaagttccggcgctcaagccagtgtgcctccctctagcaagctatatacctacatagtacagctatggcccccaccgtgatggcctcgtcggccacctccgtcgctcctttccaggggctcaagtccaccgccggcctccccgtcagccgccgctcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccggcaaggcataaacagctcactgacgatgggccacatataaagtgccattgcagttttgtcaactctgacattgctttgggttttccttctccatttatctttcttatttgttcctaagaatatgtgtatgtccatgttcatgtaccaacatggctcgagaaaacatgcttgtatgtgaatgctgtcggtggctatgtatatgcacgtacgcataatattatacaataatat

SEQ ID NO: 2633 - DNA, 786 bp, Hordeum vulgare
gagctatatacctacatagtacagctatggcccccaccgtgatggcctcgtcggccacctccgtcgctcctttccaggggctcaagtccaccgccggcctccccgtcagccggcggtcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccggcaaggcataaacagctcactgacgatgggccacatataaagtgccattgcagttttgtcaactctgacattgctttgggttttccttctccatttatctttcttatttgttcctaagaatatgtgtatgcccatgttcatgtaccaacatggctcgagaaagcatgctcgtatgtgaatgctatcggtggctatgtatatgcacctgcacataatattatacaatctgtcgactatggaata

SEQ ID NO: 2634 - DNA, 668 bp, Triticum aestivum
gcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaagcaggtcgactacttgatccgctccaagtgggtgccctgcctcgagttcagcaaggttggtttcgtcttccgtgagcacaatagctcccccggatactatgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatgaaggtcttttgtgaacgtcacttttgtccacgactctgctggacgaccagagcatatttttcattctatatggtctgtgtatgtatgtacgaacataggttctcgagcatgca

SEQ ID NO: 2635 - DNA, 806 bp, Leymus cinereus x Leymus triticoides
gcacgaggcctccttgtagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacttgccaccgctcagcacggaggccctccttaagcaggtggactacctgatccgctccaagtgggtgccttgtctcgagttcagcaaggttgggttcatcttccgtgagcacaatgcatctcctgggtactacgatggccgatactggacaatgtggaaactacctatgtttgggtgcaccgacgccacacaggtgataaacgaggtggaggaggtcaagaaggagtaccctgacgcctatgtccgcatcatcggtttcgacaacttgcgtcaggtgcagtgcgtcagcttcatcgccttcaagccaccaggctgcgaggagtccggcaaggcctaaacagctcactgacgacgacgggccacatataaagtgccattgcagttttgtcaactctgacattgctttgggttttccttgtccatttatctttcttatttgttcctaagaatatgtgtatgtccatgttcatgtaccaacatgcctcgagaaagcatgctcgtatgtgaatgctatcacttgctatgtatatgcacatgcacataatattatacaatatgtcgactatata

SEQ ID NO: 2636 - DNA, 894 bp, Gossypium hirsutum
  misc_feature (29)..(29): n is a, c, g, or t
  misc_feature (878)..(878): n is a, c, g, or t
  misc_feature (892)..(892): n is a, c, g, or t
caaaaagacctgggggaccttccacgcgncggtggcgcgtgcgcgctcctagtaactagctcggaatcccccgggactgcagggaattcggcaccagagcaagctatatacctacatagtacagctatggcccccaccgtgatggcctcgtcggccacctccgtcgctcctttccaggggctcaagtccaccgccggcctccccgtcagccgccgctcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgcgaggagtccggcaaggcataaacagctcactgacgatgggccacatataaagtgccattgcagttttgtcaactctgacattgctttggggttttccttccccatttatctttcttatttgttcctaagatatgtgtatgtccatgttcatgtaccaacatggcttcgagaaacatgcttggctggtgaatgcctgcggtggcttatgtattgcccgtacccataattatattccataatatggnaactttataccgtnat

SEQ ID NO: 2637 - DNA, 852 bp, Secale cereale
  misc_feature (7)..(7): n is a, c, g, or t
cgagcgngctcgcaaagcaaagcgggtagttgggagtttggttggggggagggcggtagcgtctcctagcaagctatatacctacatagtacagcgatggcccctaccgtgatggcctcgtcggccacctccgtcgctcctttccaggggctcaagtccaccgccggcctccctgtcagccgccgctccaacggcgctagcctcggcagcgtcagcaacggtggaaggatcaggtgcatgcaggtgtggcccatcgagggcatcaagaagttcgagaccctgtcttacttgccaccgctcaccacggaggccctcctcaagcaggtcgactacctgatccgctccaagtgggtgccttgcctcgagttcagcaaggttgggttcatcttccgtgagcacaacgcgtctcccgggtactacgatggccggtactggacaatgtggaagctgcctatgttcggatgcaccgacgccacacaggtgatcaacgaggtggaggaggtcaagaaggagtaccctgacgcgtacgtccgcatcatcggattcgacaacatgcgccaggtgcagtgcgtcagcttcatcgccttcaagccaccgggctgcgaggagtccggcaaggcataaacagctcactcaccacgggccgcatataaagtgccattgcagttttgtcaactctgacattgctttgggttttccttgtccatttatctttcttatttgttcctaagaatatgtgtatgtccatgttcatgtaccaacatgactcgagaaagcatgctcgtatgtgagtgctatcggtggctatgtatatgcacggacgcataatattatacaatatgtcactatata

SEQ ID NO: 2638 - DNA, 637 bp, Setaria italica
aacaagcttggcaaagccatacataacgcatcgaccaacaccatggcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgcaacgcaggtgctcagcgaggtggaggaggtcaagaaggagtaccctgatgcctatgtccgcgtcatcggcttcgacaacatgcgccaggtgcagtgcgtcagcttcattgccttcaggccaccaggctgcgaggaatctggcaaggcctaaagtgcaagttgaagtaacgcatatacatgccatgttagttcacatttgtcggcagcgctgctccttc

SEQ ID NO: 2639 - DNA, 777 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactat

SEQ ID NO: 2640 - DNA, 814 bp, Triticum aestivum
ctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccatgttcatgtaccaacatggctcgagaaagcatgctcgtatgtgaatgcaatcggtggctatgtatatgcacatgcacataatatatttatacaatctgtcgactatgtattcgggtaattaataatgagaaacatctttg

SEQ ID NO: 2641 - DNA, 776 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaccaacatggctcgagaaagcgtgctcgtatgtgaatgcaatcggtggctatgtatatgcacggacgcataatattatacaatatgtcaacta

SEQ ID NO: 2642 - DNA, 778 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggtttcccttctccatttatctttcttatttgttcctaagaatatgtgtatgtccatgttcatgtacgaacatggctcgagaaagcatgctcgtatgtgaatgctatcggtggctatgtatatgccccgacccataatattatacaatatgtcgactata

SEQ ID NO: 2643 - DNA, 798 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggtaaccaa

SEQ ID NO: 2644 - DNA, 781 bp, Triticum aestivum
agctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaagtgggtgccttgcctcgagttcagcaaggttgggttcatcttccgtgagcacaacgcatcccctgggtactacgatggccggtactggacaatgtggaaactgcctatgttcgggtgcaccgacgccacacaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatat

SEQ ID NO: 2645 - DNA, 727 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgtccctaagaatatgtgtatgtccatgttcatgtaccaacatggctcgagaaagcatgctcgtatgtgaatgctatcg

SEQ ID NO: 2646 - DNA, 796 bp, Triticum aestivum
ctatatacctacatattacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacgggcgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattgtacaatctgtcgacttatgtattcgggtaattaa

SEQ ID NO: 2647 - DNA, 719 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaa

SEQ ID NO: 2648 - DNA, 797 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgccatcgggggctatgtatataaacggccgcataatattatacactatgtcgactatataccctttaatggtaacca

SEQ ID NO: 2649 - DNA, 794 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgcttcgtatgtgaatgctatcggtggctatgtatatgcacggacgcataatattatacaatatgtcaactatatacgttttaatggta

SEQ ID NO: 2650 - DNA, 798 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttttaatggtaaccaa

SEQ ID NO: 2651 - DNA, 813 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaacatctttg

SEQ ID NO: 2652 - DNA, 846 bp, Triticum aestivum
ccagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaacatctttgccaccgcaaa

SEQ ID NO: 2653 - DNA, 884 bp, Triticum aestivum
ctcgtgccgaattcggcacgaggcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcaactatatacgttttaatggtaaccaatggaaaatatctccaccaccgtgcttattacttcctctgtaaattaatata

SEQ ID NO: 2654 - DNA, 960 bp, Leymus cinereus x Leymus triticoides
gcacgaggcctccttctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggtatcaagaagttcgagaccctgtcttacttgccacccctctccacggaggccctcctgaagcaggtcgactacctgatccgctccaagtgggtgccttgtctcgagttcagcaaggttgggttcatcttccgtgagcacaatgcatctcctgggtactacgatggccgatactggacaatgtggaaactacctatgtttgggtgcaccgacgccacacaggtgctaaaggaggtggaggaggtcaagaaggagtaccctgacgcctatgtccgcatcatcggattcgacaacaatcgtcaggtgcagtgcgtcagcttcatcgccttcaagccaccaggctgcgaggagtccggcaaggcctaaacagctcactgacgacgggccacatataaagtgccattgcagttttgtcaactctgacattgctttgggttttccttctccatttgtctttctttgttcctaagaatatgtgtatgtccatgttcatgtaccaacatggcttgagaagcatgctcgtatgtgaatgctatcacttgctacagatatgcacgtacgcataataatatacaatatgtcgactatatacgttttaatggtaatcaatggaaaatatctccactacagtgcttatactttttattagtagtgaacggttggaggttgtcttagtttgtatccctaaaatgtagggttgtaaacatggccccgcagaacgttaggcaataatatgatattagttgtatcta

SEQ ID NO: 2655 - DNA, 944 bp, Pseudoroegneria spicata
ccgttgctgtcgccgttgctgtcgtgcctccttgtagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctcctcaagcaggtcgactacctgatccgctccaagtgggtgccttgtctcgagttcagcaaggttgggttcatcttccgtgagcacaacgcatctcctgggtactacgatggccggtactggacaatgtggaagctgcctatgttcgggtgcaccgacgccacccaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacgggccacatataaaagtgccattgcagttttgtcaactctgacattgctttggggtttccttctccatttatctttcttatttgttcctaagaatatgtgtatgtccatgttcatgtaccaacatggctccagaaagcatgctcgtatgtgaatgctatcgatggctatgtatatgcacatgcacataatattatacaatctgtcgactatgtattcgggtaattaatgagaaacatctttgccaccgcaaaatcgactgagacttaaccaagtctcagtcaagtgatatagtatgtaagaagaaaaaagaaaaattgaaaataaatttttgcaca

SEQ ID NO: 2656 - DNA, 798 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtacaatctgtcgactatgtatttgggtaattaat

SEQ ID NO: 2657 - DNA, 846 bp, Triticum aestivum
  misc_feature (830)..(830): n is a, c, g, or t
gaattcggcacgaggcctctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtacaatctgtcgactatgtatttgggtaattaatganaaacatctttgccacc

SEQ ID NO: 2658 - DNA, 839 bp, Pseudoroegneria spicata
ccgttgctgtcggtgcctccttgtagcaagctatatacctacatagtacagccatggctcccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacttgccaccgctcagcacggaggccctcctcaagcaggtcgactacctgatccgctccaagtgggtgccttgtctcgagttcagcaaggttgggttcatcttccgtgagcacaatgcatctcctgggtactacgatggccggtactggacaatgtggaagctgcctatgttcgggtgcaccgacgccacccaggtgatcaacgaggtggaggaggtcaagaaggagtaccctgacgcctatgtccgcatcatcggattcgacaacatgcgtcaggtgcagtgcgtcagcttcatcgccttcaagccaccaggctgcgaggagtccggcaaggcctaaacagctcactgacgacaggccacatataaagtgccattgcagttttgtcaactctgacattgctttgggttttccttctccatttatctttcttatttgttcctaagaatatgtgtatgtccatgttcatgtactaacatggctcgagaaagcatgctcgtatgtgaatgctatcggtggctatgtatatgcacggacgcataatattatacaatatgtcgagtatatgcgttttaatggtaaccaatggaaatatct

SEQ ID NO: 2659 - DNA, 824 bp, Secale cereale
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacttgccaccgctcagcacggaggccctcctcaagcaggtcgactacctgatccgctccaagtgggtgccttgcctcgagttcagcaaggttgggttcatcttccgtgagcacaacgcatcccccgggtactacgatggccggtactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcgccacgggccacatataaagtgccattgcagttttgtcaactctgacattgctttggattctccttctccatttatctttcttgtttgttcctaagaatatgtgtatatccatgttcatgtaccaacatggctccagaaagcatgctcgtatgtgaatgctatcgatggctatgtatatgcacatgcacataatattatacaatctgtcgactatgtattcgggtaattaatgagaaacatctttgccacc

SEQ ID NO: 2660 - DNA, 809 bp, Triticum aestivum
gaattcggcacgaggcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccatgttcatgtaccaacatgtctcgagaaagcatgctcgtatgtgaatgcaatcggtggctatgtatatgcacatgcacataatatatttatacaatctgtcgacta

SEQ ID NO: 2661 - DNA, 858 bp, Triticum aestivum
ccagagtgcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccatgttcatgtaccaacatgtctcgagaaagcatgctcgtatgtgaatgcaatcggtggctatgtatatgcacatgcacataatatatttatacaatctgtcgactatgtattcgggtaattaataatgagaaacatctttggcaccgcacgcaaaaaaaaaa

SEQ ID NO: 2662 - DNA, 798 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcaactatatacgttttaatggtaaccaa

SEQ ID NO: 2663 - DNA, 814 bp, Triticum aestivum
ctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccatgttcatgtaccaacatgtctcgagaaagcatgctcgtatgtgaatgcaatcggtggctatgtatatgcacatgcacataatatatttatacaatctgtcgactatgtattcgggtaattaataatgagaaacatctttg

SEQ ID NO: 2664 - DNA, 798 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggtaaccaa

SEQ ID NO: 2665 - DNA, 804 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcacttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaa

SEQ ID NO: 2666 - DNA, 794 bp, Hordeum vulgare
agcaagctatatacctacatagtacagccatggcccccaccgtgatggcctcatcggccacctccgtcgctcctttccaggggctcaagtccaccgccggccttcccgtcagccgccgctccaacggcgctagcctgggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacaatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgccttcaagccaccaggctgccaggagtcgggaaaggcataaacagctcactgacgatgggcacatataagtgccattgcagtttgtcaactctgacatgcttggttttccttctccattatctttcttattgttcctaaaatgtgtgtagtcccatgttcatgtaccaacatgctcgagaaagcatgctcgtatgtgaatgctatcggtggctatgtatatgcacatgcacataatattatacaatctgtcgactatgtaatatgtattcgagtaatt

SEQ ID NO: 2667 - DNA, 794 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaacaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacgggacgcataatattatacaatatgtcaactatatacgttttaatggta

SEQ ID NO: 2668 - DNA, 725 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaacaaggttgggtttatcttccgtgagcacaacgcatcccctgggtactacgatggccggtactggacaatgtggaagctgcctatgttcgggtgcaccgacgccacgcaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcagttttgtcaactctgacattgctttgggttttccttttccatttatctttcttgtttgttcctaagataagaatatgtgtatgtccatgttcccgagcatgactcgagaaagcatgctcgtatgtgaatgcta

SEQ ID NO: 2669 - DNA, 1080 bp, Festuca arundinacea
  misc_feature (815)..(815): n is a, c, g, or t
  misc_feature (818)..(818): n is a, c, g, or t
cctcttcttagtaaagcatatacaactaggcagctagctaagtgcgtactacaatggcccctgccgtgatggcttcctcggccactactgtggcacccttccagggcctcaagtccaccgctggcctccccgtcagccgccgcagcgccgccagcctcggcagcgtcagcaacggtggaaggatcaggtgcatgcaggtgtggccgattgagggcattaagaaattcgagaccctatcttacctgccaccgctctcggcggaggccctcctgaagcagatcgactttttgatccgctccaaatgggttccctgcttggagttcagcaaggttggcttcatcttccgtgagcatggcagcactcccggatactacgacggcaggtactggacaatgtggaagctgcccatgttcggctgcacagatgccacccaggtcctcaaggaggtggaggaggtcaagaaggagtaccctgacgcctatgtccgcatcatcggttttgacaacatccgtcaggtgcagtgcgtcagcttcatcgccttcaagccaccaggctgcgaggagtccggcaaggcataagatgcgacccaggaataacagatgctagatgaagtgtcataaaatttgtcgacaattccgcttttatcgttttacttctggttccatataactgtgtatgtacacatatatgtatgtacctcgcagccttgagtaagtctgttccatgttagcttgccttcgttgatgaaccaagcacatgctaaggatgatccagatttatgcgagggcgtttatatgttttgtgttgacactgtntgnaatctggaatatatatatacaaagtttgagttttataaaaaaaaaaaaaaaaaaaactcgcttcaccgccgggaacggcacgggcggcgagtccatctacggcgccaagttcgcggacgagaacttcgtgcacacgcactccggccccggcatcctctccatggccaactccgggcccggcaccaacggctcccagttcttcctctgcaccgacgcctgcgactggctcgacggcaagcacgtcgtcttcggcaaggtcgtg

SEQ ID NO: 2670 - DNA, 824 bp, Festuca arundinacea
cttagtagagcatatacagctaggcagctagctaagtgcgtactacaatggcccccgccgtgatggcttcctcggccactactgtggcacccttccagggcctcaagtccaccgctggcctccccgtcagccgccgcagcgccgccagcctcggcagcgtcagcaacggtggaaggatcaggtgcatgcaggtgtggccgattgagggcattaagaaattcgagaccctatcttacctgccaccgctctcggcggaggccctcctgaagcagatcgactttttgatccgctccaaatgggttccctgcttggagttcagcaaggttggcttcatcttccgtgagcatggcagcactcccggatactacgacggcaggtactggacaatgtggaagctgcccatgttcggctgcacagatgccacccaggtcctcaaggaggtggaggaggtcaagaaggagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggctggtatatgaaacaacggccgctatatacttttgccgaagactcggtttattttgcatttaatgtgattgtgtttgcacgtattcttgtatgtatgaacctaccgacctaggttgaagagctgatatgtgaattctagaaccggctacatgtaaaggcatacacatacacatataatattatatattatttccgagtgtatttatatccaatccgcctattctgtttttct

SEQ ID NO: 2671 - DNA, 722 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcaacaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcaaggagtccggcaaggcctaaacagctcactcacgacaggccatatataaagtgccattgcattttgtcaactctgacatgctttggctttccttctccatttactttcctattgttcctaagaatatgtgtatgtccatgttcatgtaccaacatggtccgagaaacatgctcgtatgagaatgctatcgg

SEQ ID NO: 2672 - DNA, 779 bp, Leymus cinereus x Leymus triticoides
  misc_feature (105)..(105): n is a, c, g, or t
  misc_feature (116)..(116): n is a, c, g, or t
  misc_feature (422)..(422): n is a, c, g, or t
  misc_feature (434)..(434): n is a, c, g, or t
  misc_feature (482)..(482): n is a, c, g, or t
  misc_feature (547)..(547): n is a, c, g, or t
  misc_feature (553)..(553): n is a, c, g, or t
cgatggcccccactgtcatgtcgtcggcagccaccgccgtcgcacccttccaggggctcaagtccaccgctggcctcccagtcagccgccgctccggcagcgcgnctggcctcggnagcgtcagcaacggcggaagaatccggtgcatgcaggtgtggccgattgaaggcatcaagaaattcgagactttgtcttacttgccaccgctcaccacggaggcactccttaagcaggtcgactacctgatccgctccaagtgggtgccttgtctcgagttcagcaaggttggcttcatcttccgtgagcacaatgcctctccagggtactacgacggccgatactggacaatgtggaagctacctatgtttgggtgcaccgacgccacacaggtgctcaaggaggtggaagaggtcaagaaagantaccctgacgcntatgtccgcattattggttttgacaacatgcgtcaagtgcagtgtgtnagcttcatcgccttcaaaccaccaggctgcgaggagtctggcaaggcctaaacaagctaactccnttttancatacaacatggtttcgtgtcaggttgattttatttcactttttacttttgttctgcttatgtatgtgttctccccctacaactcgaattaacattgtatgagtactacaatcataagagtactacaattatcgttgggtgagaaatatgtgaatgtaaactacggctatccataaaggcatatatacatgataagaatacagtgatatactatgccgccgtgttg

SEQ ID NO: 2673 - DNA, 680 bp, Leymus cinereus x Leymus triticoides
gcacgaggcggcatcctcctctcttccagttaatataataccatggcccccgccgtgatggcttcgtcggctaccaccgtcgcacccttccaggggctcaagtccacagccggtctccccctcagccgccgctccggcagcgccggcctcagcagcgtcagcaatggcggaaggatcaggtgcatgcaggtgtggccgatcgagggcatcaagaagttcgagaccctgtcttacttgccaccgctctccacggaggccctcctgaagcagatcgattacctgatccgctccaagtgggtgccctgcctcgagttcagcaaggttggcttcgtcttccgtgagcacaacagctcccccgggtactacgacggccgatactggacaatgtggaagctgcctatgttcggctgcaccgatgccacacaggtgctcaaggagctggaggaggtcaagaaggagtaccctgacgcatatgtccgcatcatcggtttcgacaactatcgtcaggtgcagtgcatcagcttcatcgcctacaagccaccaggctgcgaggagtccggcaaggcctaaactgcgagtaaaagtaacccatataaagggcgtgttatatagttcacttttgtcgacgactctgcatttggggttttacttctcgttcaataattgcgtatgtatgtacg

SEQ ID NO: 2674 - DNA, 763 bp, Festuca arundinacea
  misc_feature (112)..(112): n is a, c, g, or t
  misc_feature (740)..(740): n is a, c, g, or t
ggcacgaggctgcctcctgctcccctccaacaccatggctcccaccgtgatggcttcctcggccaccaccgtcgcacccttccagggcctcaagtccaccgcgggcctcccngtcagccgccgcagcgccgccagcctcggcagcgtcagcaatggtggaaggatcagatgcatgcaggtgtggccgattgagggcatcaagaagttcgagaccctatcttacctgccaccgctctcggcggaggccctcctgaagcagatcgacttcttgatccgctccaaatgggttccctgtctggagttcagcaaggttggcttcatcttccgtgagcatggcagcactcccggatactacgacggcaggtactggacaatgtggaagctgcccatgttcggctgcacagacgccacccaggtcctcaaggaggtggaagaggtcaagaaggagtaccctgacgcctatgtccgcatcatcggtttcgacaacatccgtcaggtgcagtgcgtcagcttcatcgccttcaagccaccaggctgtgaggagtccggcaaggcataagctgcgagctaggaatccgatatatggagtctcttggttcagtttttgatgacaactccgctttccgggttttacttttagttccacatataattgtgtgtgtatgcaagttgttaaatactttgagatcaacaagttgtaaagagtttgtgacccgtcaaatactgaatatctatctcancgggttgcgatggagtttagcgc

SEQ ID NO: 2675 - DNA, 802 bp, Setaria italica
agccagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtgcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcgactatatacgttt

SEQ ID NO: 2676 - DNA, 759 bp, Lolium multiflorum
gtaaagcatatacagctaggcagctagctaagtgcgtactacaatggcccctgccgtgatggcttcctcggccactactgtggcgcccttccagggcctcaagtccaccgctggcctccccgtcagccgccgcagcgccgccagcctcggcagcgtcagcaacggtggaaggatcaggtgcatgcaggtgtggccgattgagggcatcaagaaattcgagaccctatcttacctgccaccgctctcgcccgaggccctcctgaagcagatcgactttttgatccgctccaaatgggttccctgcttggagttcagcaaggttggcttcatcttccgtgagttcggcagcactcccggatactacgacggcaggtactggacaatgtggaagctgcccatgttcggctgcactgacgccgcccaggtcctcaaggaggtggaggaggtcaagaaggagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggccgctatatacttttggcgaagactcggtttattttccatttaatgtgattgtgtttgcacgtattcaagtatgtatgtacctaccgacctaggaagagctgatatgtgaattctagaaccggctacatgtaaaagcatacacatacacatataatattatatattatttc

SEQ ID NO: 2677 - DNA, 774 bp, Lolium multiflorum
gtaaagcatatacaactaggcagctagctaagtgcgtactacaatggcccctgccgtgatggcttcctcggccactactgtggcgcccttccagggcctcaagtccaccgctggcctccccgtcagccgccgcagcgccgccagcctcggcagcgtcagcaacggtggaaggatcaggtgcatgcaggtgtggccgattgagggcatcaagaaattcgagaccctatcttacctgccaccgctctcggccgaggccctcctgaagcagatcgactttttgatccgctccaaatgggttccctgcttggagttcagcaaggttggcttcatcttccgtgagttcggcagcactcccggatactacgacggcaggtactggacaatgtggaagctgcccatgttcggctgcactgacgccacccaggtcctcaaggaggtggatgaggtcaagaaggagtaccctgacgcctatgtccgcatcatcggttttgacaacatccgtcaggtgcagtgcgtcagcttcatcgccttcaagccaccaggctgcgaggagtccggcaaggcataaactgccagctgaaacaacggccgctatatacttttggcgaagactcggtttattttgcatttaatgtgattgtgtttgcacgtattcaagtatgtatgcacctaccgacctaggaagagctgatatgtgaattctagaaccggctacatgtaaaagcatacacatacacatataatattatatattatttccgagtgtatttatat

SEQ ID NO: 2678 - DNA, 736 bp, Lolium multiflorum
gtaaagcatatacagctaggcagctagctaagtgcgcactacaatggcccctgccgtgatggcttcctcggccactactgtggctcccttccagggcctcaagtccacagctggcctccccgtcagccgccgcagcgccgccagcctcggcagcgtcagcaacggtggaaggatcaggtgcatgcaggtgtggccgattgagggcatcaagaaattcgagaccctatcttacctgccaccgctctcgcccgaggccctcctgaagcagatcgactttttgatccgctccaaatgggttccctgcttggagttcagcaaggttggcttcatcttccgtgagttcggcagcactcccggatactacgacggtaggtactggacaatgtggaagctgcccatgttcggttgcactgacgccgcccaggtcctcaaggaggtggaggaggtcaagaaggagtaccctgacgcctatgtccgcatcatcggttttgacaacatccgtcaggtgcagtgtgtcagcttcatcgccttcaagccaccaggctgcgaggagtccggcaaggcataagatgtgacccaggaataacagatgctagatcaagtgtctgttaaaatttgtcgacaattccgcttttatcgttttactgctggttgcatataactgtgtaactgtgtatgaacacatatatgtatgtacgtacctcgcagccttgagtaagtctgttccatgttagct

SEQ ID NO: 2679 - DNA, 759 bp, Lolium multiflorum
cctcctgctcccctccaacaccatggctcccaccgtgatggcttcctcggccaccaccgtcgcacccttccagggcctcaagtccaccgcgggcctccccgtcagccgccgcagcgccgccagcctcggcagcgtcagcaatggtggaaggatcagatgcatgcaggtgtggccgattgagggcatcaagaaattcgagaccctatcttacctgccaccgctctcgcccgaggccctcctgaagcagattgactttttgatccgctccaaatgggttccctgcttggagttcagcaaggttggcttcatcttccgtgagttcggcagcactcccggatactacgacggcaggtactggacaatgtggaagctgcccatgttcggctgcacagacgccacccaggtcctcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggcaaggcataagatgcggcccaggaataaacagcctatgcaaggcatgttactatttttgctgacgactctgctttcggggatttacttgcgcttccacataattgtgcatgtatgtacttacctatatcacctgggtcgaggaacatttatatgtcaattctaccacaggctacacatacacatatgtatttatatacagtctacatgctattgtgcttgtt

SEQ ID NO: 2680 - DNA, 829 bp, Avena sativa
caagcatagcctagctagctatctcatcaactccttagcagtatacttgccaccatggcccccgccgtgatggcttcgtcggccaccaccgtcgcgcccttccagggtctcaagtccaccgctggcctccccgtcagccgccgcagctccggaagcctcggcagcgtgagcaacggtggaagaatcagatgcatgcaggtgtggccaattgagggcatcaagaagttcgagaccctgtcttacctgccaccactctcagaggaggctctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtgatcaaggaggtggaggaggtcaagaaggagtaccctgacgcctatgttcgcatcatcggcttcgacaacatccgtcaagtgcagtgcgtcagcttcatcgccttcaagccaccaggctgcgaggagtctggcaaggcctaagccacgagctgggaataactgccttttctgaggatctgggaataactgcctatgcaaggcatgttagttcactttttgttgatgactctcctttcggtgttttacttcaggttccatacaattgtgtatgtatgtactatgtttgggcgtacctatctacgtaggtcgaggaacatgcatatgttgattgtataaccggctacacatacacatatatatttatatacaaaccacatactattgtcttgtt

SEQ ID NO: 2681 - DNA, 844 bp, Avena sativa
cctagctagcaatctcatcaactccttagcagtatacttgccaccatggcccccgccgtgatggcttcgtcggccaccaccgtcgcgcccttccagggcctcaagtccacagctggccttcccgtcagccgtcgcagctccggaagcctcggcagcgtcagcaacggtggaagaatcagatgcatgcaggtgtggccgattgagggcatcaagaagttcgagaccctgtcttacctgccaccactctcagaggaggccctcctgaagcagatcgacttcttgatccgctccaagtgggttccctgcctcgagttcagcaaggttggcttcatcttccgtgagcacggcagcactcctggatactacgacggcaggtactggacaatgtggaagctgcccatgttcggctgcaccgacgcctcacaggtcattaaggaggtggaggaggtgaagaaggagtaccctgacgcctatgtccgcatcattggcttcgacaacatccgtcaagtgcagtgcgtcagcttcatcgccttcaagccaccgggttgcgaggagtctggcaaggcataagttgtcagctgaaacaacggcctctatatatgaaacaacgtccagtatatacttttgccgatgactctgctcgagagtttgttttgcaatcaatatgattgtgtatgtacgagtatgcttgtatttatgtacctatcaacctagggtgaagagctcaaatgtgaattctagaaccggctacacataaggacatacacatatatattatttttgatgtgtttatatcccatccgcaagtgtgtttgatactttgatattaattgattggaatttc

SEQ ID NO: 2682 - DNA, 835 bp, Avena sativa
gcatagcctagctagctagctatctcatcaactccttagcagtatacttgccaccatggcccccgccgtgatggcttcgtcggccaccaccgtcgcgcccttccagggtctcaagtccaccgctggcctccccgtcagccgtcgcagctccggaagcctcggcagcgtgagcaacggtggaagaatcagatgcatgcaggtgtggccaattgagggcatcaagaagttcgagacactgtcttacctgccaccactctcagaagaagccctcctgaagcagatcgacttcttgatccgctccaagtgggttccctgcctggagttcagcaaggttggcttcatcttccgtgagcatggcagcactcccggatactacgacggcaggtactggacaatgtggaagctccccatgttcggatgcaccgacgcctcccaggtcatcaaggaggtggaggaggtcaagaaggagtaccctgacgcgtatgtccgcatcatcggcttcgacaacatccgtcaagtgcagtgcgtcagcttcatcgccttcaagccaccgggttgcgaggagtctggcaaggcctaagccacgagctgggaataaatgccttttctgagaatctgggaataactgcctatgcaaggcatgttactagttcactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaagaccaaaaaaaactaagagacac

SEQ ID NO: 2683 - DNA, 934 bp, Avena sativa
atagcctagctagctatctcatcaactccttagcagtatacttgccaccatggcccccgccgtgatggcttcgtcggccaccaccgtcgcgcccttccagggtctcaagtccaccgctggcctccccgtcagccgtcgcagctccggaagcctcggcagcgtgagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcccggatactacgatggcaggtactggacaatgtggaagctgcccatgttcggctgcaccgacgcctcccaggtcatcaaggaggtggaggaggtcaagaaggagtaccctgacgcgtatgtccgcatcatcggcttcgacaacatccgtcaggtgcagtgcgtcagcttcatcgccttcaagccaccaggctgcgaggagtccggcaaggcctaagccacgagctgggaataaatgccttttctgagaatctgggaataactgcctatgcaaggcatgttagttcactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaaaccacatactattgtcttcttgctagttgatggaaattttctttatttgctgctagaatgcctatgttttgctgttagttgaagtgtctttgttcacatttgtagaaaatgctttgtttcaactcttgttt

SEQ ID NO: 2684 - DNA, 796 bp, Avena sativa
gctagctatctcatcaactccttagcagtatacttgccaccatggcccccgccgtgatggcttcgtcggccaccaccgtcgcgcccttccagggtctcaagtccaccgctggcctccccgtcagccgccgcagctccggaagcctcggcagcgtgagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctggagttcagcaaggttggcttcatcttccgtgagcatggcagcactcccggatactacgacggcaggtactggacaatgtggaagctccccatgttcggatgcaccgacgcctcccaggtcatcaaggaggtggaggaggtcaagaaggagtaccctgacgcgtatgtccgcatcatcggcttcgacaacatccgtcaagtgcagtgcgtcagcttcatcgccttcaagccaccgggttgcgaggagtctggcaaggcctaagccacgagctgggaataaatgccttttctgagaatctgggaataactgcctatgcaaggcatgttagttcactttttgttgatgactctcctttcggggtttacttcaggttccatacaattctgtatgtatgtactatgtttgggcgtacctatctacgtaggtcgaggaacatgcatatgttgattgtataaccggctacacatacacatatatatttatatacaaac

SEQ ID NO: 2685 - DNA, 826 bp, Avena sativa
catagcctagctagctagctatctcatcaactccttagcagtatacttgccaccatggcccccgccgtgatggcttcgtcggccaccaccgtcgcgcccttccagggtctcaagtccaccgctggcctccccgtcagccgtcgcagctccggaagcctcggcagcgtgagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaagtgcagtgcgtcagcttcatcgccttcaagccaccgggctgcgaggaatccggcaaggcataagttgccagctgaaacagtggccgctatatgaaacaacggccgcgctatatacttttgccgacgactctgctccagggtttgttttacaagcaatatgattgtgtatgtacgtatgcttgtatgtatgtacctatcaacctagggtgaagagctcaaatgtgaattctagaaccggctatacgtaaggacatacgcattatttttttccgaatgtgtttatatccaatccacaagtgtgtttgataat

SEQ ID NO: 2686 - DNA, 746 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaaactgcctatgttcgggtgcaccgacgcacgcaggtgatcaacgaagtggaggaggcaagaaggagtacctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcatgtacgaacatggctcgagaaagcatgctcgtatgtgaatgctatcggtggctatgtatatgca

SEQ ID NO: 2687 - DNA, 851 bp, Leymus cinereus x Leymus triticoides
  misc_feature (764)..(764): n is a, c, g, or t
  misc_feature (769)..(769): n is a, c, g, or t
  misc_feature (772)..(772): n is a, c, g, or t
cctgcctctcctattagctatcaacgatggctcccactgtcatgtcgtcggcagccaccgccgtcgcacccttccaggggctcaagtccaccgctggcctcccagtcagccgccgctccggcagcgcggctggcctcggcagcgtcagcaacggcggaagaatccggtgcatgcaggtgtggccgattgaaggcatcaagaagttcgagactttgtcttacttgccaccgctctccacggaggcactcctcaagcaggtcgactacctgatccgctccaagtgggtgccttgtctcgagttcagcaaggttggcttcatcttccgtgagcacaatgcctctccagggtactacgacggccgatactggacaatgtggaagctacctatgtttgggtgcaccgacgccacacaggtgataaacgaggtggaggaggtcaagaaggagtaccctgacgcctatgtccgcatcatcggattcgacaacctgcgtcaggtgcagtgcgtcagcttcatcgccttcaaaccaccaggctgcgaggagtctggcaaggcctaaacaagctaactcccttttatcatacaacatggtttcgtgtcaggttgattttatttccctttttacttttgttctgcttgtgtatgtgttctccccctacaactcgagttaacattgtatgagtactacaatcataagagtactacaactatcgttgggtgagaaatatgtgaatgtaaactacggctatgcataaaggaaaatatncatgntangaataccagtgatatactatgccaccgtgttgacgatattgtctattatgtcaattctcggtacatgaatgtttattga

SEQ ID NO: 2688 - DNA, 694 bp, Festuca arundinacea
cctcttcttagtaaagcatatacagctaggcagctagctaagtgcgtactacaatggcccccgccgtgatggcttcctcggccactactgtggcgcccttccagggcctcaagtccaccgctggcctccccgtcagccgccgcagcgccgcaagcctcggcagcgtcagcaacggtggaaggatcaggtgcatgcaggtgtggccgattgagggcatcaagaaattcgagaccctatcttacctgccaccgctctcagcggaggacctcctgaagcagatcgactttttgatccgctccaaatgggttccctgcttggagttcagcaaggttggcttcatcttccgtgagcacggcagcactcccggatactacgacggcagatactggacaatgtggaagctgcccatgttcggctgcacagatgccgcccaggtcctcaaggaggtggaggaggtcaagaaagagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggctggtatataaaacaacggccgctatatacttttgccgaagactcggtttattttgcatttaatgtgattgtgttgcacgtattcttgtatgtatg

SEQ ID NO: 2689 - DNA, 714 bp, Lolium multiflorum
ctcctgctcccctccaacaccatggctcccaccgtgatggcttcctcggccaccaccgtcgcacccttccagggcctcaagtccaccgcgggcctccccgtcagccgccgcagcgccgccagcctcggcagcgtcagcaatggtggaaggatcagatgcatgcaggtgtggccgattgagggcatcaagaagttcgagaccctatcttacctgccaccgctctcagcggaggccctcctgaagcagattgacttcttgatccgctccaaatgggttccctgtctggagttcagcaaggttggcttcatcttccgcgagcacggcagcactcccggatactacgacggcaggtactggacaatgtggaagctgcccatgttcggctgcacagacgccgcccaagtcctcaaggaggtggaggaggtcaagaaggagtaccctgacgcctatgtccgcatcatcggtttcgacaacatccgtcaggtgcagtgcgtcagcttcatcgccttcaagccaccaggctgtgaggagtccggcaaggcataagctgccagctaggaatccgatatatgagtctcttggttcagttttcgatgacaactccgctttctgggttttacttttagttccacatataattgtgtgtgtatgcaagttgttaaatactttgagatcaacaagttgtaaagagtttgtgacccgtcaaaaaaaaaa

SEQ ID NO: 2690 - DNA, 707 bp, Lolium multiflorum
ctcctgctcccctccaacaccatggctcccaccgtgatggcttcctcggccaccaccgtcgcacccttccagggcctcaagtccaccgcgggcctccccgtcagccgccgcagcgccgccagcctcggcagcgtcagcaatggtggaaggatcagatgcatgcaggtgtggccgattgagggcatcaagaagttcgagaccctatcttacctgccaccgctctcagcggaggccctcctgaagcagattgacttcttgatccgctccaaatgggttccctgtctggagttcagcaaggttggcttcatcttccgcgagcacggcagcactcccggatactacgacggcaggtactggacaatgtggaagctgcccatgttcggctgcacagacgccgcccaagtcctcaaggaggtggaggaggtcaagaaggagtaccctgacgcctatgtccgcatcatcggtttcgacaacatccgtcaggtgcagtgcgtcagcttcatcgccttcaagccaccaggctgtgaggagtccggcaaggcataagctgccagctaggaatccgatatatgagtctcttggttcagttttcgatgacaactccgctttctgggttttacttttagttccacatataattgtgtgtgtatgcaagttgttaaatactttgagatcaacaagttgtaaagagtttgtgacccgtcaaa

SEQ ID NO: 2691 - DNA, 952 bp, Lolium multiflorum
cttcttagtaaagcatatacagctaggcagctagctaagtgcgtactacaatggcccctgccgtgatggcttcctcggccactactgtggcgcccttccagggcctcaagtccaccgctggcctccccgtcagccgccgcagcgccgccagcctcggcagcgtcagcaacggtggaaggatcaggtgcatgcaggtgtggccgattgagggcatcaagaaattcgagaccctatcttacctgccaccgctctcgcccgaggccctcctgaagcagatcgactttttgatccgctccaaatgggttccctgcttggagttcagcaaggttggcttcatcttccgtgagttcggcagcactcccggatactacgacggcaggtactggacaatgtggaagctgcccatgttcggctgcactgacgccgcccaggtcctcaaggaggtggaggaggtcaagaaggagtaccctgacgcctatgtccgcatcatcggttttgacaacatccgtcaggtgcagtgcgtcagcttcatcgccttcaagccaccaggctgcgaggagtccggcaaggcataagatgtgacccaggaataacagatgctagatgaagtgtctgttaaaatttgtcgacaattccgcttttatcgttttacttctggttccatataactgtgtagggaccaactgtgtatgtacacatatgtctatgtacgtacctcgcagccttgagtaagcctgttccatgttagcttgctttcgttgcatgatgtgtggtcttttttgttgttgttgagtgattatatcagccgggagtcgatggtggtttgaacttttacgtagatttattacgttgttgtgttaggtttgaggttgaattcttatatcaatagctggcagtgatcagttgctgtttgatccaaaaatatgtagagaaattaagtatggtttgtgtc

SEQ ID NO: 2692 - DNA, 777 bp, Festuca arundinacea
cctcttcttagtaaagcatatacaactaggcagctagctaagtgcgtactacaatggcccctgccgtgatggcttcctcggccactacagtggcgcccttccagggcctcaagtccaccgctggcctccccgtcagccgccgcagcgccgccagcctcggcagcgtcagcaacggtggaaggatcaggtgcatgcaggtgtggccgattgagggcatcaagaaattcgagaccctatcttacctgccaccgctctcggccgaggccctcctgaagcagatcgactttttgatccgctccaaatgggttccctgcttggagttcagcaaggttggcttcatcttccgtgagttcggcagcactcccggatactacgacggcaggtactggacaatgtggaagctgcccatgttcggctgcactgacgccacccaggtcctcaaggaggtggatgaggtcaagaaggagtaccctgacgcctatgtccgcatcatcggttttgacaacatccgtcaggtgcagtgcgtcagcttcatcgccttcaagccaccaggctgcgaggagtccggcaaggcataagctgccagctgaaacaacggccgctatatacttttgccgaagactcggtttattttgcatttaatgtgattgtgtttgcacgtattcaattatgtatgtacctaccgacctaggaagagctgatatgtgaattctagaaccggctacatgtaaaagcatacacatacacatataatattatatattatttccgagtgta

SEQ ID NO: 2693 - DNA, 891 bp, Avena sativa
gaagcatagcctagctagcaatctcatcaactccttagcagtatacttgccaccatggcccccgccgtgatggcttcgtcggccaccaccgtcgcgcccttccagggcctcaagtccaccgctggccttcccgtcagccgtcgcagctccggaagcctcggcagcgtcagcaacggtggaagaatcagatgcatgcaggtttggccgattgagggcatcaagaagttcgagaccctttcttacttgccaccactctcggaggaggcccttctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcaccgacgcctcccaggtgatcaaggaggtcgaggaggtcaagaaggagtaccctgacgcctatgtccgcatcatcggcttcgacaacatccgtcaagtgcagtgcgtcagtttcatcgccttcaagccaccgggttgcgaggagtctggcaaggcataagttgtcagctgaaacaacggccgctatagaaacaacggccacactatatacttttgccgatgactctgctcgagggtttgttttgcaatcaatatgattgtgtatgtacgagtatgcttgtatgtatgtacctatcaacctagggtgaagagctcaaatgtgaattctagaaccggctacacataattaaggacatacacatatatattatttttgaatgtgtttatattccatccgcaagtgtgtttgatattaattgattggaatttatatttatttgtcctgctttttgataaaaaaaaaaaaaaaaaa

SEQ ID NO: 2694 - DNA, 865 bp, Avena sativa
caagcatagcctagctagctatctcatcaactccttagcactatacttgccaccatggcccccgccgtgatggcttcgtcggccaccaccgtcgcgcccttccagggtctcaagtccaccgctggcctccccgtcagccgtcgcagctccggaagcctcggcagcgtgagcaacggtggaagaatcagatgcatgcaggtgtggcctattgagggcatcaagaagttcgagaccctgtcttacctgccaccactctcagaggaggccctcctgaagcagatcgatttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtctggcaaggcataagccacgagctgggaataactgccttttctgagaatctgctgggaataactgcctatgcaaggcatgttagttcactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaaaccacatactattgtcttcttgctagttgatggaaattttctttatttgctgct

SEQ ID NO: 2695 - DNA, 574 bp, Hordeum vulgare
cttctagcaagctatatacctacatagtacagccatggcccccaccgtgatggcctcatcggccacctccgtcgctcctttccaggggctcaagtccaccgccggccttcccgtcagccgccgctccaacggcgctagctcggcagcgtcagaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagtttcatcgccttcaagccaccaggctgcgaggagtccggcaaggcataaacagctcactgacg

SEQ ID NO: 2696 - DNA, 796 bp, Pseudoroegneria spicata
ctgcctctcctattagctatcaacgatggctcccaccgtgatgtcgtcggcagccaccgccgtcgcacccttccaggggctcaagtccaccgctggcctcccagtcagccgccgctccggcagcgcggctggcctcggcagcgtcagcaacggcggaagaatccggtgcatgcaggtgtggccgattgaaggcatcaagaagttcgagaccttgtcttacctgccaccgctctccacggaggcccttctgaagcaggtcgactacctgatccgctccaagtgggtgccgtgtctcgagttcagcaaggttggcttcatcttccgtgagcacaatgcctctccagggtactacgacggccgatactggacaatgtggaagctacccatgtttgggtgcaccgacgccacacaggtgataaacgaggtggaggaggtcaagaaggagtaccctgacgcctatgtccgcatcatcggattcgacaacatgcgtcaggtgcagtgcgtcagcttcatcgctttcaagccaccaggctgcgaggagtctggcaaggcctaaacaagctaactcccttttatcatacaacatggtttcgtgtcaggttgattttatttcccttttttacttttgttctgcttgtgtatgtgttctctccctgcaattcgagttaacattgtatgagtactacaatcataagagtactacaactatcgttgggtgagaaatatgtgaatgtaaactacggctatgcataaaggaaatatatacatgatatgaataccagtgagatactaaaaa

SEQ ID NO: 2697 - DNA, 787 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaagtcaagaaggagtacctgacgcgtatgtccgcatcatcggattcacaacatgcgccaggtccagtgggtcagtttcatccccttcaagcccccgggttgcgaggagtccggcaaggcttaaacagttcactcacgacaggccataaataaagtgccattgcaggtttgcaactctgacattgctttgggttttccttcccatttatctttcttatttggtcctaagaaaatgtgtatgccatgttcatgtaccaacatggctcgagaaagcatgctcgtatgagaatgctatcggtggctatgtatatgaacggacgcataatattatccaatatgtcgactataaacgttttaatggt

SEQ ID NO: 2698 - DNA, 589 bp, Hordeum vulgare
tcctctctacagttaatacagtaccatggcccccgccgtgatggcttcgtcggctaccaccgtcgcacccttccaggggctcaagtccacagccggtctccccgtcagccgccgctccagcgccagcctcggcagcgtcagcaatggcggaaggatcaggtgcatgcaggtgtggccgattgagggtatcaagaagttcgagaccctgtcttacttgccacccctcaccacggaggccctcctgaagcaggttgactacctgatccgctccaagtgggtgccctgcctcgagttcagcaaggttggcttcgtcttccgtgagcacaacagctcccccgggtactacgacggccgatactggacaatgtggaagctgcctatgtttgggtgcaccgacgctacacaggtgcttaacgaggtggaggaggtcaagaaagaataccctgacgcttacgtccgtatcatcggctttgacaacctgcggcacgtgcggtgcgtcagcttctgcgccttaagccaccggggtgcgaggagtccggcaaggccttaattccaagggaaacaatggcctttgttgtatgaaaggctt

SEQ ID NO: 2699 - DNA, 609 bp, Avena sativa
tactgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgt

SEQ ID NO: 2700 - DNA, 874 bp, Avena sativa
ggcaagtgtagcctgcctactgctctcttccaataccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacctgccaccactctcagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcccaggtgatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaacccaggcaatgcaaatgaggtttctgatttatgtgagggattctatctgtttctttttgatgttgtttggaatctggatatatatacgtagccatgtgatgcaagtgtaagactactttttttcccagtatgtttctacataaataaaacaa

SEQ ID NO: 2701 - DNA, 891 bp, Avena sativa
cttccccatctgttaggaaagcaaccggctgagcacatggctatgtataccctgctgacccagcaatgggggccgcaagtgtagcctgcctactgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgaggttttacttctggttccatataatagggcgatgaacaatcgcaggcttgggtaaagtctgttccttcgtagattgtcttcgttgattaacccaggcaatgcaaatgaggtttctgatttatgcgaaggattctatccgtttgttttttatgttgtttggaatctggatatatatatatatatata

SEQ ID NO: 2702 - DNA, 913 bp, Avena sativa
gtaagaaaggaacggcgctaagcctaaggcgagccgtataaaacgcgtcggcccagacatggaggggcctcaagcatagcctagctagcaatctcatcaactccttagcagtatacttgccaccatggcccccgccgtgatggcttcgtcggccaccatcgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcacccccggatactacgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaagtgcagtgcgtcagtttcatcgccttcaagccaccgggttgcgaggagtctggcaaggcataagttgtcagctgaaacaacggccgctatatgaaacaacggccacactatatacttttgccgatgactctgctcgagggtttgttttgcaatcaatatgattgtgtatgtacgagtatgcttgtatgtatgtacctatcaacctagggtgaagagctcaaatgtgaattctagaaccggctacacataaggacatacacatatatattatttttgatgtgtttatatcccatccgcaagtgtgtttcatactttgatattaattga

SEQ ID NO: 2703 - DNA, 855 bp, Avena sativa
gggaggcctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcctaagttgtcagctgaaacaacggtcactatatacttttgccgacgaactctgctccagggtttgttttgcaatcaatatgattatgtgcgtatatatgcttgtatttgtatgtatgtacctatcaacctagcgtgaagagctcaaatgtgaattctagaaccggctacacataaggacatacacatatatatatatatatatattattttcgattgtgtttatatcgaatccgcaagtgtgtttgatattaattgattggaatctc

SEQ ID NO: 2704 - DNA, 934 bp, Avena sativa
agcctgcctactgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcacaggtgatcaaggaggtggaggaggtcaagaaggagtaccctgacgcctatgtccgcatcatcggcttcgacaacatccgtcaagtgcagtgcgtcagcttcatcgccttcaagccaccgggttgcgaggaatccggcaaggcataagctgcaacccgggaataacagatgctgtatgtaaatttgtcgacaattctgtattttgtaggttttacttctggtatgtatgcgtacacgtatgtatctcaaaccaggacaaatggaatgtaacgggccaggacaaatggtttcggggagttttaggccgtccggtttggaccattagtcctggccccagccatggccgcgactaatggcccgaacaaatggtccgttttctactagtatactacaccattttgaccttgttactagtttgctattctttctcatgttcatatattctggtatctgatgattgagataccttgattacccggatagattaattgtataaattaaccgattgaaatcccataattatttgca

SEQ ID NO: 2705 - DNA, 814 bp, Avena sativa
cctactgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggtttgttttacaagcaatatgattgtgtatgtacgtatgcttgtatgtatgtacctatcaacctagggtgaagagctcaaatgtgaattctagaaccggctatacgtaaggacatacgcattatttttttccgaatgtgtttatatccaatccacaagtgtgtttgataataaattgattggatttctatc

SEQ ID NO: 2706 - DNA, 784 bp, Festuca arundinacea
  misc_feature (137)..(137): n is a, c, g, or t
ggcacgaggctgccttctgctcccctccaataccatggctcccaccgtgatggcttcctcggccaccaccgtcgcacccttccagggcctcaagtccaccgcgggcctccccgtcagccgccgcagcgccgccagcntcggcagcgtcagcaatggtggaaggatcagatgcatgcaggtgtggccgattgagggcatcaagaagttcgagaccctatcttacctgccaccgctctcggcggaggccctcctgaagcagatcgacttcttgatacgctccaaatgggttccctgtctggagttcagcaaggttggcttcatcttccgtgagcacggcagcactcccggatactacgacggcaggtactggacaatgtggaagctgcccatgttcggctgcacagacgccgcccaagtcctcaaggaggtggaggaggtcaagaaggagtaccctgacgcctatgtccgtatcatcggtttcgacaacgtccgtcaggtgcagtgcgtcagcttcattgccttcaagccaccaggctgtgaggagtccggcaaggcataagctgtgagctaggaatccgatatatggagtctcttggttcagttttcgatgacaactccgctttccgggttttacttttagttccacatataattgtgtgtgtatgcaagttgttaaatactttgagatcaacaagttgtaaagagtttgtgacccgtcaaatactgaatatctatatatctcaccgggttgcgatggagtttagcgcaatctacattcacggta

SEQ ID NO: 2707 - DNA, 924 bp, Avena sativa
  misc_feature (889)..(889): n is a, c, g, or t
agtatacttaccaccatggcccccgccgtgatggcatcgtcggccacctcggtagcgcccttccagggcctcaagtccactgctggccttcccgtcagccgccgcagcaacgccggccttggcagcgtcagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctggagtttagcaaggttggcttcatcttccgcgagcacggcagcactcccggatactacgatggcaggtactggacaatgtggaagctgcccatgttcggctgcaccgacgcctcacaggtcatcaaggaggtggaggaggtgaagaaggagtaccctgacgcctatgtccgcatcattggcttcgacaacatccgtcaagtgcagtgcgtcagcttcatcgccttcaagccaccaggttgcgaggaatccggcaaggcctaagccacgagctgcgaataacagatgctgtatgaagtgtcttgttcaaatttgtcgacaattctgattttggggttttacttctggttccatataaatatgtatgcgtatacgtatgtatgtatgtacatacgaacctaggtcgatatgaacactcgcaggcttgggaaagtctgttccttctttagattgtcttcgttgattaagattaacccacgcaacacaaatgaggtttctgatttatacgagtgattctacatgtttaccggtgatgttgtttggaatttggatacgtatgcatgttatccaagtgtaagtttacttttttttcagtgtgttgcaatataatagnaacaagttgtgctttagaaaaggaaaaaaaaaaaa

SEQ ID NO: 2708 - DNA, 861 bp, Brachypodium distachyon
accgcagtgcgtgcctcaagccaaagcctcttgctaagcgtaccacactatacagacgtgcgcgcgcagccatggcacccaccgtgatggcttcctccgccacctccgtggctcctttccaggggctcaagtccaccgccggcctccccgtcgccagccgccgctcctccaacagcctcggcagcgtcagcaacggtggaaggatcaggtgcatgcaggtgtggccgatcgagggcatcaagaagttcgagaccctctcgtacctgccccctctctccgtggagtctctcctgaagcagatcgagtacctgatccgctccaagtgggttccttgcctggagttcagcaaggtcggcttcgtcttccgcgagcacaacagctcccctgggtactatgatggcaggtactggacaatgtggaagctgcccatgttcgggtgcaccgacgccacacaggtgctcaaggagctggaggaggtcaagaaggagtacccggacgcctatgtccgcatcatcggcttcgacaacacccggcaggtgcagtgcatcagcttcatcgccttcaagcctccaggctgcgaggagtccggcaaggcctaaacagcagctcactgatctggattgatctgttggagtcccatatatatatgtataagatgccagcccggtttcgtcaaccatggcattttgctttgcgtttttcctttccggtttgttatttctctttgtccctatggatatcgtgtgtgtacatttgaatgtaccgacatgggctcgaggagcatatgtacatttgaaccctgactacacatatacacacatatacatgtaatattatacaatctgtcgagtatgtgttggt

SEQ ID NO: 2709 - DNA, 1376 bp, Brachypodium distachyon
gaacccaataagctagcagcctcttctcgcttgctctacctgctgcttgcaaccatggcacccaccgtgatggcttcctccgccacctccgtggcccctttccagggcctcaagtccaccgccggcctccccctcagccgccgctcctccaacagcctcggccgcgtcagcaacggcggaaggatcagctgcatgcaggtgtggccgatcgagggcatcaagaagttcgagaccctctcgtacctgccccctctctccgtggagtctctcctgaagcagatcgagtacctgatccgctccaagtgggttccttgccttgagttcagcaaggtcggctttgtgttccgtgagcacaacagctctcctgggtactacgacgggaggtactggacaatgtggaagctgcccatgttcgggtgcaccgacgccacgcaggtgctcaaggagctggaggaggtcaagaaggagtacccggacgcctacgtccgcatcatcggcttcgacaacacccggcaggtgcagtgcatcagcttcatcgccttcaagccaccgggctgcgaggaatccggcaaggcataaacaaccaaggacagctccgtattaagatggaccatatataaagtgtcagctcagttttgtcaactctgacattgctttgagttttctatttttcatccccaagattgttgttgtgtgtagcaacctggctctcgatcgaggagctagcttgcatatgtgaattcctaaaagtttgaaagagttgagaaaatcactttctttcttataacacagagtactttgtctaaatactgcaaattaacactacagcattaggcaattactgtgttcttctccatactcgtcttcccatttcccaaacacacatgtagccctgttcaaagacaaatagtcgactctccgatcagactcctgccacgttgtgcaaagacgaacgagactgcaggaaagctcttgacgttcaagatggggaaatctgcggcgccatgcgcggaggagggcacgtttccacaattcaacgttaagatcatgcggcacaaatccgatcttgccggtggcagaggaatgaaccggtgatgcggctcatcaggatccgcaaagacgctgatcgaggttgcacgcctcgcttctgactgcggaaacttctgccgctagcatgacaataagctattaccaatcatggtgctcctaattctgttgaaacatgtggttcgagatttcgagaaatcgatgagaacggaacaacgcttcacagaagaagcaatttgagatttgtgagtcacacactcacatgatgtgctgtaaaccagaccttacaagatttatcccccttttcaccatgtaaatagagtaaacta

SEQ ID NO: 2710 - DNA, 843 bp, Avena sativa
gaggcctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcccaggtgatcaaggaggtggaggaggtgaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattatgtgcgtatatatgcttgtatttgtatgtatgtacctatcaacctagcgtgaagagctcaaatgtgaattctagaaccggctacacataaggacatacacatatatatattattttcgattgtgtttatatcgaatccgcaagtgtgtttgatattaattgattggaatctc

SEQ ID NO: 2711 - DNA, 799 bp, Hordeum vulgare
gtacagccatggcccccaccgtgatggcctcatcggccacctccgtcgctcctttccaggggctcaagtccaccgccggccttcccgtcagccgccgctccaacggcgctagctcggcagcgtcacaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgttcaacgaggtggaggaggtcaagaaggagtaccctgacgcgtatgtccgcatcatcggattcgacaacatgcgtcaggtgcagtgcgtcagtttcatcgccttcaagccaccaggctgcgaagagtccggcaaggcataaacagctcactgacgatgggccacatataaagtgccattgcagttttgtcaattctgacattgctttgggttttccttctccattatctttcttatttgttcctaaaaatgtgtgtatgcccatgttcatgtaccaacatggctcgagaaagcatgttcgtatgtgaatgctatcggtggctatgtatatgcacatgcacataatattatccaatctgtcgactatgtaatatgtattcgagtaattaatgagaaacatctttgcc

SEQ ID NO: 2712 - DNA, 804 bp, Avena sativa
gcctactgctctcttccattaccatggctcccaccgtgatggcttcgtcggccaccaccgtcgcgcccttccagggcctcaagtccaccgctggcctccccgtccagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgaggttttacttctggttccatataatagggcgatgaacaatcgcaggcttgggtaaagtctgttccttcgtagattgtcttcgttgattaacccaggcaatgcaaatgaggtttctgatttatgcgaaggattctatccgtttgttttttattgttgtttggaatctggatatatatatatatata

SEQ ID NO: 2713 - DNA, 853 bp, Avena sativa
cctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtgggaagctgcccatgttcggctgcaccgacgcctcacaggtgatcaaggaggtggaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggtttgttttacaagcaatatgattgtgtatgtacgtatgcttgtatgtatgtacctatcaacctagggtgaagagctcaaatgtgaattcttgaaccggctatacgtaaggacatacacattattttttttccgaatgtgtttatatccaatccacaagtgtgtttgataataattgattggaatttcta

SEQ ID NO: 2714 - DNA, 553 bp, Hordeum vulgare
agcctgcctctcctattagctatcaacgatggctcccactgtcatgtcgtcggcagccaccgccgtagcacccttccagggactcaagtccacagctggtctcccagtcagccgcctctccggcaacgcggctggcctcggcagcgtcagcaacggcggaagaatccggtgcatgcaggtctggccgattgaaggcatcaagaagttcgagactttgtcttacttgccaccgctctccacggaggcactcctgaagcaggtcgactacctgatccgctccaagtgggtgccttgtctcgagttcagcaaggttggattcatcttccgtgagcacaatgcctctccagggtattacgatggccgatactggacaatgtggaagctacctatgtttgggtgcaccgacgccacacaggtgttaaacgaagtggaggaggtcaagaaggagtaccctgacgcctatgtccgcatcatcggattcgacaacatgcgtcaggtacagtgcgtcagcttcatcgccttcaagccaccaggctgcgaggagtctggcaag

SEQ ID NO: 2715 - DNA, 785 bp, Leymus cinereus x Leymus triticoides
  misc_feature (26)..(26): n is a, c, g, or t
  misc_feature (43)..(43): n is a, c, g, or t
  misc_feature (82)..(82): n is a, c, g, or t
  misc_feature (105)..(105): n is a, c, g, or t
ccatggcccccactgtgatggcttcntcggccacctcggtcgngcccttccagggtctcaagtccaccgccggcctgcccgncagccgccgctccagcagcgccngcctcagcagcgtcagcaacggtggaaggatcaggtgcatgcaggtgtggccgatcgagggcatcaagaagttcgagaccctgtcttacttgccaccgctctccacggaggccctcctgaagcagatcgactacctgatccgctccaagtgggtgccctgcctcgagttcagcaaggttggcttcgtcttccgtgagcacaacagctcccccgggtactacgacggccgatactggacaatgtggaagctgcctatgttcggctgcaccgatgccacacaggtgctcaaggagctggaggaggtcaagaaggagtaccctgacgcatatgtccgcatcatcggtttcgacaactatcgtcaggtgcagtgcatcagcttcatcgcctacaagccaccaggctgcgaggagtccggcaaggcctaaactacgagttgaaacaatggcctatgtatgaaggtcgatcttttgtgaacttcgcttttgtcgacgactttgctttccgaccagagcttattttccgttctatatgatctgtgtatgtacgaacgaacataggttgtggagcatgcatatgtaaattctagcaccggctacacatatacaacacctgtgtgatatttattatatacaacacgcggactttacttatcaatacaaatttcagtttctttacttatc

SEQ ID NO: 2716 - DNA, 760 bp, Lolium multiflorum
gtctcctgctcccctccaacaccatggctcccaccgtgatggcttcctcggccaccaccgtcgcacccttccagggcctcaagtccaccgcgggcctcccagtcagccgccgcagcgccgccagcctcagcagcgtcagcaatggtggaaggatcagatgcatgcaggtgtggccgattgagggaatcaagaaattcgagaccctatcttacctgccaccgctctcgcccgaggccctcctgaagcagatcgactttttgatccgctccaaatgggttccctgcttggagttcagcaaggttggcttcatcttccgtgagttcggcagcactcccggatactatgacggcaggtactggacaatgtggaagctgcccatgttcggctgcactgacgccgcccaggtcctcaaggaggtggaggaggtcaagaaggagtaccctgatgcctatgtccgcatcatcggttttgacaacatccgtcaggtgcagtgcgtcagcttcatcgccttcaagccaccaggctgcgaggagtctggcaaggcataagatgcgacccaggaataaacagcctatgcaaggcatgttactatttatgctgacgactctgctttcggggctttacttgtgcttccacataattgtgcatgtatgtacttacctatatcacctgggtcgaggaacatttatatgtcaattctaccacaggctacacatacacatatgtatttatatacagtctacatgctattgtgcttgtt

SEQ ID NO: 2717 - DNA, 855 bp, Avena sativa
gattgggaggcctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtgtggccaattgagggcatcaagaagttcgagaccctatcttacttgccaccactctcagaggaggccctcctaaagcagatcgacttcttgatccgctccaagtgggttccatgcctggagttcagcaaggttggcttcatcttccgtgagcacggcagcactcccggatactacgacggcaggtactggacaatgtggaagctgcccatgttcggctgcaccgacgcctcccaggtgatcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggaaaggcctaagttgtcagctgaaacaacggccactatatacttttgccgacgaactctgctccagggtttgttttgcaatcaatatgattgtgtatgtgcgtatatatgcttgtatttgtatgtatgtacctatcaacctagcgtgaagagctcaaatgtgaattctagaaccggctacacataaggacatacacatatatatattattttcgattgtgtttatatcgaatccgcaagtgtgtttgatattaattgattggaatctcta

SEQ ID NO: 2718 - DNA, 830 bp, Avena sativa
agttatttgcggcattgggaggcctcaagtgtagacaacctatctgagttaacaggcacatcggcagcaaactacgtgataccatggcccccgccgtgatggcttcgtcggccaactcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattgtgtatgtgcctatatatgcttgtatttgtatgtatgtacctatcaacctagcgtgaagagctcaaatgtgaattctagaaccggctacacataaggacatacacatatatatatattattttcgattgtgtttctatggaa

SEQ ID NO: 2719 - DNA, 846 bp, Avena sativa
agcatagctaactatcggagcatctaactagcagtatacttaccaccatggcccccgccgtgatggcatcgtcggccacctcggtcgcgcccttccagggcctcaagtccactgctggccttcccgtcagccgccgcggcaacgccggccttggcagcgttagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgccttcaagccaccgggctgcgaggaatccggcaaggcataagttgccagctgaaacagtggccgctatatgaaacaacggccgcgctatatacttttgccgacgactctgctccagggttttgttttacaagcaatatgattgtgtatgtacgtatgcttgtatgtatgtacctatcaacctagggtgaagagctcaaatgtgaattctagaaccggctatacgtaaggacatacgcattattttttttccgaatgtgtttatatccaatccacaagtgtgtttgataataattgattggaatttctattaatgc

SEQ ID NO: 2720 - DNA, 881 bp, Avena sativa
gtgtagcctgcctactgctctcttccattaccatggctcccaccgtgatggcttcgtcggccaccaccgtcgcgcccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacctgccaccactctcagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcccaggtgatcaaggaggtggaggaggtcaagaaggagtaccctgacgcctatgtccgcatcatcggcttcgacaacatccgccaagtgcagtgcgtcagcttcatcgccttcaagccaccgggttgggaggagtccggcaaggcctaagccgcgagctgggaataacagatgctttatgaagtgttttgttcaaatttgtcgacaattttgattttgaggttttacttttggttccatataatagggggatgaacaatcacaggcttgggtaaagtttgttcctttttagattgttttcgttgattaaccccggcaaagcaaatgaggtttttgatttatgtgagggattctatttgtttttttttgatgttgtttggaatctggaaaaatatacgtagccatgtgatgcaagtgtaagactactttttttcccagtatgtttttacataaaaaaaacaagtttgagttttt

SEQ ID NO: 2721 - DNA, 764 bp, Avena sativa
gccttgcctactgctctcttccaataccatggctcccaccgtgatggcttcgtcggccaccaccgtcgcgcccttccagggcctcaagtccaccgctggccttcccgtcagccgtcgcagcaatgccggccttggcagcgtcagcaacggtggaagaatcagatgcatgcaggtgtggccgattgagggcatcaagaagttcgagaccctttcttacctgccaccactctcagaggaggccctcctgaagcagatcgacttcttgatccgctccaagtgggttccctgcctcgagttcagcaaggttggcttcatcttccgcgagcacggcagcacccccggatactacgacggcaggtactggacaatgtggaagctgcccatgttcggctgcaccgacgcctcccaggtgatcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggaaaggcctaagttgtcagctgaaacaacggccactatatactttgccgacgaactctgctccagggtttgttttgcaatcaatatgattgtgtatgtgcgtatatatgcttgtatttgtatgtatgtacctatcaacctagcgtgaagagctcaaatgtgaattctagaaccggctacacataaggacatacacatatatatattattttcgattgtgttt

SEQ ID NO: 2722 - DNA, 726 bp, Avena sativa
ttccattaccatggctcccaccgtgatggcttcgtcggccaccaccgtcgcgcccttccagggcctcaagtccaccgctggcctccccgtcagccgtcgcagctccggggtcctcggcagcgtcagcaacggcggaaggatcaggtgcatgcaggtgtggccgattgagggcatcaagaagttcgagaccctttcttacttgccaccactctcggaggaggccctcctgaagcagatcgacttcttgatccgctccaagtgggttccctgcctggagttcagcaaggttggcttcatcttccgcgagcacggcagcactcccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcctaagttgtcagctgaaacaacggtcactatatacttttgccgacgaactctgctccagggtttgttttgcaatcaatatgattatgtgcgtatatatgcttgtatttgtatgtatgtacctatcaacctagcgtgaagagctcaaatgtgaattctagaaccggctacacataaggacatacacatatatatat

SEQ ID NO: 2723 - DNA, 924 bp, Avena sativa
taactatcggagcatctaactagcagtatacttaccaccatggcccccgccgtgatggcatcgtcggccacctcggtcgcgcccttccagggcctcaagtccactgctggccttcccgtcagccgccgcggcaacgccggccttggcagcgttagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcccggatactacgatggcaggtactggacaatgtggaagctgcccatgttcggctgcaccgacgcctcacaggtcatcaaggaggtggaggaggtgaagaaggagtaccctgacgcctatgtccgcatcattggcttcgacaacatccgtcaagtgcagtgcgtcagcttcatcgccttcaagccaccgggttgcgaggaatccggcaaggcctaagccacgagctgcgaataacagatgctgtatgaagtgtcttgttcaaatttgtcgacaattctgattttggggttttacttctggttccatataaatatgtatgcgtgtacgtatgtatgtatgtacatacgaacctaggtcgatatgaacactcgcaggcttgagaaagtctgttccttctttagattgtcttcgttgattaagattaacccacgcaacacaaatgaggtttctgatttatacgagtgattctatatgtttaccggtgatgttgtttggaatctggatacgtatgcatgttatccaagtgtaagtttacttttttttcagtgtgttgcaatataaatagaacaagtttgt

SEQ ID NO: 2724 - DNA, 796 bp, Avena sativa
accatggcccccgccgtgatggcctcgtcggccacctccgtcgcgcctttccagggactcaagtccaccgcaggactccctgtcagccgccgcagcgcctccagcctcggcaacgtcagcaacggtggaaggatcagatgcatgcaggtgtggccgattgagggcatcaagaagttcgagaccctgtcttacttgccaccactctcagaggaggccctcctgaagcagatcgacttcttgatccgctccaagtgggttccttgcctcgagttcagcaaggttggcttcatcttccgcgagcacggcagcacccccggatactacgacggcaggtactggacaatgtggaagctgcccatgttcggctgcaccgacgcctcacaggtcatcaaggaagtggaggaggtgaagaaggagtaccctgacgcctatgtccgcatcatcggcttcgacaacatccgtcaagtgcagtgcgtcagcttcatcgccttcaagccaccgggttgcgaggagtccggaaaggcataagctgcgcccgagcagggaataacagcatatacatatatacaattataccaaggttttactcatggcatacgcatgccatttcattttttgttgacgactctgcattcagggttttactcatgattccatacaattatgcaagtacctatcaacgtaggtggaggatcatgcatatgtcgattgtacaactggctgcacatacacatatatacaatgcaaagacgattgtcttcttgttaattgataaaaaaattctctatttgcggct

SEQ ID NO: 2725 - DNA, 886 bp, Avena sativa
cgcaacccagcattgcggcattgggaggcctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctttcttacctcccaccactctcagaggaggccctcctgaagcagatcgacttcttgatccgctccaagtgggttccctgcctcgaattcagcaaggttggcttcatcttccgcgagcacggcagcactcctggatactatgacggcaggtactggacaatgtggaagctgcccatgttcggctgcaccgacgcctcccaggtgatcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggaaaggcctaagttgtcagctgaaacaacggccactatatacttttgccgacgaactctgctccagggtttgttttgcaatcaatatgattgtgtatgtgcgtatatatgcttgtatttgtatgtatgtacctatcaacctagcgtgaagagctcaaatgtgaattctagaaccggctacacataaggacatacacatatatatattattttcgattgtgtttatatcgaatccgcaagtgtgtttgatattaattgattggaatctctattaatgtgtactg

SEQ ID NO: 2726 - DNA, 711 bp, Festuca arundinacea
gctagttatctcattctctccttagcaataatacttagcactatggcccccgcggtgatggcttcgtcagccacctccgtcgcgcccttccagggcctcaagtccaccgctggcctcccggtcagccgccgcagcaacgctggcctcggcagagtcagcaacggcggaaggattaggtgcatgcaggtgtggccgatagagggcatcaagaagttcgagaccctttcctacctgccaccgctgtccacggaggaactcctgaagcagatcgacttcctcatccgctctaagtgggttccctgcttggagttcagcaaggtcggcttcgtcttccgcgagttcggcagcactcccggatactacgacggcaggtactggacaatgtggaagctgcccatgttcggctgcaccgacgccgcacaggtcgccaaggaggtggaggaggtcaagaaggagtaccctgacgcctatgtccgcatcatcggcttcgacaacgtccgtcaagtgcaatgcgtcagcttcatcgcctacaagccaccaggctgcgaggagtccggcaaggcataaactgcaagctgcgaataacagcagcctatacaagttcactttttttttgttgacgactctggtttcagggttttacttctgcttccatatacactgtgtaccaaatatttacgtacctatcaacgtgggtcgacaagcttaatt

SEQ ID NO: 2727 - DNA, 498 bp, Secale cereale
  misc_feature (2)..(2): n is a, c, g, or t
  misc_feature (13)..(13): n is a, c, g, or t
  misc_feature (24)..(24): n is a, c, g, or t
  misc_feature (55)..(55): n is a, c, g, or t
  misc_feature (64)..(64): n is a, c, g, or t
  misc_feature (99)..(99): n is a, c, g, or t
  misc_feature (142)..(142): n is a, c, g, or t
  misc_feature (199)..(199): n is a, c, g, or t
  misc_feature (206)..(206): n is a, c, g, or t
  misc_feature (244)..(244): n is a, c, g, or t
  misc_feature (283)..(283): n is a, c, g, or t
  misc_feature (298)..(298): n is a, c, g, or t
  misc_feature (304)..(304): n is a, c, g, or t
  misc_feature (316)..(316): n is a, c, g, or t
  misc_feature (319)..(319): n is a, c, g, or t
  misc_feature (352)..(352): n is a, c, g, or t
  misc_feature (358)..(358): n is a, c, g, or t
  misc_feature (478)..(478): n is a, c, g, or t
  misc_feature (495)..(495): n is a, c, g, or t
cntgatggcttcntcggctaccancgtcgcacccttccaggggctcaagtccacngccggtctncccgtcagccgccgctccagcggcagcctcggcancgtcagcaatggcggaaggatcaggtgcatgcaggtgtggccnattgagggcatcaagaagttcgagaccctgtcttacttgccacccctctccacggangccctcntgaagcaggtcgactacctgatccgctccaagtgggtnccctgcctcgagttcagcaaggttggcttcgtcttccgngagcacaacagctcncccggntactacgacggncgntactggacaatgtggaagctgcctatgttcggntgcacngacgccactcaggtgctcaatgaggtggaggaggtcaagaaggagtaccctgacgcctatgtccgcgtcatcggcttcgacaacctgcgccaggtgcagtgcgtcagcttcatcgccttnaggccaccgggttgcgngga

SEQ ID NO: 2728 - DNA, 686 bp, Gossypium hirsutum
caaaaagacctgggggaccttccacgcgccggtggcgcgtgcgcgctcctagtaactagctcggaatcccccgggactgcagggaattcggcaccagtagcaagctatatacctacatagtacagctatggcccccaccgtgatggcctcgtcggccacctccgtcgctcctttccaggggctcaagtccaccgccggcctccccgtcagccgccgctcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttaatgggcttcaagccaccaggctgcgaggagtccggcaaggcaaaaacagcccactgacgatgggccacatataaag

SEQ ID NO: 2729 - DNA, 872 bp, Hordeum vulgare
gcctgcctctcctattagctatcaacgatggctcccactgtcatgtcgtcggcagccaccgccgtagcacccttccagggactcaagtccacagctggtctcccagtcagccgcctctccggcaacgcggctggcctcggcagcgtcagcaacggcggaagaatccggtgcatgcaggtctggccgattgaaggcatcaagaagttcgagactttgtcttacttgccaccgctctccacggaggcactcctgaagcaggtcgactacctgatccgctccaagtgggtgccttgtctcgagttcagcaaggttggattcatcttccgtgagcacaatgcctctccagggtattacgatggccgatactggacaatgtggaagctacctatgtttgggtgcaccgacgccacacaggtgttaaacgaagtggaggaggtcaagaaagagtaccctgacgcctatgtgcgcatcatcggattcgacaacatgcgtcaagtgcactgcgtcagcttcatcgccttcaagccaccaggctgtgagaagtctggcaaggcctaaacaagctaactcccttttatcatacaaccatggaatgctgccaagctcatttatgtttcccttaaacttaaagacagctgtggatgcgagacactccctgcaacttgatttagcttgggttgaagtctacaggaagaagaaaaaagaaaaactcgtgggggggcccggagtgccaagggggccgtgagggagggggtgccaggagcctgggccgaggagggcacaggagaggccggggaaaccccggagagtccgaggttaaggaggtagagagcgtagcagcagaggtagctagaggagagtgaagatgaccg

SEQ ID NO: 2730 - DNA, 720 bp, Triticum aestivum
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgattcagcaagttgggttcatcttccgtgagcacaacgcatcccctgggtactacgatggccggtactggacaatgtggaaactgcctatgttcggatgcaccgacgccaccaagtgatcaacgaggtggaggagtcaagaaggagtacctgacgcctaagtccgcatcatcggattcgacaacatgcgccaggtgcagtgcgtcagcttcatcgccttcaagccaccgggctgcgaagagtccggcaaggcctaaacagctcactcacgacaggccacatataaagtgccattgcagttttgtcaactctgacattgctttgggttttccttttccatttatctttcttgtttgttcctaagataagaatatgtgtatgtccatgttcccgaccatgagctcgagaaagcatgctcgtatgtgaatgct

SEQ ID NO: 2731 - DNA, 796 bp, Avena sativa
tagcagtatacttaccaccatggccccgccgtgatggcatcgtcggccaccacggtcgcgcccttccagggctcaagtccaccgctggcctccccgtcagccgccgcagcaacggaagcctcggcagcgtgagcaacggtggaagaatcagatgcatgcaggtgtggccaattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatgaaacaacggccgcgctatatacttttgccgacgactctgctcctagggttttgttttgcaagcaatatgattgtgtatgtacgtatgcttgtatgtatgtacctatcaacctagggtgaagagctcaaatgtgaattctagaaccggctatacgtaaggacatacacatattattttttccgtaatgtgtttatatccaatccacaagtgtgtttgat

SEQ ID NO: 2732 - DNA, 809 bp, Avena sativa
gccatggtattggagtgcagcctgcttactgctctccaataccatggctcccaccgtgatggcttcgtcggccacctccgttgcgcccttccagggcctcaagtccaccgctggcctccccgtccagccgccgcagcaatgccggcctcggcagcgtcagcaacggcggaaggatcaggtgcatgcaggtgtggccgattgagggcatcaagaagttcgagaccctttcttacttgccaccactctcggaggaggccctcctgaagcagatcgacttcttgatccgctccaagtgggttccctgcctggagttcagcaaggttggcttcatcttccgcgagcacggcagcactcctggatactatgacggcaggtactggacaatgtggaagctgcccatgttcggctgcactgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattgtgtatgtgcgtatatatgcttgtatttgtatgtatgtacctatcaacctagcgtgaagagctacaaatgtgaattctagaaccggctacacataaggacatacacatatatatattattttcgattgtgtttatatcgaatccgcaagtgtgtttgata

SEQ ID NO: 2733 - DNA, 785 bp, Avena sativa
cctcaagtgtagacaacctatctgagttaacaggcacatcggcagcaaactacgtgataccatggcccccgcccgtgatggcttcgtcggccacctcggtcggcccccttccaggggctcaagtccactgctggccttcccgtcagccgccgcagcaacgccggccttggcagcgtcagcaacggtggaagaatccgatgcatgcaggtgtggcctattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcccggatactacgacggcaggtactggcaaatgtggaagctgcccatgttcggctgcaccgacgcctcacaggtcatcaaggaggtggaggaggtcaagaaggagtaccctgacgcttatgtccgcatcatcggcttcgacaacatccgtcaagtgcagtgcgtcagcttcatcgccttcaagccaccaggctgcgaggagtccggcaaggcataagccacgagctgggaataactgccttttctgagtatctgggaataactgcctatgcaaggcatgttagttcactttttgttgatgactctcctttcggtgttttacttcaggttccatacaattgtgtatgtatgtactatgtttgggcgtacctatctacgtaggtcgaggaacatgcatatgttgtattgtataac

SEQ ID NO: 2734 - DNA, 849 bp, Avena sativa
agtattgcggcattgggaggcctcaagtgtagacaacctatctgagttaacaggcacatcggcagcaaactacgtgataccatggcccccgcccgtgatggcttcgtcggccacctcggtcgccccttcccacggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaacaacggtcactatatacttttgccgacgaactctgctccagggtttgttttgcaatcaatatgattgtgtatgtgcgtatatatgcttgtatttgtatgtatgtacctatcaacctagcgtgaagagctcaaatgtgaattctagaaccggctacacataaggacatacacatatatatattattttcgattgtgtttatatcgaatccgcaagtgtgtttgatatt

SEQ ID NO: 2735 - DNA, 532 bp, Hordeum vulgare
agttaatacagtaccatggcccccgccgtgatggcttcgtcggctaccaccgtcgcacccttccaggggctcaagtccacagccggtctccccgtcagccgccgctccagcgccagcctcggcagggtcagcaatggcggaaggatcaggggggtgcaggtgtggccgattgagggtatcaagaagttcaagaccctgtcttacttgccacccctcaccacggaggccctcctgaagcaggttgactacctgatccgctccaagtgggtgccctgcctcgagttcaacaagggtggcttggtcttccgtgagcacaacagctcccccgggtactacgacggccgatactggacaatgtggaagctgcctatgttcggatgcaccgacgccacacaggtgcttaacgaggtggaggagggcaacaaggagtaccctgacgcttatgtccgtatcatcggcttctacaacctgcggcacgtgcattgcgtcatcttcatcgccttcacgccaccgggtcgcgaggagtcccgcg

SEQ ID NO: 2736 - DNA, 817 bp, Avena sativa
agcatagctaactatcggagtatctaactagcagtatacttaccaccatggcccccgccgtgatggcatcatcggccacctcggtcgctcccttccagggcctcaagtccactgctggccttcccgtcagccgccgcggcaacgccggccttggcagcgttagcaacggtggaagaatcagatgcatgcaggtgtggccaattgagggcatcaagaagttcgagaccctatcttacttgccaccactctcagaggaggccctcctaaagcagatcgacttcttgatccgctccaagtgggttccatgcctggagttcagcaaggttggcttcatcttccgtgagcacggcagcactcccggatactacgacggcaggtactggacaatgtggaagctgcccatgttcggctgcaccgacgcctcgcaggtgatcaaggaggtggaggaggtcaagaaggagtaccctgacgcctatgtccgcatcatcggcttcgacaacatccgtcaagtgcagtgcgtcagcttcatcgccttcaagccaccgggttgcgaggaatccggcaaggcataagctgcaacccgggaataacagatgctgtatgaaatttgtcgacaattctgattttgaggttttacttctggtatgtatgcgtacacgtatgtatctcaaaccaggacaaatggaatgtaacgggccaggacaaatggtttcggggagtttaggccgtccggtttggaccattagtcctggccccagccatggccgcgactaatggcccgaacaaatggtccgttttctactagtatactacacca

SEQ ID NO: 2737 - DNA, 756 bp, Avena sativa
ctccaataccatggctcccaccgtgacggcttcgtcggccacctctgtcgccccattccagggcctcaagtccactgctggtctccccgtcagccgtcgcagctccggaagcctcggcagcgtgagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcccggatactacgatggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcataagccgcgacctgggaataaccgactacgcaaggcatgttagttcactttctgttgacgactctcctttcggggttttacttcaggttccatacaattgtgtatgtatatatgtactatgtttgggcgtacctatctacgtaggtcgaggaacatgcatatgttgattgtataactggctacacatacacatgtatatttatatacaaacagaagactgttgt

SEQ ID NO: 2738 - DNA, 859 bp, Avena sativa
gcctgcttactgctctccaataccatggctcccaccgtgatggcttcgtcggccacctccgttgcgcccttccagggcctcaagtccaccgctggcctccccgtcagccgccgcagcaatgccggcctcggcagcgtcagcaacggcggaaggatcaggtgcatgcaggtgtggccgattgagggcatcaagaagttcgagaccctttcttacttgccaccactctcggaggaggccctcctgaagcagatcgacttcttgatccgctccaagtgggttccctgcctggagttcagcaaggttggcttcatcttccgcgagcacggcagcactcccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgacccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgtgatgcaagtgtaagccttttttcagtatgtttctacataaatagaacaattttg

SEQ ID NO: 2739 - DNA, 938 bp, Avena sativa
cggcacgaggctcatcctctacttagcagtatacttaccaccatggcccccgccgtgatggcctcgtcggccacctccgtcgcgcctttccagggactcaagtccaccgcaggactccccgtcagccgccgcagcgcctccagcctcggcaacgtcagcaacggtggaaggatcagatgcatgcaggtgtggccgattgagggcatcaagaagttcgagactctgtcttacctgccaccactctcagaggaggccctcctgaagcagatcgacttcttgatccgctccaagtgggttccctgcctcgagttcagcaaggttggcttcatcttccgcgagtacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggaaaggcataagctgccacctgaaacaacggccgctatatgaaatatatacttttgccgactgactctgctccagggtttgttttgcattcagtatgattgtgtatgtacgtatgcttgtatctatgtacctaccaacctagggtgaagagggctcatatgtgaattctacaaccggctacacataaggacatacacatatatattatttccgagtgtatttatatgcaatcagccgagtatttcttgctattaatttgatgggaatatctatttatttgccctgctggtcgattgaaagttgatgtatttttcacagataacatgctccttattatcaacacaaatttcacacgcctttactgataaaaaaaaaaaaaaaa

SEQ ID NO: 2740 - DNA, 922 bp, Avena sativa
cggcacgaggctcatcctctacttagcagtatacttaccaccatggcccccgccgtgatggcctcgtcggccacctccgtcgcgcctttccagggactcaagtccaccgcaggactccccgtcagccgccgcagcgcctccagcctcggcaacgtcagcaacggtggaaggatcagatgcatgcaggtgtggccgattgagggcatcaagaagttcgagactctgtcttacctgccaccactctcagaggaggccctcctgaagcagatcgacttcttgatccgctccaagtgggttccctgcctcgagttcagcaaggttggcttcatcttccgcgagtacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggaaaggcataagctgccacctgaaacaacggccgctatatgaaatatatacttttgccgactgactctgctccagggtttgttttgcattcagtatgattgtgtatgtacgtatgcttgtatctatgtacctaccaacctagggtgaagagggctcatatgtgaattctacaaccggctacacataaggacatacacatatatattatttccgagtgtatttatatgcaatcagccgagtatttcttgctattaatttgatgggaatatctatttatttgccctgctggtcgattgaaagttgatgtatttttcacagataacatgctccttattatcaacacaaatttcacacgcctttactgat

SEQ ID NO: 2741 - DNA, 729 bp, Festuca arundinacea
ggcacgaggcccagctagttatctcattctctccttagcaataatacttagcaccatggcccccgcggtgatggcttcgtcagccacctccgtcgcgcccttcctgggcctcaagtccaccgctggcctccccgtcagccgccgcagcaacgctggcctcggcagcgtcagcaacggcggaaggattaggtgcatgcaggtgtggccgattgagggcatcaagaagttcgagaccctttcctacctgccaccgctgtccacggaggaactcctgaagcagatcgacttcctcatccgctccaagtgggttccctgcctggagttcagcaaggtcggcttcgtcttccgcgagttcggcagcactcccggatactacgacggcaggtactggacaatgtggaagctgcccatgttcggctgcaccgacgccacacaggtcgccaaggaggtggaggaggtcaagaaggagtaccctgacgcctatgtccgcatcatcggcttcgacaacatccgtcaagtgcagtgcgtcagcttcatcgcctacaagccaccaggctgcgaggagtccggcaaggcataaactgcaagctgcgaataacagcagcctatacaagttcacttttttttgttgacgactctggtttcggggttttacttctgcttccatatacactgtgtaccaaatatttacgtacctatcaacgtgggtcgacaagcttaattttcctg

SEQ ID NO: 2742 - DNA, 896 bp, Avena sativa
ctactcccctgtgtgccttgcctactccccttgcgtgtctcagcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtgtggccaattgagggcatcaagaagttcgagaccctatcttacctgccaccactctcagaggaggccctcctgaagcagatcgacttcttgatccgctccaagtgggttccctgcctggagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatgaaacaacggccgcgctatatacttttgccgacgactctgctccagggttttggttttgcaagcaatatgattgtgtatgtacgtatgcttgtatgtatgtacctatcaacctagggtgaagagctcaaatgtgaattctagaaccggctatacgtaaggacatacacatattattttttccgaatgtgtttatatccaatccacaagtgtgtttgataataattgattggaatt

SEQ ID NO: 2743 - DNA, 566 bp, Avena sativa
tctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtctggcaaggcataagccgcgagctgggaataac

SEQ ID NO: 2744 - DNA, 820 bp, Avena sativa
tctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatccgatgcatgcaggtgtggcctattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggtttgttttacaagcaatatgattgtgtatgtacgtatgcttgtatgtatgtacctatcaacctagggtgaagagctcaaatgtgaattcttgaaccggctatacgtaaggacatacacatatttttttttccgaatgtgtttatatccaatccacaagtgtgtttgataataattgattggaatttcta

SEQ ID NO: 2745 - DNA, 765 bp, Avena sativa
gctagctatctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatccgatgcatgcaggtgtggccaattgagggcatcaagaagttcgagaccctgtcttacctgccaccactctcagaggaggctctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcataagccgcgacctgggaatataaccgactacgcaaggcatgttagttcactttctgttgacgactctcctttcggggttttacttcaggttccatacaattgtgtatgtatgtactatgttgattgtataactggctacacatacacatgtatatttatatacaaacggcagactattatcttattgttaattgatggaaagtttc

SEQ ID NO: 2746 - DNA, 823 bp, Avena sativa
ctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcataagttgccagctgaaacagtggccgctatatgaaacaacggccgcgctatatacttttgccgacgactctgctccagggtttgttttaaaagcaatatgactgtgtatgtacgtatgcttgtatgtatgtacctatcaacctagggtgaagagctgaaatgtgaattctagaaccggctatatgtaaggacatacacatatatttttttccgaatgtgtttatatccaatccacaagtgtgtttgataataattgattggaatttctattaa

SEQ ID NO: 2747 - DNA, 716 bp, Avena sativa
ctgcctccaacaccatggctcccaccgtgatggcttcgtcggccacctccgtcgcgcccttccagggcctcaagtccactgctggcctccccgtcagccgccgccgcagcaatgccggcctcggcagcgtcagcaacggcggaaggatcaggtgcatgcaggtgtggccgattgagggcatcaagaagttcgagaccctgtcttacttgccaccgctctcggaggaggccctcctgaagcagatcgacttcttgatccgctccaagtgggtcccctgcctggagttcagcaaggttggcttcatcttccgcgagcacggcagcacccccgggtactacgacggcaggtactggacaatgtggaagctgcccatgttcggctgcaccgacgcctcacaggtcatcaaggaggtggaggaggtcaagaaggagtaccctgacgcgtatgtccgcatcatcggcttcgacaacatccgtcaggtgcagtgcgtcagcttcatcgccttcaagccaccaggctgcgaggagtccggcaaggcctaagccacgagctgggaataaatgccttttctgagaatctgggaataactgcctatgcaaggcatgttagttcactttttgttgatgactctcctttcgggttttacttcaggttccatacaattctgtatgtatgtactatgtttgggtcgtacctatctacgtaggtcgaggaac

SEQ ID NO: 2748 - DNA, 868 bp, Avena sativa
gattcggacgaggcctgcttactgctctcctccataccatggctcccaccgtgatggcttcgtcggccacctccgtcgcgcccttccagggcctcaagtccaccgctggcctccccatcagccgccgcagcaatgccggcctcggcagcgtcagcaacggcggaaggatcaggtgcatgcaggtgtggccaattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcacaggtgatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgacccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgtgatgcaagtgtaagccttttttcagtatgtttctacataaatagaacaa

SEQ ID NO: 2749 - DNA, 707 bp, Avena sativa
ttgcctcctctcctccaataccatggctcccaccgtgacagcttcctcggccacctctgtcgcccccttccagggcctcaagtccaccgctggccttcccgtcagtcgtcgcagcaatgccggccttggcagcgtcagcaacggtggaagaatcagatgcatgcaggtgtggccgattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcccggatactacgatggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcctaagccacgagctgggaataaatgccttttctgagaatctgggaataactgcctatgcaaggcatgttagttctactttttgttgatgactctcctttcgggttttacttcaggttccatacaattctgtatgtatgtactatgttggcgtacctatctacgt

SEQ ID NO: 2750 - DNA, 562 bp, Avena sativa
cctgcttactgctctccaataccatggctcccaccgtgatggcttcgtcggccacctccgttgcgcccttccagggcctcaagtccaccgctggcctccccgtcaaccgccgcagcaatgccggcctcggcagcgtcagcaacggcggaaggatcaggtgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcacccccggatactacgacggcaggtactggacaatgtggaagctgcccatgttcggctgcaccgacgcctcccaggtgatcaaggaggtggaggaggtcaagaaggagtaccctgacgcctatgtccgcatcatcggcttcgacaacatccgccaagtgcagtgcgtcagcttcatcgccttcaagccaccgggttgcgaggagtctggcaaggcctaagccgcgagctggga

SEQ ID NO: 2751 - DNA, 837 bp, Avena sativa
tctcctccaataccatggctcccaccgtgacggcttcctcggccacctctgtcgcccctttccagggcctcaagtccactgctggccttcccgtcagccgtcgcagcaatgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcataagccgcgacctgggaatataaccgactacgcaaggcatgttagttcactttctgttgacgactctcctttcggggttttacttcaggttccatacaattgtgtatgtatgtactatgttgattgtataactggctacacatacacatgtatatttatatacaaacggcagactattatcttattgttaattgatggaaagtttctttattttctgctagaatgcctatgttttgctgttagttgaagtgtcttcgttcacatttgtagaaaatccttgtttcaacgctgtttttcggcc

SEQ ID NO: 2752 - DNA, 797 bp, Avena sativa
catggctcccaccgtgacagcttcctcggccacctctgtcgcccccttccagggcctcaagtccaccgctggccttcccgtcagccgtcgcagcaatgccggccttggcagcgtcagcaacggtggaagaatcagatgcatgcaggtgtggccgattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacaacggccgcgctatatacttttgccgacgactctgctccagggtttgttttaaaagcaatatgactgtgtatgtacgtatgcttgtatgtatgtacctatgaacctagggtgaagagctgaaatgtgaattctagaaccggctatatgtaaggacatacacatatatttttttccgtaatgtgtttatatccaatccacaagtgtgtttgataataattgattggattttctacaaa

SEQ ID NO: 2753 - DNA, 710 bp, Avena sativa
ctgcctactgctctcccagcctccaacaccatggctcccaccgtgatggcttcgtcggccacctccgtcgcgcccttccagggcctcaagtccactgctggcctccccgtcagccgccgccgcagcaatgccggcctcggcagcgtcagcaacggcggaaggatcaggtgcatgcaggtgtggccgattgagggcatcaagaagttcgagaccctgtcttacttgccaccgctctcggaggaggccctcctgaagcagatcgacttcttgatccgctccaagtgggtcccctgcctggagttcagcaaggttggcttcatcttccgcgagcacggcagcacccccgggtactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggctgcgaggagtccggaaaggcctaagccgtgagatggggataacagatgctatttgtcacacacttctgattttgaggttttacttctgattttgagtatataagtagccatgtgatgcaagtgtaaggctacttttgtcagtatgtttcaacataagtaaatactagaacaagttt

SEQ ID NO: 2754 - DNA, 1112 bp, Avena sativa
gcattgcagcctgcttacttctctcctccaataccatggctcccaccgtgatggcttcgtcggccacctccgtcgcgcccttccagggcctcaagtccaccgctggcctccccgtcaaccgccgcagcaatgccggcctcggcagcgtcagcaacggcggaaggatcaggtgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcacaggtcatcaaggaggtggaggaggtcaagaaggagtaccctgacgcctatgtccgcatcatcggcttcgacaacatccgtcaagtgcagtgcgtcagcttcatcgcattcaagccaccgggctgcgaggagtccggcaaggcataagctgcgatccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgcgatgcaagtgtaaggctattttcagtatgtttcaacataaatagaacaattttgagttttagaaatggagggttgctttgttaagatgcatttttctctgaaacatgcctgccaaatttggtgacaccatacaaaaatatctgggaacagatctgatgcctagtgctattctaaacttgcattggctatgacgtaactaggaaatgtgcgttttgttctctggaactctggacttcacacttgcttcatgttgatatactttgtcaacataggaatgacatgtaccaactttgtaa

SEQ ID NO: 2755 - DNA, 796 bp, Avena sativa
ctcctctcctccaataccatggctcccaccgtgacagcttcctcggccacctctgtcgcccccttccagggcctcaagtccaccgctggccttcccgtcagccgtcgcagcaatgccggccttggcagcgtcagcaacggtggaagaatcagatgcatgcaggtgtggccgattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcctggatactatgacggcaggtactggacaatgtggaagctgcccatgttcggctgcaccgacgcctcccaggtcatcaaggaagtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcataagccgcgacctgggaataaccgactacgcaaggcatgttagttcactttctgttgacgactctcctttcggggttttacttcaggttccatacaattgtgtatgtatgtactatgtttgggcgtacctatatctacgtaggtcgaggaacatgcatatgttgattgtataactgcctacacatacacatgtatatttatatacaaacagcagactgttgtcttattgttaattggtggaaagtttctttatttt

SEQ ID NO: 2756 - DNA, 820 bp, Avena sativa
tatataacgcggcgacccagacatggaggggcctcaagcatagcctagctagctatctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtgaagaaggagtaccctgacgcctatgtccgcatcatcggtttcgacaacatccgtcaggtgcagtgcgtcagcttcatcgccttcaagccaccaggctgcgaggagtccggaaaggcctaagttgtcagctgaaacaacggccatatatactttgccgacgaactctgctccgtagggttttgttttgcaatcaatatgattgtgtatgtgcgtatatatgcttgtatttgtatgtatgtacctatcaacctagcgtgaagagctcaaatgtgaattctagaaccggctacacataaggacatacacatatatatattattttcgattgtgt

SEQ ID NO: 2757 - DNA, 831 bp, Avena sativa
tcgcctccttctctcctccaataccatggctcccaccgtgacggcttcctcggcgacctccgtcgcccccttccagggcctcaagtccactgctggccttcccgtcagccggcgcagcaatgccggccttggcaacgttagcaacggtggaaggatcagatgcatgcaggtgtggccgattgagggcatcaagaagttcgagaccctttcttacttgccaccactctcagaggaggccctcctgaagcagatcgatttcttgatccgctccaagtgggttccctgcctggagttcagcaaggttggcttcatcttccgtgagcacggcagcactcccggatactacgacggcaggtactggacaatgtggaagctgcccatgttcggttgcaccgacgcctcacaggtcatcaaggaggtggaggaggtcaagaaggagtaccctgacgcctatgtccgcatcatcggtttcgacaacatccgtcaagtgcagtgcgtcagcttcatcgcattcaagccaccgggctgcgaggagtccggcaaggcataagccacgagatgggaatatataacagatgctatataaagtgtattgttcaaattttatacaagggattttatatgtttgctggtgattttgtttggaatctggatatatacacgtaggcatgttatgcacgtgtaagtctattttttctagtgtgtttcgatattataaatagaacaagtttgactttaaaaaaaggaaaggttggaacgctaagatgaattttctctgaaacatgcatgaaatttcggtgacacataataaaatatcttggaacagatctg

SEQ ID NO: 2758 - DNA, 812 bp, Avena sativa
gcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcacccctggatactatgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagtttcatcgccttcaagccaccgggttgcgaggagtctggcaaggcataagttgtcagctgaaacaacggccgctatatgaaacaacggccacactatatacttttgccgatgactctgctcgagggtttggttttgcaatcaatatgattgtgtatgtacgagtatgcttgtatgtatgtacctatcaacctagggtgaagagctcaaatgtgaattctagaaccggctacacataaggacatacacatatatattatttttgatgtgtttatatcccatccgcaagtgtgtttcatactttgatattaattgattggaatt

SEQ ID NO: 2759 - DNA, 898 bp, Avena sativa
gctatctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcataagccgcgacctgggaataaccgactacgcaaggcatgttagttcactttctgttgacgactctcctttcggggttttacttcaggttccatacaattgtgtatgtatatatgtactatgtttgggcgtacctatctacgtaggtcgaggaacatgcatatgttgattgtataactgcctacacatacacatgtatatttatatacaaacagcagactgttgtcttattgttaattggtggaaagtttctttattttctgctagaatgcctatgttttgctgttagttgaagtgtcttcgttcacatttgtagaaaattcttgtttcaacgctgtttttcgg

SEQ ID NO: 2760 - DNA, 693 bp, Avena sativa
ccagcaatggggccgcaagtgcagcctgcttacttctctcctccaataccatggctcccaccgtgatggcttcgtcggccacctccgtcgcgcccttccagggcctcaagtccaccgctggcctccccgtcaaccgccgcagcaatgccggcctcggcagcgtcagcaacggcggaaggatcaggtgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgtattttgtaggttttacttctggttccatataataggcgatgaacaatcgcaggc

SEQ ID NO: 2761 - DNA, 667 bp, Avena sativa
tcttgcctcctctcctccaataccatggctcccaccgtgacggcttcctcggccacctctgtcgccccattccagggcctcaagtccactgctggccttcccgtcagccgtcgcagcaatgccggccttggcagcgtcagcaacggtggaagaatcagatgcatgcaggtgtggcctattgagggcatcaagaagttcgagaccctgtcttacctgccaccactctcggaggaggccctcctgaagcagattgacttcttgatccgctccaagtgggttccctgcctggagttcagcaaggttggcttcatcttccgcgagcacggcagcactcccggatactacgatggcaggtactggacaatgtggaagctgcccatgttcggctgcaccgacgcctcccaggtcatcaaggaggtggaggaggtcaagaaggagtaccctgacgcttatgtccgcatcatcggcttcgacaacatccgtcaagtgcagtgcgtcagcttcatcgccttcaagccaccgggttgcgaggagtctggcaaggcataagccacgagctgggaataactgccttttctgagaatctgctgggaataactgcctatgcaaggcatgttagttctactttttgttgatgactctcctttcggggttttacttcaggttc

SEQ ID NO: 2762 - DNA, 609 bp, Avena sativa
cgcctccttctctcctccaataccatggctcccaccgtgacggcttcctcggcgacctccgtcgcccccttccagggcctcaagtccactgctggccttcccgtcagccggcgcagcaatgccggccttggcaacgttagcaacggtggaaggatcagatgcatgcaggtgtggccgattgagggcatcaagaagttcgagaccctttcttacttgccaccactctcagaggaggccctcctgaagcagatcgatttcttgatccgctccaagtgggttccctgcctggagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggaaaggcctaagttgtcagctgaaacaacggccactatatactttgtcgacgaactctgctccagggtttg

SEQ ID NO: 2763 - DNA, 831 bp, Avena sativa
gtgatggcttcgtccgccaccaccgtcgcacccttccagggcctcaagtccaccgctggcctccccgtcagccgtcgcagctccggaagcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcatggcagcactcctggatactatgacggcaggtactggacaatgtggaagctgcccatgttcggctgcactgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttcaaatttgtcgacaattctgattttgaggttttacttctggttccatataatagggcgatgaacaatcacaggcttgggtaaagtctgttccttcttagattgtcttcgttgattaacccaggcaatgcaaatgaggtttctgatttatgtgagggattctatctgtttcttttttatgttgtttggaatctggatatatatacgtagccatgtgatgcaagtgtaagactactttttttcccagtatgtttctacataaataaaacaagtttga

SEQ ID NO: 2764 - DNA, 788 bp, Festuca arundinacea
gcaaagccttcctctcgtgttagctatctacaacgatggctcccactgtgatgtcgtcggcggccaccgccgtagctcctttccagggactgaagtccactgcaggactccccgtgagccgccgttccagcagctctggccttggcagcgtcagcaacggcggcaggatccggtgcatgcaggtgtggccgatcgaggggatcaagaagttcgagaccctgtcttacttgccaccgctctccacggaggccctcctgaagcagatcgacttcttgatccgctccaagtgggttccctgcctggagttcagcaaggtcggcttcgtcttccgtgagcacggcagcactcccggatactacgacggcaggtactggacaatgtggaagctgcccatgttcggatgcactgacgccgcacaggtcgtcaaggagctggaggaggttaagaaggagtaccctgacgcctatgtccgcatcatcggtttcgacaacatccgccaggtgcagtgcgtcagcttcatcgccttcaagccaccaggttgcgaggagtccggcaaggcctaaacaagttgatctcctccttcctattatacaacttggttccgggtcatgttgatttcatttcccttttcacttttcttgtgcttatgttggacgtggtttctccctgcaactcgaattaactgtatgggtactacaattataagagtactacaactaccgttgggtgaggaatatttgtatgtaaactccggctatgcatataaagacaaatataaattataagtt

SEQ ID NO: 2765 - DNA, 739 bp, Lolium multiflorum
cggcacgagggcccagctagttatctcattctctccttagcaataatacttagcaccatggcccccgcggtgatggcttcgtcagccacctccgtcgcgcccttccagggcctcaagtccaccgctggcctcccggtcagccgccgcagcaacgctcgcctcggcagcgtcagcaacggcggacggattaggtgcatgcaggtgtggccgattgagggcatcaagaagttcgagaccctttcctacctgccaccgctgtccacggaggacctcctgaagcagatcgacttcctcatccgctccaagtgggttccctgcctggagttcagcaaggtcggcttcgtcttccgcgagttcggcagcactcccggatactacgacggcaggtactggacaatgtggaagctgcccatgttcggctgcaccgacgccgcacaggtcgccaaggaggtggaggaggtcaagaaggagtaccctgacgcctatatccgcatcatcggcttcgacaacatccgtcaagtgcagtgcgtcagcttcatcgcctacaagccaccaggctgcgaggagtccggcaaggcataaactgcaagctgcgaataacagcagcctatacaagttcacttttttttgttgacgactctggtttcagggttttacttctgcttccatatacactgtgtaccaaatatttacgtacctatcaacgtgggtcgacaagcttaattttccaaaaaaaaaa

SEQ ID NO: 2766 - DNA, 668 bp, Lolium multiflorum
cggcacgagggcccagctagttatctcattctctccttagcaataatacttagcaccatggcccccgcggtgatggcttcgtcagccacctccgtcgcgcccttccagggcctcaagtccaccgctggcctcccggtcagccgccgcagcaacgctcgcctcggcagcgtcagcaacggcggacggattaggtgcatgcaggtgtggccgattgagggcatcaagaagttcgagaccctttcctacctgccaccgctgtccacggaggacctcctgaagcagatcgacttcctcatccgctccaagtgggttccctgcctggagttcagcaaggtcggcttcgtcttccgcgagttcggcagcactcccggatactacgacggcaggtactggacaatgtggaagctgcccatgttcggctgcaccgacgccgcacaggtcgccaaggaggtggaggaggtcaagaaggagtaccctgacgcctatatccgcatcatcggcttcgacaacatccgtcaagtgcagtgcgtcagcttcatcgcctacaagccaccaggctgcgaggagtccggcaaggcataaactgcaagctgcgaataacagcagcctatacaagttcacttttttttgttgacgactctggtttcagggttttacttctgcttcca

SEQ ID NO: 2767 - DNA, 895 bp, Avena sativa
aatttctcttctccaataccatggctcccaccgtgacggcttcctcggccacctctgtcgcccctttccagggcctcaagtccactgctggccttcccgtccagccgtcgcagcaatgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggtttcgacaacatccgtcaagtgcagtgcgtcagcttcatcgccttcaagccaccgggctgcgaggagtccggcaaggcctaagccgcgagctgggaataacagatgctctatgaagtgtcttgttaaaattttgtcgacaattctgattttgaggttttacttctggttccatataatagggcgatgaacaatcgcaggcttgggtaaagtctgttccttcttagattgtcttcgttgattaacccaggcaatgcaaatgaggtttctgatttatgtgagggattctatcttgttttctttttgatgttgtttggaatctggatatatatacgtagccatgtgatgcaagtgtaagactactttttttcccagtatgtttctacataaataaaacaagtttgagttttagaaatggagggttgctttgcta

SEQ ID NO: 2768 - DNA, 854 bp, Avena sativa
ctagctagctatctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtcagcaacggtggaagaatccgatgcatgcaggtgtggccaattgagggcatcaagaagttcgagaccctgtccttacctgcccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggtttgttttacaagcaatatgattgtgtatgtacgtatgcttgtatgtatgtacctatcaacctagggtgaagagctcaaatgtgaattcttgaaccggctatacgtaaggacatacacattattttttttccgaatgtgtttatatccaatccacaagtgtgtttgataataattgattggaatttctattaattcttcctgtctttcgt

SEQ ID NO: 2769 - DNA, 757 bp, Avena sativa
ccagcctccaacaccatggctcccaccgtgatggctccgtcggccacctccgtcgcgcccttccagggcctcaagtccactgctggcctccccgtccagccgccgccgcagcaatgccggcctcggcagcgtcagcaacggcggaaggatcaggtgcatgcaggtgtggccgattgagggcatcaagaagttcgagaccctgtcttacttgccaccgctctcggaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccaggctgcgaggagtccggcaaggcctaagttgtcagctgaaaaccgacggtcactatatacttttgccgacgaactctgctccagggtttgttttgcaatcaatatgattgtgtatgtgcctatatatgcttgtatttgtatgtatgtacctatcaacctagcgtgaagagctcaaatgtgaattctagaaccggctacacataaggacatacacatatatatattattttcgattgtggc

SEQ ID NO: 2770 - DNA, 536 bp, Gossypium hirsutum
gcacgaggcatcatcctctctacagttaatacagtaccatggcccccgccgtgatggcttcatcggctaccaccgtcgcacccttccaggggctcaagtccacagccggtctccccgtcagccgccgctccagcgccagcctgggcagcgtcagcaatggcggaaggatcaggtgcatgcaggtgtggccgattgagggtatcaagaagttcgagaccctgtcttacttgccacccctcaccacggaggccctcctgaagcatgttgactacctgatccgctccaagtgggtgccctgcctcgacttcagcaaggttggcttcgccttccgtgagcacaacagctcccccgggtactacgacggccgatactggacaatgtggaagctgcctatgtttgggtgcaccgacgctacacaggtgcttaacgaggtggaggaggtcaagaatgaataccctgacgctcacgtagctatcatcggctttgacaacctgcggcaggtgcagtgcatcaacttcatcaccattaggccaccg

SEQ ID NO: 2771 - DNA, 808 bp, Avena sativa
atctcatcaactccttagcagtatacttgccaccatggcccccgcccgtgatggcttcgtcggccaccaccgtcgcgcccttccagggtctcaagtccaccgctggcctccccgtcagccgtcgcagctccggaagcctcggcagcgtgagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcccggatactacgatggcaggtactggacaatgtggaagctgcccatgttcggctgcaccgacgcctcccaggtcatcaaggaggtggaggaggtcaagaaggagtaccctgacgcttatgtccgcatcatcggcttcgacaacatccgtcaagtgcagtgcgtcagcttcatcgccttcaagccaccaggctgcgaggagtccggcaaggcataagccgcgacctgggaataaccgactacgcaaggcatgttaggtcactttctgttgacgactctcctttcggggttttacttcaggttccctacaattgtgtatgtatgtacctatgtttgggcgtacctatacgtaggtcgaggaacatgcatatgttgattgtataaatggctacacattatatttatatacaaacaacagactattgtcccattgttaattgatgggaagtttctttattttctgct

SEQ ID NO: 2772 - DNA, 867 bp, Avena sativa
cttgtaagaaaggaaaggcgctgagcctaaggcgagccatatataacgcggcgacccagacatggaggggcctcaagcatagcctagctagctatctcatctctaattagcagtatacttagcaccatggcccccgtcgtggcttcgtcggccacctcggtcgcgcccttccaggggttcaagtccactgctggccttcccgtcagccgccgcagcaacgccggccttggcagcgtcagcaacggtggaagaatccgatgcatgcaggtgtggcctattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaagtgcagtgcgtcagcttcatcgccttcaagccaccgggctgcgaggaatccggcaaggcataagttgccagctgaaacagtggccgctatatgaaacaacggccgcgctatatacttttgccgacgactctgctccagggtttgttttacaagcaatatgattgtgtatgtacgtatgcttgtatgtatgtacctatcaacctagggtgaagagctcaaatgtgaattctagaaccggctatacgtaaggacatacgcatattttttttccgaatgtgttta

SEQ ID NO: 2773 - DNA, 708 bp, Avena sativa
tcgcgcctcctcctctcctccaataccatggctcccaccatgacggcttcctcggcgacctccgtcgcccccttccagggcctcaagtccactgctggccttcccgtcagccgccgtagcaacgccggcctcggcaacgtcagcaacggtggaaggatcagatgcatgcaggtgtggccgattgagggtatcaagaagttcgagaccctttcttacttgccaccactctcagaggaggccctcctgaagcagatcgacttcttgatccgctccaagtgggttccctgcctcgagttcagcaaggttggcttcatcttccgtgagcacggcagcacacccggatactacgatggcaggtactggacaatgtggaagctgcccatgttcggctgcaccgacgcctcccaggtcatcaaggaggtggaggaggtgaagaaggagtaccctgacgcctatgtccgcatcatcggtttcgacaacatccgtcaggtgcagtgcgtcagcttcatcgccttcaagccaccaggctgcgaggagtccggaaaggcctaagccacgagctgggaatatataacagatgctatatgaagtgtattgttcaaattttatacgagggattttatatgtttgctggtgattttgtttggaatctggatatttacacgtaggcatgttatgcacgtgtaagtctattttttctagtgtgtt

SEQ ID NO: 2774 - DNA, 702 bp, Avena sativa
cgcgcctcctcctctcctccaataccatggctcccaccatgacggcttcctcggcgacctccgtcgcccccttccagggcctcaagtccactgctggccttcccgtcagccgccgtagcaacgccggcctcggcaacgtcagcaacggtggaaggatcagatgcatgcaggtgtggccgattgagggtatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcacaggtcatcaaggaggtggaggaggtcaagaaggagtaccctgacgcctatgtccgcatcatcggcttcgacaacatccgtcaagtgcagtgcgtcagcttcatcgcattcaagccaccgggctgcgaggagtccggcaaggcataagctgcgatccgggaataacagatgctatatgaactgtcttgttcaaatttgtcaaaaattctgattttgtaggttttacttctggttccataatataggtcgatgaacaatcgcaggcttggttaagtctgttccttcttagattgtcttc

SEQ ID NO: 2775 - DNA, 833 bp, Avena sativa
agacaacctatctgagttaacaggcacatcggcagcaaactaacgtgataccatggcccccgccgtgatggcttcgtcggccaactcggtcgccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcacccccggatactacgacggcaggtactgggcaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgccttcaagccaccaggctgcgaggagtccggcaaggcctaagttgtcagctgaaacaacggccactatatacttttgccgacgaactctgctccagggtttgttttgcaatcaatatgattgtgtatgtgcgtatatatgcttgtatttgtatgtatgtacctatcaacctagcgtgaagagctcaaatgtgaattctagaaccggctacacataaggacatacacatatatatattatttcgattgtgtttatatcgaatccgcaagtgtgtttgatattaattgattggaatctct

SEQ ID NO: 2776 - DNA, 703 bp, Avena sativa
gaagtgtacctcgcctccttctctcctccaataccatggctcccaccgtgacggcttcctcggcgacctccgtcgcccccttccagggcctcaagtccactgctggccttcccgtcggccgccgcagcaacgccggcctcggcaacgtcagcaacggtggaaggatcagatgcatgcaggtgtggccgattgagggcatcaagaagttcgagaccctgtcttatctgccaccactgtcagaggaggccctcttgaagcagatcgacttcctgatccgctccaagtgggttccctgcctggagttcagcaaggttggcttcatcttccgcgagcacggcagcacccccggatactacgacggcaggtactggacaatgtggaagctgcccatgttcggctgcaccgacgcctcccaggtcatcaaggaggtggaggaggtgaagaaggagtaccctgacgcctatgtccgcatcatcggtttcgacaacatccgtcaggtgcagtgcgtcagcttcatcgccttcaagccaccaggctgcgaggaggtccggaaaggcctaagccacgagctgggaatatataacagatgctatatgaagtgtattgttcaaattttatacgagggattttatatgtttgctggtgattttgtttggtaatctggatatttacacgtaggcatgttatgcacgtgtaagtctat

SEQ ID NO: 2777 - DNA, 687 bp, Avena sativa
tagacaacctatctgagttaacaggcacatcggcagcaaactacgtgataccatggccccgccgtgatggcttcgtcggccacctcggtcgccccttccaggggctcaagtccactgctggcttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctggagttcagcaaggttggcttcatcttccgcgagcacggcagcacccccggatactacgacggcaggtactggacaatgtggaagctacccatgttcggctgcaccgacgcctcccaggtgatcaaggaggtggaggaggtcaagaaggagtaccctgacgcctatgtccgcatcatcggcttcgacaacatccgccaagtgcagtgcgtcagcttcatcgccttcaagccaccgggttgcgaggagtccggcaaggcctaagccgcgagctgggaataacagatgctctatgaagtgtcttgttacaaatttgtcgacaattctgtattttgaggttttacttctggttccatataatagggcgatgaacaatc

SEQ ID NO: 2778 - DNA, 765 bp, Triticum aestivum
cccttccaggggctcaagtcgaccgccggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgctacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatgaaggtcttttgtgaacttcacttttgtccacgactctgctggacgaccagagcatatttttcattctatatggtctgtgtatgtatgtacgaacatagattctcgagcatgcatatgtaaattctagagccggctacacatatacaaaacctgtgtgatatttattatataaaacatgcggaccattgtcttgatgttattaattcatggaaaagtttctttatttggcactgcaatgaatatgtcaca

SEQ ID NO: 2779 - DNA, 855 bp, Brachypodium distachyon
aagcaagcctgcctcctcttgttagctatctacgtacgtgtacgatggctcccacagtgatgtcgtcagcggctactgccgttgctcctttccagggcctcaagtccaccgccgggctccccatcggccgccgctcagccagcgctggtctcggcagcgtctccaacggtggaaggatcaggtgcatgcaggtgtggccaattgagggcatcaagaagttcgaaaccctttcctacctgccgcctctcaccgtggagtccctcttgaagcagatcgagtatctcatccgctccaagtgggttccttgcctcgagttcagcaaggtcggtttcgtcttccgtgagcacggcaactctcccgggtactacgacggcaggtactggacaatgtggaagcttcccatgttcgggtgcaccgacgccacgcaggtgctaaaggagctggaggaggtgaagaaggagtaccctgacgcctatgtccgcatcatcggcttcgacaacaccaggcaagtgcagtgcatcagcttcatcgccttcaagccaccgggttgtgaggagtccggcaaggcctaagcaagttgatttcttataatacaagaacgggtcacaccgattttatgtacctttttcacacgtttgtttcatgttgtatttatgcatgtgatctctcccaacaacccggattaactgtattcatgagtactactattataagagtactacaactatcgttgggagaggggcatgtaatataaactccggttatacatattaagataagtatattttgtaaaagaatatcaaattcgtcgacaaattctgattatgataatttaccggtacgtgtttgtgtgtt

SEQ ID NO: 2780 - DNA, 915 bp, Avena sativa
ctcatctctaattagcagtatacttagcaccatggcccccgtcgtggcttcgtcggccacctcggtcgcgcccttccaggggctcaagtccactgctggccttcccgtcagccgccgcagcaacgccggccttggcagcgtgagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatgaaacaacggccgcgctatatacttttgccgacgactctgctccagggtttgttttaaaagcaatatgactgtgtatgtacgtatgcttgtatgtatgtacctatcaacctagggtgaagagctgaaatgtgaattctagaaccggctatatgtaaggacatacacatatatttttttccgaatgtgtttatatccaatccacaagtgtgtttgataataattgattggaatttctattaagttttcatgtctgtcgataaaaagttcatgtactttcgacggctaagatgcctttattatgaaaacaaatttcaagcgtctttact

SEQ ID NO: 2781 - DNA, 796 bp, Avena sativa
tcctccaataccatggctcccacccgtgatggcttcgtcggccacctccgtcgcgcccttccagggcctcaagtccactgctggcctccccgtcagccgccgccgcagcaatgccggcctcggcagcgtcagcaacggcggaaggatcaggtgcatgcaggtgtggccgattggagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcacccccggatactacgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaagtgcagtgcgtcagtttcatcgccttcaagccaccgggttgcgaggagtctggcaaggcataagttgtcagctgaaacaacggccgctatatgaaacaacggccacactatatacttttgccgatgactctgctcgagggtttgttttgcaatcaatatgattgtgtatgtacgagtatgcttgtatgtatgtacctatcaacctagggtgaagagctcaaatgtgaattctagaaccggctacacataaggacatacacatatatattattttgtatgtgtttattatcccactccgcaagtgtgtttctatactt

SEQ ID NO: 2782 - DNA, 831 bp, Avena sativa
gctagctatctcatctctaattagcagtatacttagcaccatggccccgtcgtggcttcgtcggccacctcggtcgcgcccttccaggggctcaagtccactgctggccttcccgtcagccgccgcagcaacgccggccttggcagcgtcagcaacggtggaagaatcagatgcatgcaggtgtggccaattgagggcatcaagaagttcgagaccctgtcttacctgccaccactctcagaggaggccctcctgaagcagatcgacttcttgatccgctccaagtgggttccttgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctggtcaagtggccgctataatgaaacagtggccgcgctatattacttttgccgacgactctgcctccgtagggttttgttttacaagcaatatgattgtgtatgtacgtatgcttgtatgtatgtacctatcaacctagggtgaagagctcaaatgtgaattctagaaccggctatacgtaaggacatacgcattatttttttccgaatgtgtttatatccaatccacaagtgtgtttgataataattgattggaatttct

SEQ ID NO: 2783 - DNA, 642 bp, Avena sativa
cttgcctcctctcctccaataccatggctcccaccgtgacggcttcctcggccacctctgtcgcccctttccagggcctcaagtccactgctggccttcccgtcagccgtcgcagcaatgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccttgcctggagaccagcaaggttggcttcatcttccgcgagcacggcagcactcccgatactacgatggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgtaggttttacttctggttccatataa

SEQ ID NO: 2784 - DNA, 704 bp, Avena sativa
gtgatggcttcttccgccacctccgtcgcgcccttccagggcctcaagtccaccgctggcctccccgtcagccgccgcagcaacgccggcctcggcagcgtcagcaacggtggaagaatcagatgcatgcaggtgtggccaattgagggcatcaagaagttcgagaccctatcttacttgccaccactctcagaggaggccctcctaaagcagatcgacttcttgatccgctccaagtgggttccatgcctggagttcagcaaggttggcttcatcttccgtgagcacggcagcactcccggatactacgacggcaggtactggacaatgtggaagctgcccatgttcggctgcaccgacgcctcgcaggtgatcaaggaggtggaggaggtcaagaaggagtaccctgacgcctatgtccgcatcatcggcttcgacaacatccgtcaagtgcagtgcgtcagcttcatcgccttcaagccaccgggctgcgaggaatccggcaaggcctaagttgtcagctgaaacaacggtcactatatacttttgccgacgaactctgctccagggtttgttttgcaatcaatatgattatgtgcgtatatatgcttgtatttgtatgtatgtacctatcaacctagcgtgaagagctcaaatgtgaattctagaaccggctacacataaggacatacacatatatatat

SEQ ID NO: 2785 - DNA, 890 bp, Avena sativa
ccagtattgcggcattgggaggcctcaagtgtagacaacctatctgagttaacaggcacatcggcagcaaactacgtgataccatggcccccgcccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggctgcaccgacgcctcacaggtcatcaaggaggtggaggaggtgaagaaggagtaccctgacgcctatgtccgcatcattggcttcgacaacatccgtcaagtgcagtgcgtcagcttcatcgccttcaagccaccgggttgcgaggagtctggcaaggcataagttgtcagctgaaacaacggcctctatatatgaaacaacggccacactatatacttttgccgatgactctgctcgagggtttgttttgcaatcaatatgattgtgtatgtacgagtatgcttgtatgtatgtacctatcaacctagggtgaagagctcaaatgtgaattctagaaccggctacacataaggacatacacatatatattatttttgatgtgtttatatcccatccgcaagtgtgtttcatactttgatattaattgattggaatttctattg

SEQ ID NO: 2786 - DNA, 835 bp, Avena sativa
cgcgcctcctcctctcctccaataccatggctcccaccatgacggcttcctcggcgacctccgtcgcccccttccagggcctcaagtccactgctggccttcccgtcagctgccgtagcaacgccggcctcggcaacgtcagcaacggtggaaggatcagatgcatgcaggtgtggccgattgagggtatcaagaagttcgagaccctttcttacttgccaccactctcagaggaggccctcctgaagcagatcgacttcttgatccgctccaagtgggttccctgcctcgagttcagcaaggttggcttcatcttccgtgagcacggcagcactcctggatactacgacggcaggtactggacaatgtggaagctccccatgttcggatgcaccgacgcctcccaggtcatcaaggaggtggaggaggtcaagaaggagtaccctgacgcgtatgtccgcatcatcggcttcgacaacatccgtcaagtgcagtgcgtcagcttcatcgccttcaagccaccgggttgcgaggagtctggcaaggcctaagccacgagctgggaataaatgccttttctgagaatctgggaataactgcctatgcaaggcatgttagttctactttttgttgatgactctcctttcggggttttacttcaggttccatacaattctgtatgtatgtactatgtttgggcgtacctatctacgtaggtcgaggaacatgcatatgttgattgtataaccggctacacatacacatatatatttatatacaaaccacatactattgtcttcttgctagttgatggaaattttctttatttgctacc

SEQ ID NO: 2787 - DNA, 604 bp, Avena sativa
cccaccgtgacagcttcctcggccacctctgtcgcccccttccagggcctcaagtccaccgctggccttcccgtcagtcgtcgcagcaatgccggccttggcagcgtcagcaacggtggaagaatcagatgcatgcaggtgtggccgattgagggcatcaagaagttcgagaccctgtcttacctgccgccactctcagaggaggccctcctgaagcagatcgacttcttgatccgctccaagtgggttccttgcctcgagttcagcaaggttggcttcatcttccgcgagcacggcagcactcccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgacccgggaataacagatgctatatgaactgtcttgttcaaatttgtacaaaaattctgtattttgtaggttttacttct

SEQ ID NO: 2788 - DNA, 554 bp, Hordeum vulgare
ctagcaagctatatacctacatagtacagccatggcccccaccgtgatggcctcatcggccacctccgtcgctcctttccaggggctcaagtccaccgccggccttcccgtcagccgccgctccaacggcgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgtcagcttcatcgcttcaagccaccaggctgcgaggagtccggcaaggc

SEQ ID NO: 2789 - DNA, 755 bp, Triticum aestivum
ctatatacctacatagtacagccatggcccccaccgtgatgggctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatgggcggtactggacaatgtggaagctgcctatgttcggatgcaccgacgccacgcaagtgatcaacgaggtggaggaggtcaagaaggagtaccctgacgcctatgtctgcatcatcggattcgaccacacgcgtcaggtgcagtgcgtcaggtttattgcgttaaagaaaccccccccccccccgtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaaccatgctcgtatctcaatgctatccgtggtctatgtatatgcccggacgcata

SEQ ID NO: 2790 - DNA, 1032 bp, Triticum aestivum
cccttaaaaaaccccgggccgacccaccctccggactttacctaggccccgggccggttaccatttccccccggaaccggtatgccctttggcccatttaggtgcccttttggaccagtttgtcccaaaaaccgggctggtcccgtccgggattccccggatattctcgacccacggttcccggactggagcacgagacccctgacctgatctgaaggagtagaaaaagctagctctcgcctccccacttcgcaattcacgtactccgccatgcccccagccgtgatggcatcgtccgccacaaccgtcgcgcccttccaggggctcaagtcgaccgcgggcttccccgtcagccgccgttccggcagcgccggcctcagaagcgtcagcaatggcggaaggatcagatccatgcaggtgtgcccgattgagggcatcaagaagttcgagaccctgtcttacttcccacccctctccacggaggccctcctaaaccaggtcgactacctgatccgctccaagtgggtgccctccctcgagttcaccaaggttggttttgtcttccgtgagcacaacagctcccccggttattacgccggtcgatactggacaatgtggaagctgcctatgttcgggtgcaccgacgcaacgcaggtgctcaacgaggtggaggaggtcaagaaggagtaccctgacgcctatgtccgtgtcatcggcttcgacaacatgcgccaggtccagtgcgtcagctccattcccttcaggccaccaggctgggaggaatctgccaagccctaaagtgcaagttgaagtaacacatatacatcccatgttagttcacatttgtcggcagctcggctttctcggttttacttctcgttctactcaatatgtgaatatatgagcatatgtatgtaaccccctcccaccttaggtcgaggccgatgcatatgagaattccaccacgggcaatacatccacagatatattatacgccatcgacaaaaaaaaccagggcggccgctctggggt

SEQ ID NO: 2791 - DNA, 766 bp, Avena sativa
cgtgatggcttcttcggccacctccgttgcgcccttccagggcctcaagtccaccgctggcctccccgtcaaccgccgcagcaatgccggcctcggcagcgtcagcaacggcggaaggatcaggtgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacaacggccgcgctatatacttttgccgacgactctgctccagggtttgttttaaaagcaatatgactgtgtatgtacgtatgcttgtatgtatgtacctatgaacctaggtgaagagctgaaatagtgaattactagaaccggctatatgtaaggacatacacatatattttttccgtaatgtgtttatatccaatccacaagtgtgtttgtataataa

SEQ ID NO: 2792 - DNA, 814 bp, Avena sativa
  misc_feature (143)..(143): n is a, c, g, or t
  misc_feature (189)..(189): n is a, c, g, or t
  misc_feature (192)..(192): n is a, c, g, or t
  misc_feature (254)..(254): n is a, c, g, or t
  misc_feature (260)..(260): n is a, c, g, or t
  misc_feature (422)..(422): n is a, c, g, or t
  misc_feature (606)..(606): n is a, c, g, or t
  misc_feature (611)..(611): n is a, c, g, or t
  misc_feature (616)..(616): n is a, c, g, or t
  misc_feature (630)..(630): n is a, c, g, or t
ccgtgatggcttcgtcggccacctccgtcgcgcccttccagggcctcaagtccaccgctggcctccccatcagccgccgcagcaatgccggcctcggcagcgtcagcaacggcggaaggatcaggtgcatgcaggtgtggccnattgagggcatcaagaagttcgagaccctgtcttacctgccaccantgncagaggaggccctcctgaagcagatcgacttcttgatccgctccaagtgggttccctgcctngagttnagcaaggttggcttcatcttccgcgagcacggcagcactcccggatactacgacggcaggtactggacaatgtggaagctgcccatgttcggctgcaccgacgcctcacaggtgatcaaggaggtggaggaggtcaagaaggagtaccctgacgcctatgtncgcatcatcggcttcgacaacatccgtcaagtgcagtgcgtcagcttcatcgccttcaagccaccgggctgcgaggagtccggcaaggcataagctgcgacccgggaataacagatgctatatgaactgtcttgttcaaatttgtcaaaaattctgattttgaggttttacttctggttccatnatatnggtcnatgaacaatcgcangcttggttaagtctgttccttcttagattgtcttcattgattaaacccggcaacgcaaatgaggtttcagatttttgcgagggattctatctgtttgttgttgatgttgtttggaatctggatatatatacatagctatgtgatgcaagtgtaagccttttttcagtaattttctacataaata

SEQ ID NO: 2793 - DNA, 1011 bp, Triticum aestivum
cgcatagaaactctcctgatacccggcatcctcctctcctccgataatacaataccatggcccccgccgtgatggcttcgacggctaccaccgtcgcacccttccaggggctcaagtccacagtcagtctggccgtcagccgccgctccagcggcagcctcggccgcgtcagtaatggcggaaggatcaggtgcgtgcaggtgtggccgatagagggtatcaagaacttcgagaccctgtcttacttgccacccctctccacagaggccctcctagagcaggtagactacctgatccgatccaggtgggtgccctgcctcaagttcagtaaggttggtttcgttttccgagagcacaacagctctcccgggtactacaacggtcgatactggacaatgtggaagctgcctatgtccgggtgcaccgacaccactcaggtgctcaacaaagtggaggaggtcaagaaggattaccctgatgcctatgtccgggtcatcggcttcaacaaactgccccaggtgcagtgcgtcagcttcatcgcgttcaggccaacaggttgtgaggagtccggaaaggcctaaactacaagtcgaaacaatggcctatgtatgatggtcatttgtgaacttcacttttgtccacgactctgctttccgaacagagcatgttcgtcggaccaaatgatctggagtggtacaaccattggtgggggaacatgcatatgttaattcacacgaaaatctatactgaaatcaaagaggggtcgggcatccgttcataaccttaaccgttccctggtgccaaaaaaaaaaaaaacgggcggcggctctatagttctccttaaggggccaaagtttcgccctcccacggtttgttgttacaaggggggccccgaatcgaagctctattaaaacacacgggacgggccgccagtttacccccttcgcgagaggggaaacagttcgcacggggcgacttggaaaagcaaccatataaccactcaagggatct

SEQ ID NO: 2794 - DNA, 742 bp, Setaria italica
cggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggttgggttcatcttccgtgagcacaacgcatcccctgggtactacgatggccgctactggacaatgtggaagctgcctatgttcggatgcaccgacgccacgcaggtgatcaacgaggtgcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtacaatctgtcgactatgtatttgggtaattaat

SEQ ID NO: 2795 - DNA, 1049 bp, Triticum aestivum
gacaacccacactgccgggactggagcacgaggacactggacgtgtactgaagccgtataaatttttctacctagctatcgcctccccatctagtcattcacgtactccgtcgtgggtcccgccgtgatggcttcctccgtcaccaccgtcgtgcccttccaggggctcaagtcgaccgcgggcctccccgtcagacgtctgtccggaagcgccagtctcagtagcgtcagcaatggcggaaggataagatgcatgcaggtgtggccaattgagggcatcaagaggttcgatattttgtcttagttgccacccctctctacggaggccctcctaaagcaggtcgactacttgatccgctccaagtgggtaccctgcctcgagtacagcaaggttggcttcgtcttccgtgagcacaagagctcccccgggtactacgactgtcgatactggacaatgtggaagctgtctatgttcggctgcaccgatgccacacatgtgctcaacgaggtcgaggaggtaaagaaggagtaccctgatgcctatgtccgtgtcatcggcttcgacaacatgcgccaggtgcaatgcgtcagcttcatatgccttcaggccaccaggattgcgaggaatccggcaaggtctaaagtgcaagttgaagtaaccgatatacatgtcatgtcagtcacatctgtcggtggctctgcattctcagttttacttctcgtcctactcatatatatgtgaatatatgagcatatgtatgtaagcacctaccattgtaggtcgagtaggatgcatatgagaattatagcaccggctatacgtattcttatatattatatgccaatcaaaaaaaaaaaaaaagggaggcgggtctaaagtatccctggaggggccccagactaccgggtacccgaccttcttggttaaaagggggcccccatgggggatggggattaaaaacaagggcctgggcggtcgtttttaaaccctcgggatctgggaaaaattgcaaacctggggaatcttggttaaggaacccttaactttt

SEQ ID NO: 2796 - DNA, 703 bp, Setaria italica
ctcaagtccacagccagtctgcccgtcagccgccgctccagcggcagcctcggccgcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgacgcctatgtccgtgtcatcggcttcgacaacctgcgccaggtgcagtgcgtcagcttcatcgccttcaggccaccgggttgcgaggagtctggcaaggcctaaactacgagttgaaacaatggcctatgtatgattgtcttttgtgaacttcacttttgtccaggactctgctttccgaccagagcatatttttcgttcggtatgatctgtgtttgtacgaacataggttgtggagcatgcatatgtaaattctagcaccggctacacatatacaacaccagtgtgatatttattatatacaacaagcggaccattgtcctgctgttaattctcg

SEQ ID NO: 2797 - DNA, 697 bp, Avena sativa
caccgtgacggcttcctcggcgacctccgtcgcccccttccagggcctcaagtccactgctggccttcccgtcagccggcgcagcaatgccggccttggcaacgttagcaacggtggaaggatcagatgcatgcaggtgtggccgattgagggcatcaagaagttcgagaccctttcttacttgccaccactctcagaggaggccctcctgaagcagatcgatttcttgatccgctccaagtgggttccctgcctggagcccagcaaggttggcttcatcttccgtgagcacggcagcactcccggatactacgacggcaggtactggacaatgtggaagctgcccatgttcggctgcaccgacgcctcccaggtgatcaaggaggtggaggaggtcaagaaggagtaccctgacgcctatgtccgcatcatcggtttcgacaacatccgtcaggtgcagtgcgtcagcttcatcgccttcaagccaccaggctgcgaggagtccggaaaggcctaagccacgagctgggaatatataacagatgctatatgaagtgtattgttcaaattttatacgagggattttatatgtttgctggtgattttgtttggaatctggatatttacacgtaggcatgttatgcacgtgtaagtctattttttctagtgtgtttcaatattataaatagaacaagtt

SEQ ID NO: 2798 - DNA, 881 bp, Avena sativa
agtattgcggcattgggaggcctcaagtgtagacaacctatctgagttaacaggcacatcggcagcaaactacgtgataccatggcccccgcccgtgatggcttcgtcggccaactcggtcgcccccttcccggggctcaagtccactgctggccttcccgtcagccgccgcagcaacgccggcctcggcagcgtcagcaacggtggaagaatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggctgcaccgacgcctcacaggtgatcaaggaggttgaggaggtcaagaaggagtaccctgacgcctatgttcgcatcatcggcttcgacaacatccgtcaagtgcagtgcgtcagcttcatcgccttcaagccaccgggctgcgaggaatctggcaaggcataagttgccagctgaaacagtggccgctatatgaaacagtggccgcgctatatacttttgccgacgactctgctccagggttttgttttacaagcaatatgattgtgtatgtacgtatgcttgtatgtatgtacctatcaacctagggtgaagagctcaaatgtgaattcttgaaccggctatacgtaaggacatacacattattttttttccgaatgtgtttatatccaatccacaagtgtgtttgataataattgattggaatttctattacgaa

SEQ ID NO: 2799 - DNA, 800 bp, Avena sativa
tgacggcttcctcggcgacctccgtcgcccccttccagggcctcaagtccactgctggccttcccgtcggccgccgcagcaacgccggcctcggcaacgtcagcaacggtggaaggatcagatgcatgcaggtgtggccgattgagggcatcaagaagttcgagaccctgtcttatctgccaccactgtcagaggaggccctcttgaagcagatcgacttcctgatccgctccaagtgggttccctgcctggagttcagcaaggtgggcttcatcttccgtgagcacggcagcactcccggatactacgacggcaggtactggacaatgtggaagctgcccatgttcggctgcaccgacgcctcccaggtcatcaaggaggtggaggaggtgaagaaggagtaccctgacgcctatgtccgcatcatcggtttcgacaacatccgtcaggtgcagtgcgtcagcttcatcgccttcaagccaccaggctgcgaggagtccggaaaggcctaagccacgagctgggaatatataacagatgctatatgaagtgtattgttcaaattttatacgagggattttatatgtttgctggtgattttgtttggaatctggatatatacacgtaggcatgttatgcacgtgtaagtctattttttctagtgtgtttcaatataaatagaagaagtttgagttttagaaaaggaaggctggaacgctaggatgaatgttctctgaaacatgcatgaaacttcggtgacactatacaaaaaatatcttggaatagatctgatgcctagt

SEQ ID NO: 2800 - DNA, 833 bp, Avena sativa
agcaatctcatcaactccttagcagtatacttgccaccatggcccccgccgtgatggcttcgtcggccaccaccgtcgcgcccttccagggcctcaagtccacagctggccttcccgtcagccgtcgcagctccggaagcctcggcagcgtcagcaacggtggaagaatcagatgcatgcaggtgtggccgattgagggcatcaagaagttcgagacccttcttacctgccaccactctcagaggaggccctcctgaagcagatcgacttcttgatccgctccaagtgggttccctgcctggagtcagcaaggttggcttcatcttccgcgagcacggcagcacccccggatactacgacggcaggtactggacaatgtggaagctgcccatgttacggttagacaaccgaacgacctacaacaaggtacaatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgaggttttacttctggttccatataatagggcgatgaacaatcgcaggcttgggtaaagtctgttccttcgtagattgtcttcgttgattaacccaggcaatgcaaatgaggtttctgatttatgcgaaggattctatccgtttgttttttatgttgtttggaatctggatatatatatatatatatatatag

SEQ ID NO: 2801 - DNA, 804 bp, Brachypodium distachyon
actctcaaacaactgaactcctccttttcttggcctaaagcacatatatagctttcgttgttccaagtacgtatggctcccaccgtgatggcttcaaccgccacctccgtggcgcccttccaggggctcaagtccaccgctggcctacctgtcagccgccgcaacagaagcgccgcgggcctcggcagcgtcagcaatggcggaaggatcaggtgtatgcaggtgtggccgatcgagggcatcaagaagttcgagacgctctcgtacctgccgccgctgtccgtggaggccctgctgaagcagatcgagtacctgatccgctccaagtgggtgccctgcttggagtttagcaaggtcggcttcgtctttcgcgagcatgccaggtcccctggatactacgacggcaggtactggaccatgtggaagctgcccatgttcggatgcaccgacgccacacaggtgctcaaggagctggaggaggccaagaaggagtaccctgacgctttcatccggattatcggttttgacaatgtcaggcaggtgcagtgcatcagcttcatcgcatacaagccacccggctgccaggagtccggcaaggcctaagcttcaagttgaaccaaagcaagagcccttaattatatcgatcaactctgctttccagagtttatttcccgttccatatgtccaacgtacgtgcgtagctcgaggagcatgcatatgtgaattcaagaaccgcccgccggctacagatgtacacatacatatactgtcataaatatacaatttaattatggtttgcgcaaa

SEQ ID NO: 2802 - DNA, 487 bp, Hordeum vulgare
catggcccccaccgtgatggcctcatcggccacctccgtcgctcctttccaggggctcaagtccaccgccggccttcccgtcagccgccgctccaacggcgctagcctcggcagcgtcagcaacggtggaaggatcaggtgcatgcaggtgtggcccatcgagggcatcaagaagttcaagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaagagtaccctgacgcgtatgtccggatcatcggattcgacaacatgcgtcaagtgcaaagcgtcagcttcatc

SEQ ID NO: 2803 - DNA, 591 bp, Hordeum vulgare
ctatggcccccaccgtgatggcctcatcggccacctccgtcgctcctttccaggggctcaagtccaccgccggccttcccgtcagccgccgctccaacggggctagcctcggcagcgtcagcaaccgtggaaggggggggggcatgcaggtgtggcccatcgagggcatcaagaagttcgagaccctgtcttacttgccaccactcagcacggaggccctccttaagcagggcgactacctgatccgctccaagtgggtgccttgcctcgagttcagcaaggggggggtcatcttccgtgagcacaacgcatctcctgggtactaccatggccgggactggacaatgtggaagctgcctatgttcggatgcaccgacgcccacaagtgctcaacgaggtggaggagggcaagaaggagtaccctgacgcgtatgtccgcatcatcggattccacaacatgcgtcaggggcagtgcgtcagcttcatcgccttcaagccaccaggctgcgaggagtccggcgaggcataaacagctcactgacgatgggccacatataaagtgccattgcagttttgtcaactctgacattg

SEQ ID NO: 2804 - DNA, 843 bp, Avena sativa
ggccacctccgtcgcacctttccagggcctcaagtccacggcagggctccccgtgagccgccgcagcgcctccagcctgggaagcgtcagcaacggtggaagaatcagatgcatgcaggtgtggccaattgagggcatcaagaagttcgagaccctgtcttacttgccaccactctcagaggaggccctcctgaagcagatcgacttcttgatccgctccaagtgggttccctgcctcgagttcagcaaggttggcttcatcttccgtgagcacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccaggctgcgaggagtccggaaaggcctaagccacgagctgggaataacagatgctatatgagttctcttggttcactttttgtttacaactctcatttcggggttctaccatgtaggtcgacgagcatgcatatgttaattcttgcaccgacttcacatacccctatatatgaatatatatatatatatatatatatatatatatatatatatatatatactgtctttggacacttttcttgctgttaattgtttaaaatcttctgttttcttgcggctgaatagcctatgtctcgctgctccttgatgtaaaatatatcatgtctttttcaaggatatgacaaccttcatttgtcattaagatttcaaaaaa

SEQ ID NO: 2805 - DNA, 862 bp, Avena sativa
gcctgcttactgctctccaataccatggctcccacccgtgatggcttcgtcggccacctccgttgcgcccttccagggcctcaagtccaccgctggcctccccgtcagccgccgcagcaatgccggcctcggcagcgtcagcaacggcggaaggatcaggtgcatgcaggtgtggccgattgagggcatcaagaagttcgagaccctttcttacttgccaccactctcagaggaggccctcctgaagcagatcgacttcttgatccgctccaagtgggttccctgcctggagttcagcaaggttggcttcatcttccgcgagcacggcagcactcccggatactacgacggcaggtactggacaatgtggaagctgcccatgttcggctgcaccgacgcctcacaggtcatcaaggaggtggaggaggtcaagaaggagtaccctgacgcctatgttcgcatcatcggcttcgacaacatccgtcaagtgcagtgcgtcagcttcatcgcattcaagccaccgggctgcgaggagtccggcaaggcataagctgcgacccgggaataacagatgctatatgaactgtcttgttcaaatttgtcaaaaattctgattttgaggttttacttctggttccataatataggtcgatgaacaatcgcaggcttggttaagtctgttccttcttagattgtcttcattgattaaacccggcaacgcaaatgaggtttcagatttttgcgagggattctatctgtttgttgttgatgttgtttggaatctggatatatatacatagctatgcgatgcaagtgtaaggctattttcagtatgtttcaacataaatagaacaattttgag

SEQ ID NO: 2806 - DNA, 511 bp, Secale cereale
  misc_feature (485)..(485): n is a, c, g, or t
  misc_feature (488)..(488): n is a, c, g, or t
tcggcagccaccgccgtcgctcccttccagggctcaagtccaccgctggcctcccagtcagccgccgctccagcagtgcggctggcctcggcagcgtcagcaacggcggaagaatccggtgcatgcaggtgtggcctattgaaggcatcaaaaaattcgagaccttgtcttacctgccaccgctctccacggaagccctcctgaaacaggtcgactacctgattcgctccaaatgggtgccgtgtctcgagtttagcaaggttggcttcatcttccgtgagcacaatgcctctccagggtactacgacggtcgatactggacaatgtggaagctacccatgtttggatgcaccgacgccacccaggtgataaacgaggtggaggaggtcaagaaggagtaccctgacgcctatgtccgcatcatcggattcgacaacatgcgtcaggtgcaatgcgtcagcttcatcgccttcaagccaccaggntgngaggagtccggcaaggcctaaac

SEQ ID NO: 2807 - DNA, 518 bp, Hordeum vulgare
tgtgcctccctctagcaagctatatacctacatagtacagctatggcccccaccgtgatggcctcgtcggccacctccgtcgctcctttccaggggctcaagtccaccgccggcctccccgtcagccgccgctcgaacggtgctagcctcggcagcgtcagcaacggtggaaggatcaggtgcatgcaggtgtggcccatcgagggcatcaagaagttcgagaccctgtcttacttgccaccactcagcacggaggccctccttaagcaggtcgactacctgatccgctccaagtgggtgccttgcctcgagttcagcaaggttgggttcatcttccgtgagcacaacgcatctcctgggtactacgatggccggtactggacaatgtggaagctgcctatgttcggatgcaccgacgccacacaggtgctcaacgaggtggaggaggtcaagaaggagtaccctgacgcgtatgtccgcatcatcggattcgacaacatgcgtcaggtgcagtgcgt

SEQ ID NO: 2808 - DNA, 726 bp, Setaria italica
gcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatgaaggtcttttgtgaacgtcacttttgtccacgactctgctggacgaccagagcatatttttcattctatatggtctgtgtatgtatgtacgaacataggttctcgagcatgcatatgtaaattctagaaccggctacacatatacaaaacctgtgtgatatttattatatacaacacgcggaccattgtcttgctgttattaattcatgaataaggttctttatttggcagatc

SEQ ID NO: 2809 - DNA, 1038 bp, Oryza sativa
agccagccagtcacccgtgctttggatcagcgaacggcagccactctttcacatccccggatcaaccaagcgctgccttccaatgccacctgcgatttggttatttatagacgtaatggattaccacacaggtcctcaagccactgctgcagcgtgactctgctctagcacctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtccggcggaaactaagctagttggcaagccagcaagctcactcgtgagctctatacagaggagactcgattgatctattcggttttggcagctttgaacgttcgaatcgggccaccttgcattggtttcccctttcccagtttgttgcttcagtttttttttttcatcttgtttgtgtcaacatcagctgtgtatgtatgtacatatgtatgtatcaacataggttgaagagcatgcatatgtgaatgctagcaccaggctaatcatatgcacatacacatcgtaataaatatattgtacaaatcgtcaaaaacgatacttata

SEQ ID NO: 2810 - DNA, 681 bp, Triticum aestivum
cctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtctggcggaaactaagctagttggcaagccagcaagctcactcgtgagctctatacagaggagactcgattgatctattcggatttggcagctttgaacggtcgaatcgggccaccttgcattggtttcccctttcc

SEQ ID NO: 2811 - DNA, 987 bp, Oryza sativa
ggatcaggcaccacatgcttggataggcaaaccatggccaatccttccacatccttgcatccacgaagcattgccttccaaccatccaatagtgacctcacccttggttatataatgacgaatctgtgcagagagagcctcagtactcaagccggaggcagcacactgcaacttaagtttttctatagctcctagcaagctagcaatggctccctcggtgatggcttcgtcggccacctccgtggctcccttccaggggctcaagtccactgcgggcctcccggtgaaccgccgctccagcagctcgagctttggcaacgtcagcaatggcggaaggatcagatgcatgcaggtgtggccgattgagggcattaagaagttcgagactctgtcgtacttgccgccattgacagtggaggaccttttgaagcagatcgagtacctgctccgatctaagtgggtgccttgcttggagttcagcaaggtcggattcgtctaccgtgagaatcacagatcacccggatactatgacggtaggtactggaccatgtggaaactgcccatgtttggatgcaccgatgccacccaagtgctcaaggagctcgaggaggcaaagaaggcataccctgatgccttcgttcgcatcattggctttgacaacgttaggcaggtgcagttaatcagcttcatcgcgtataagccaccgggttgcgaggagtcaggcggcaactaagcgctttcgttccttcgtgcatgttctttctttttctttttttttttgtgtgtccgtgttaagctgcacgtaattgttctctcgcgctccgacctgccgttgttgcaagagtactactacaactatcggtctatcgttcggtgacggtgagacagggcacgtgaatgcaagatctccggctatacacacgtactcatgtaatatgatgcctagagcatatctgaatccgtcgacaatgaaattttggttttgca

SEQ ID NO: 2812 - DNA, 861 bp, Avena sativa
caagaggaggcctcaagtgtagacaacctatctgagttaacaggcacatcggcagcaaactacgtgataccatggcccccgccgtgatggcttcgtcggccaactcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctttcttacctgccaccactctcagaggaggccctcctgaagcagatcgacttctttgatccgctccaagtgggttcccttgcctcgagttcagctaaggttggcttcatcttccgcgagcacggcagcactcctggatactatgacggcaggtactggacaatgtggaagctgcccatgttcggctgcaccgacgcctcacaggtgatcaaggaggtggaggaggtcaagaaggagtaccctgacgcctatgtccgcatcatcggcttcgacaacatccgtcaagtgcagtgcgtcagcttcatcgccttcaagccaccgggctgcgaggaatctggcaaggcataagttgccagctgaaacagtggccgctatatgaaacaacggccgcgctatatacttttgccgacgactctgctccagggtttgttttaaaagcaatatgactgtgtatgtacgtatgcttgtatgtatgtacctatgaacctagggtgaagagctgaaatgtgaattctagaaccggctatatgtaaggacatacacatattatttttttccgaatgtgtttatatccaatccacaagtgtgtttgataataattgattggaat

SEQ ID NO: 2813 - DNA, 1057 bp, Oryza sativa
accacagccagagcccgggtcgagatgccaccacggccacaatccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggattcgtctaccgtgagaaccacagatcccccggatactacgatggcaggtactggaccatgtggaagctgcccatgttcgggtgcactgacgccacccaggtgctcaaggagctcgaggaggccaagaaggcgtaccctgatgcattcgtccgtatcatcggcttcgacaacgtcaggcaggtgcagctcatcagcttcatcgcctacaagcccccgggctgcgaggagtctggtggcaactaagccgtcatcgtcatatatagccttgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatatatggaagctccggctatatatatttataca

SEQ ID NO: 2814 - DNA, 958 bp, Oryza sativa
tggtgaaccagcgtacagggcctcaacagcactgctactggacatactctactactactagccagtaagctagctaactaactacgtggctatggcccccaccgtgatggcctcctcggccacctccgtggctccattccaagggctcaagtccaccgccgggctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatatttttattttacagtttggttatgtaccatctcaatggcctctgctcttaacacatatgtaataatctcttccctccctctccggccggttttattgtaagagtactacaattatcgttgggtgaggatatgtgaaaacaaagctccggctatatacacacaagatatgtatctagagcatatctgataaattcgtcgacaataaaaaaaatggatggtatcacgtaattatgttt

SEQ ID NO: 2815 - DNA, 701 bp, Avena sativa
tccgtccgcccccttccagggcctcaagtccactgctggccttcccgtcagctgccgtagcaacgccggcctcggcaacgtcagcaacggtggaaggatcagatgcatgcaggtgtggccgattgagggcatcaagaagttcgagaccctttcttacttgccaccactctcagaggaggccctcctgaagcagatcgacttcttgatccgctccaagtgggttccctgcctcgagttcagcaaggttggcttcatcttccgcgagcacggcagcactcccggatactacgacggcaggtactggacaatgtggaagctgcccatgttcggttgcaccgacgcctcgcaggtcatcaaggaggtggaggaggtcaagaaggagtaccctgacgcctatgtccgcatcatcggcttcgacaacatccgtcaagtgcagtgcgtcagcttcatcgccttcaagccaccgggttgcgaggagtccggcaaggcctaagccgcgagctgggaataacagatgctctatgaagtgtcttgttaaaatttgtcgacaattctgattttgaggttttacttctggttccatataatagggcgatgaacaatcgcaggcttgggtaaagtctgttccttcgtagattgtcttcgttgattaacccaggcaatgcaaatgaggtttctgatttatgcgaaggattctatcc

SEQ ID NO: 2816 - DNA, 668 bp, Avena sativa
cccttccagggcctcaagtccactgctggccttcccgtcggccgccgcagcaacgccggcctcggcaacgtcagcaacggtggaaggatcagatgcatgcaggtgtggccgattgagggcatcaagaagttcgagaccctgtcttatctgccaccactgtcagaggaggccctcttgaagcagatcgacttcctgatccgctccaagtgggttccctgcctggagttcagcaaggtgggcttcatcttccgtgagcacggcagcactcccggatactacgacggcaggtactggacaatgtggaagctgcccatgttcggctgcaccgacgcctcccaggtcatcaaggaggtggaggaggtgaagaaggagtaccctgacgcctatgtccgcatcatcggtttcgacaacatccgtcaggtgcagtgcgtcagcttcatcgccttcaagccaccaggctgcgaggagtccggaaaggcctaagccacgagctgggaatatataacagatgctatatgaagtgtattgttcaaattttatacgagggattttatatgtttgctggtgattttgtttggaatctggatatatacacgtaggcatgttatgcacgtgtaagtctattttttctagtgtgtttcaatattataagagtgaattccactttt

SEQ ID NO: 2817 - DNA, 806 bp, Triticum aestivum
  misc_feature (772)..(772): n is a, c, g, or t
cgcaacgcgtccccgaattgggcacggagacctctgacatgggactgaaggaatagaaaaagccagactccctcctcctagcagggtatatacctacatagcacagccatggcccccaccgtgatggcctcgtgggccacatcaatcgctcctttccaggggctcaagtccaccaccggcctgcccgtcacccgccgatccaaaggcgatagcctcggcagagtcagccacggtggaaggatcaggtgcatgcaggtgtggcccatcgagggcatcagagaagttagagaccctgtcatacctgccaccgctcagcacggaggccctcctcaagcaggtagactacctgatccgctccaaatgggtgccttgccttgagttcagcaaggttgggttctatgttccgtgagcacaacgcatcccctgggtagtacgatggccggtactggacaatgtggaagctgcgtatgttcgggagcaccgactccacacaggtgatcaacgagttggaagagaacaagaacccctccccccaggagtacgtccgcatcatcggattcgaccacatgcgccaggtgcagtgcgtcagtttcatcgccttcaagccaccgggtttcgaggagtccggcaaggcctaatcagctcactcaccgcgggccacatataaagtgccattgcggttttgtctactccgccattgttttgggttttccttctccatttatccttcccgtttgttcttccaaaattcgtgtgggtccatgttcatgtncccaaaaaaaaaaaaaagggcggccggtctgaca

SEQ ID NO: 2818 - DNA, 797 bp, Avena sativa
cccgtcgtggcttcgtcggccacctcggtcgcgcccttccacggggctcaagtccactgctggccttcccgtcagccgccgcagcaacgccggccttggcagcgtcagcaacggtggaagaatcagatgcatgcaggtgtggcctattgagggcatcaagaagttcgagaccctgtcttacctgccaccactctcagaggaggccctcctgaagcagatcgacttcttgatccgctccaagtgggttccctgcctggagttcagcaaggttggcttcatcttccgcgagcacggcagcactcctggatactatgacggcaggtactggacaatgtggaagctgcccatgttcggctgcaccgacgcctcccaggtcatcaaggaggtggaggaggtcaagaaggagtaccctgacgcctatgtccgcatcatcggcttcgacaacatccgtcaggtgcagtgcgtcagcttcatcgccttcaagccaccgggctgcgaggaatctggcaaggcaaaggcataagttgccagctgaaacagtggccgctatatagaaacaacggccgcgctatattacttttgccgacgactctgctccgtagggttttgtttttaacaagcaatatgattgtgtatgtacgtatgcttgtatgtatgtacctatcaacctagggtgaagagctcaaatgtgaattcttgaaccggctatacgtaaggacatacacattattttttttccgaatgtgtttatatccaatccacaagtgtgtttgataataattgattggaatttctat

SEQ ID NO: 2819 - DNA, 749 bp, Avena sativa
ggcctcaagtccaccgctggccttcccgtcagtcgtcgcagcaatgccggccttggcagcgtcagcaacggtggaagaatcagatgcatgcaggtgtggccgattgagggcatcaagaagttcgagaccctgtcttacctgccaccactctcagaggaggccctcctgaagcagatcgacttcttgatccgctccaagtgggttccctgcctcgagttcagcaaggttggcttcatcttccgtgagcacggcagcactcctggatactacgacggcaggtactggacaatgtggaagctgcccatgttcggctgcaccgacgcctcacaggtcattaaggaggtggaggaggtgaagaaggagtaccctgacgcctatgtccgcatcattggcttcgacaacatccgtcaagtgcagtgcgtcagcttcatcgccttcaagccaccgggttgcgaggagtctggcaaggcataagttgtcagctgaaacaacggcctctatatatgaaacaacgtccagtatatacttttgccgatgactctgctcgagagtttgttttgcaatcaatatgattgtgtatgtacgagtatgcttgtatttatgtacctatcaacctagggtgaagagctcaaatgtgaattctagaaccggctacacataaggacatacacatatatatttattttgatgtgtttatatcccatccgcaagtgtgtttgatactttgatattaattgattggaatttct

SEQ ID NO: 2820 - DNA, 764 bp, Avena sativa
gaggcctcaagtgtagacaacctatctgagttaacaggcacatcggcagcaaactacgtgataccatggcccccgccgtgatggcttcgtcggccacctcggtcgcccccttccaggggctcaagtccactgctggccttcccgtcagccgccgcagcaacgccggcctcggcagcgtcagcaacggtggaagaatcagatgcatgcaggtttggccgattgagggcatcaagaagttcgagaccctgtcttacctgccaccattgacagaggaggccctcctgaagcagatcgacttcttgatccgctccaagtgggttccctgcctcgagttcagcaaggttggcttcatcttccgcgagcacggcagcactcctggatactatgacggcaggtactggacaatgtggaagctgcccatgttcggctgcactgacgcctcccaggtcatcaaggaggtggaggaggtcaagaaggagtaccctgacgcgtatgtccgcatcatcggcttcgacaacatccgtcaggtgcagtgcgtcagcttcatcgccttcaagcccaccaggctggcgaggagtctggcaaggcctaagccacgagctgggaataaatgccttttctgagaatctgggaataactgcctatgcaaggcatgttagttcactttttgtttgatgactctcctttcggggttttacgtttcaggttccatacaattttgtatgtatgtactatgtttgggtcggtacctatctacgtaggtc

SEQ ID NO: 2821 - DNA, 909 bp, Avena sativa
agggactcaagtccaccgcaggactccctgtcagccgccgcagcgcctccagcctcggcaacgtcagcaacggtggaaggatcagatgcatgcaggtgtggccgattgagggcatcaagaagttcgagaccctgtcttacttgccaccactctcagaggaggccctcctgaagcagatcgacttcttgatccgctccaagtgggttccctgcctcgagttcagcaaggttggcttcatcttccgtgagcacggcagcactcccggatactacgacggcaggtactggacaatgtggaagctgcccatgttcggctgcaccgacgcctcacaggtcatcaaggaggtggaggaggtcaagaaggagtaccctgacgcctatgtccgcatcatcggcttcgacaacatccgccaagtgcagtgcgtcagcttcatcgccttcaagccaccaggctgcgaggagtccggaaaggcctaagccacgagctgggaataacagatgctatatgagttctcttggttcactttttgtttacaactctcatttcggggttctaccatgtaggtcgacgagcatgcatatgttaattcttgcaccgacttcacatacccctatatatgaatatatatatatatatatatatatatatatatatatatatatatatactgtctttggacacttttcttgctgttaattgtttaaaatcttctgttttcttgcggctgaatagcctatgtctcgctgctccttgatgtaaaatatatcatgtctttttcaaggatatgacaaccttcatttgtcaaaaaaaaaaaaaaaaaactcgggtgattggcctatccgtcgatcgtttggatggaggctgaaccttcctgttacttgtttccggggtctgtcacaatgtaatggc

SEQ ID NO: 2822 - DNA, 848 bp, Eragrostis curvula
  misc_feature (89)..(91): n is a, c, g, or t
aagtaagaaagacagaaggaacagaaagaaaagaaatagatacggagaaaagaagaaacaaacgacaagagacgggtagagcaaagcgnnntgggtttgtggatatgctctgatcggctcctctcttcttcctctcccctccattacaggagagcgtagccaattaaaaccaagcagcctgccatggcgcccaccgtgatggcctcgtccgccacctccgtcgctccgttccaggggctcaagtccaccgccggacttcccctcagccgccgcgccggcagcgccagcttcggcagggtcagcaacggcggaaggatccggtgcatgcaggtgtggccggttgagaacaacaagaagttcgagacgctgtcgtacctgccaccgctgacaaccgaggacctcctgaagcaggtggagtacctgctgcggtccaactggatcccttgcctggagttcagcaacgtcggcttcgtgttccgcgagaactcccggtcaccggggtactacgacggccgctactggaccatgtggaagctgcccatgttcggctgcaccgacgccactcaggtgctcaaggagctcgaggaggtcaaggccgactaccccaactccttcgtccgcatcatcggcttcgacaacgtcaggcaggtgcagtgcatcagcttcatcgcatacaagccaccgggcagcgagtaagcaagcgcacatagctagcctcgctgctggtgcgtgagcaaccatgaactaagcctgcctgttagttcggttttgcttggggtcacctgagtttcctttttttttttttctttttgtttttttggttgcttctgctgtatccatggcctgct

SEQ ID NO: 2823 - DNA, 1633 bp, Eragrostis curvula
acagctctcgatcggctcctcctctcttcttcctctcccctccattacaggagagcgtagccaattaaaaccaagcagcctgccatggcgcccaccgtgatggcctcgtccgccacctccgtcgctccgttccagggcctcaagtccaccgccggacttcccctcagtcgccgctccggcaacgccagcttcggcagggtcagcaacggcggaaggatccggtgcatgcaggtgtggcctgttgagaacaacaagaagttcgagacgctttcgtacctgccaccgttgaccaccgaggacctcctgaagcaggtggagtacctgctgcggtccaactgggttccttgcctggagttcagcagcgtcggcttcgtgttccgtgagaactcccagtccccggggtactacgacggccgctactggaccatgtggaagctgcccatgttcggctgcaccgacgccactcaggtgctcaaggagctggaggaggtcaaggctgcctaccccaactccttcgtccgcctcatcggcttcgacaacgtcaggcaggtgcagtgcatcagcttcatcgcctacaagccaccgggcagagagtaaaccggcagtgcctcgctgctggtgcgtgagcaaccatcaacctgttcggttttgcttggggtcacctgagtttcctttttttcttctttttttttttttaggttgcttctgctgtatccatggcctgctcatgcatgtaagcgatgtccgtctccctctccgagcccagagtcatctacgtatgactacatacgtactaccactatcgttgggtgagaaacaacatgtggatgcaacaagctccggctatacggatcaatatgtactagaacatatccaacactccgtcaaaaatacaagatcgtgttaactactcgtgtttttgacttagctactacacctcttttttaaatctaacaatgatgtttcatgctttcctacaagacaaacataaaacgaagcatccagtaccccgcgttgatacgcctgcttattttacttcccgccgccactccggccgtcccggactcctatatcaacatggacaccatttcgcgattactgggtactagatttcttacacgcgctcttttctaacattagagagattaggcacaacaataaacaacaaacaaacaagaagacgacacagacgtcgtcatatttaacaagagaaataacaaagagcaagaagtgagactgtcaagaccccaccacaatgtggaccacgatgaatgaccatataatgccacctcaaagggcataccgcggggggctgcggtgtggggaccaactaagagcttgatttctaagtatagagcgctgtacgtacgcgatatcttaatatataacagattatgttatcaatcccatgcatttcttacttcaagatattctggtcgtgcagcgccactgataataggaagactgttcaatataattaattaatcttgacattgtataatcctgcatcaaggaccatcaggtcgcaactacaggctgtcgcttgaccagttgtaacgcgagatgtcgacgcttacacagcactagccgacgtagtaagccaggttggccctttagccctttatgcacctga

SEQ ID NO: 2824 - DNA, 829 bp, Triticum aestivum
gcagcagcgaactgtgaattctagctctgtagcagctcaagatcgggcttgctagaaaaagccattttgagtctcttcccaaccatacaggctacagcaacaccatggcggcatcagtagcctgcgccttcttcttcgacgccgagccggtgggcgagccgggcatgccggcgctggacgcgtgcgcgctctgcgccaagccgctggcacgcgacagcgacgtcttcatgtacaggggggacacgccctactgcagcaaggagtgccggcacgagcagatgcacctcgacgccgtctccgccaggcaggccgcccggaggctgcagcggttctcgtcgggagcagagtccgggcgtgcacgccagggggtgtccgtctcgagctaaccggcgagagtgccaagcgacatacgtgcctgacgaagaaaggttattatgcttgagccagcatgatctccgtgcaccaagccgctggtgtccgtggttagctgatcgagcagcgcgcgaggtcgaggagacttgccatgcttgaagaagcaaggggcgggtcgcaggagtcgctcacggcaggccggcgctgcatgtgccgcctgtcaagtgatttgggcataaacgcagcggaaaaggggctggattggatctgaagaaagtcaagcaaacaagattccccgcggtttaactttgaggcggtcatgtctgcccctcagtttttttctttctgcgttattgtcacttctgtacaagctcatttgcaatagcactctcgctcggtaaactttcaagcgaatcgacatacaacatgccttgtgcaatcctctttctgttcgtga

SEQ ID NO: 2825 - DNA, 853 bp, Triticum aestivum
gcagcagcgaactgtgaattctagctctgtagcagctcaagatcgggcttgctagaaaaagccattttgagtctcttcccaaccatacaggctacagcaacaccatggcggcatcagtagcctgcgccttcttcttcgacgccgagccggtgggcgagccgggcatgccggcgctggacgcgtgcgcgctctgcgccaagccgctggcacgcgacagcgacgtcttcatgtacaggggggacacgccctactgcagcaaggagtgccggcacgagcagatgcacctcgacgccgtctccgccaggcaggccgcccggaggctgcagcggttctcgtcgggagcagagtccgggcgtgcacgccagggggtgtccgtctcgagctaaccggcgagagtgccaagcgacatacgtgcctgacgaagaaaggttattatgcttgagccagcatgatctccgtgcaccaagccgctggtgtccgtggttagctgatcgagcagcgcgcgaggtcgaggagacttgccatgcttgaagaagcaaggggcgggtcgcaggagtcgctcacggcaggccggcgctgcatgtgccgcctgtcaagtgatttgggcataaacgcagcggaaaaggggctggattggatctgaagaaagtcaagcaaacaagattccccgcggtttaactttgaggcggtcatgtctgcccctcagtttttttctttctgcgttattgtcacttctgtacaagctcatttgcaatagcactctcgctcggtaaactttcaagcgaatcgacatacaacatgccttgtgcaatcctctttctgttcgtgatttaggatccggttagctcgatga

SEQ ID NO: 2826 - DNA, 757 bp, Triticum aestivum
tcggcacgagccaccctctcccccccgccaagagcagcaacgaactgcgaattctagctctgaagcagcccaagatcgggcttgctagaagaagccagtccgagtctcttcccaatcataccggctgcagcaataccatggcggcatcggtagcctgcgccttcttcttcgacgccgagccggtgggcgagcccggcatgctggcgctggacgcgtgcgcgctctgcgccaagccgctggcgcgcgacagcgatgtcttcatgtacaggggggacacgccctactgcagcaaggagtgccggcacgaacagatgcagctcgacgccgtctccgccaggcaggccgcccggaggctgcagcggttctcggcgggagcagagtccgggcgtgcacaccagggggtctccgtctcgagctaaccggcaagagtgcccagcgacatacgtacctgacaaagaaaggttattatgcttgggctaacctgatctccgtgcaccaagccgctggtgtccgtggctagctgatcgagcagcgcgcgaggtcgaggagacttgccatgcttgaagaagcaaaggggtgggtcgccggagtcgctcacggcaggccggcgctgcaagtgccgccggtcaaatgatttgggaataaacgtagcggaaaaggggcgggattggatctgagcaaaataagcaaacaagattccccacggtcacttctgtataagctcatttgccacagcactctcactcggtaaactttc

SEQ ID NO: 2827 - DNA, 784 bp, Triticum aestivum
tcggcacgagccaccctctcccccccgccaagagcagcaacgaactgcgaattctagctctgaagcagcccaagatcgggcttgctagaagaagccagtccgagtctcttcccaatcataccggctgcagcaataccatggcggcatcggtagcctgcgccttcttcttcgacgccgagccggtgggcgagcccggcatgctggcgctggacgcgtgcgcgctctgcgccaagccgctggcgcgcgacagcgatgtcttcatgtacaggggggacacgccctactgcagcaaggagtgccggcacgaacagatgcagctcgacgccgtctccgccaggcaggccgcccggaggctgcagcggttctcggcgggagcagagtccgggcgtgcacaccagggggtctccgtctcgagctaaccggcaagagtgcccagcgacatacgtacctgacaaagaaaggttattatgcttgggctaacctgatctccgtgcaccaagccgctggtgtccgtggctagctgatcgagcagcgcgcgaggtcgaggagacttgccatgcttgaagaagcaaaggggtgggtcgccggagtcgctcacggcaggccggcgctgcaagtgccgccggtcaaatgatttgggaataaacgtagcggaaaaggggcgggattggatctgagcaaaataagcaaacaagattccccacggtcacttctgtataagctcatttgccacagcactctcactcggtaaacttcaagtgaatcgacatgtaaaaaaaaaaaa

SEQ ID NO: 2828 - DNA, 570 bp, Triticum aestivum
acggtactaccaccaccagtacacgcgccagcttctcggttctcgcctaggtgcagcaacaatggccatcacttctctgcagctgccctctcagatccacggccttactcctgctagaaatgggcgcacccgcacaaggtcacgggctactctgcttagctgcaaacacaaccagtcaaccattgtccaagtagccagcaggacatcccgcagagataccctggcatacatttcgtctgccttctttgcaatgttcctggtggctgaacatgctgaagctagaacctccagacaagagaacaagaggaaagtaatggagaagttggagaaggtccgggaggaggccctgggctcaaaggagaagaaagaggacacgagcaaggagtctgtggcgaacttgttgatccctcctactttggtcgatgcttacatctgaaaggcatcgtttcgttgtaaatcttatgtttatgctaagtgctatacttaacactattctgaatgtactaataacaattggaaccaagcaaccttgcaaaagaactttcctgtgtcctcgctgcattgtttttc

SEQ ID NO: 2829 - DNA, 543 bp, Triticum aestivum
caccagtacgcgccagcttctcggttctcgtctaggagcaacaacaatggccatcacttctctgcagctgccctctcagatccacggccttgctcctgctagaaatggccgcgcccgcacaaggtcaagggctactctgcttagctgcaaacacaaccagtcaaccattgtccaagtagcgagtaggacatctcgtagaagtaccctggcatacatttcgtctgccttctttgcaatgttcctgctggctgaacatgctgaagccagaacctcgagacaagagaacaagaggaaagtaatggagaagctggagatggtccgggaggaggccctgggctcgaaggagaagaaagagaacacgaacaaggagtctgtggcaaacttgttgatccctcctactttggtcgatgcttacatctgaaaggcatcgtgtcgctgtaaattttatgtttatgctaagtgctacttaaccttgcaaaaattctgaatgtactaataacaactggaaccaaacaaccttgcaaaagaactttcctgtgtcct

SEQ ID NO: 2830 - DNA, 509 bp, Triticum aestivum
ccagcttctcggttctcgtctaggagcaacaacaatggccatcacttctctgcagctaccctctcagatccacggccttgctcctgctagaaatggccgcacccgcacaaggtcacgggctactccgcttagctgcaaacacaaccagtcaaccattgtgcaagtagcaagcaggacatctcgtagaagtaccctggcatacatttcgtctgccttctttgcaatgttcctgctggctgaacatgctgaagccagaacctcgagacaagagaacaagaggaaagtaatggagaagctggagatggtccgggaggaggccctgggctcgaaggagaagaaagagaacacgaacaaggagtctgtggcaaacttgttgatccctcatactttggtcgatgcttacatctgaaaggcatcgtgtcgctgtaaattttatgtttatgctaagtgctacttaaccttgcaaaaattctgaatgtactaataacaactggaaccaaacaaccttg

SEQ ID NO: 2831 - DNA, 509 bp, Triticum aestivum
ccagcttctcggttctcgtctaggagcaacaacaatggccatcacttctctgcagctgccctctcagatccgcggccatactcctgctagaaatggccgcgcccgcacaaggtcacgggctactccgcttagctgcaaacacaaccagtcaaccattgtccaagtagccagcaggacatctcgtagaagtaccctggcatacatttcgtctgccttctttgcaatgttcctggtggctgaacatgcagaagctagaacctcgagacaagagaacaagaggaaagtaatggagaagctggagaaggtccgggaggaggccctgcgctcaaaggagaagaaagaggacacgagcaaggagtctgtggcgaacttgttgatgcctcctactttggtcgatgcttacatctgaaaaggcatcgtgtcgttgtaaattttatgtttatgctaagtgctacttaacactattctgaatgtactaataacaattggaaccaagcaaccttgcaaaa

SEQ ID NO: 2832 - DNA, 627 bp, Triticum aestivum
cggcacgaggaactgttgagaagagtcgagaaagccaccgaggaagcacttgccttccacggcactaccaccaccagtacgcgccagcttctcggttctcgtctaggagcaacaacaatggccatcacttctctgcagctgccctctcagatccgcggccatactcctgctagaaatggccgcgcccgcacaaggtcacgggctactccgcttagctgcaaacacaaccagtcaaccattgtccaagtagccagcaggacatctcgtagaagtaccctggcatacatttcgtctgccttctttgcaatgttcctggtggctgaacatgcagaagctagaacctcgagacaagagaacaagaggaaagtaatggagaagctggagaaggtccgggaggaggccctgcgctcaaaggagaagaaagaggacacgagcaaggagtctgtggcgaacttgttgatgcctcctactttggtcgatgcttacatctgaaaaggcatcgtgtcgttgtaaattttatgtttatgctaagtgctacttaacactattctgaatgtactaataacaattggaaccaagcaaccttgcaaaagaactttccggtgtcctcgctgcattgtttttcat

SEQ ID NO: 2833 - DNA, 1094 bp, Triticum aestivum
acgcgtccgccgtgccctgcccccgatgtcgagcagcctcttcctctgctcttcccaggtgcgctatgccagcctcccggcacctctccggcagccgggccgccaagccgcccggctgcccccagcggctgccgcgttcgtctctcgcagccttcatcgccctcctcccctccactggaccggctcgggggttcggatgatttcttcttgcttcgtggtcaaaagaagaaggcgtaggaatggtatctccgcctctttgtttggcgttggagctcctgaagccctggtcattggagtggtcgctttgctggtttttggccccaagggtctagcagaggcagccaggagtttggggaagactctgcgtgcgttccaaccgactatcagagagctacaggatgtatcaagggatttcaagaacactcttgaacgagaaatcgggcttgatgaggatcccccatccatcagttataggcctcctccacctatgaataatagcccacggcctgctgttgacccagatgtcaagcctgaaacaaccgtgccttacacgagcgaggaactcatgaaagtaaccgaagagcagcttgctgcatccgcaattgctgcttggaatgcacagcaacctcccacatctgaacagcaagaagcagcagcagcaacaacaccttctgaaagtactgactcagcattatcaggagggagtgacggtcctagtgccgtgacggaggagtccacctcaggtaatactgaaaatgcaaagccgagagacgaggcataatactaaaaacagaaagtatgttgtatgcggactagaggaaggcgaaagctttggcgtcaattggttgtagaaagaatgaaatagttttggtttccacttggtgagctgggttggccaagtgatgggtgattcgaggcttcgattagtagcggcttggtctgttgaggtgtgtagcatggagagataggtaggtgatgcgaaaccgagctgtgcatatcttggtcctcctccagtatcttgtttctgccacggctgttgttacatgtctgtaccatatttttgtgattatgcaaggtaagcagatagatttttg

SEQ ID NO: 2834 - DNA, 1105 bp, Triticum aestivum
gtcgagcagcctcttcctctgctcttcccaggtgcgctatgccagcctcccggcacctctccggcagccgggccgccaagccgcccggctgcccccagcggctgccgcgttcgtctctcgcagccttcatcgccctcctcccctccactggaccggctcgggggttcggatgatttcttcttgcttcgtggtcaaaagaagaaggcgtaggaatggtatctccgcctctttgtttggcgttggagctcctgaagccctggtcattggagtggtcgctttgctggtttttggccccaagggtctagcagaggcagccaggagtttggggaagactctgcgtgcgttccaaccgactatcagagagctacaggatgtatcaagggatttcaagaacactcttgaacgagaaatcgggcttgatgaggatcccccatccatcagttataggcctcctccacctatgaataatagcccacggcctgctgttgacccagatgtcaagcctgaaacaaccgtgccttacacgagcgaggaactcatgaaagtaaccgaagaacagcttgctgcatccgcaattgctgcttggaatgcacagcaacctcccacatctgaacagcaagaagcagcagcagcaacaacaccttctgaaagtactgactcagcattatcaggagggagtgacggtcctagtgccgtgacggaggagtccacctcaggtaatactgaaaatgcaaagccgagagacgaggcataatactaaaaacagaaagtatgttgtatgcggactagaggaaggcgaaagctttggcgtcaattggttgtagaaagaatgaaatagttttggtttccacttggtgagctgggttggccaagtgatgggtgattcgaggcttcgattagtagcggcttggtctgttgaggtgtgtagcatggagagataggtaggtgatgcgaaaccgagctgtgcatatcttggtcctcctccagtatcttgtttctgccacggctgttgttacatgtctgtaccatatttttgtgattatgcaaggtaagcagatagatttttgaagggatgagatatcttttttctttctcaaaaaaaaaa

SEQ ID NO: 2835 - DNA, 1188 bp, Triticum aestivum
  misc_feature (450)..(451): n is a, c, g, or t
  misc_feature (651)..(651): n is a, c, g, or t
gcacgagccaccgtccaccgcagcgcgccatgctctccctcctcccgcccgcgcggctccgcgccgcgccctccgacgcctccgtcaccttgccgcgccgcccggccgtcatcctcccagggctcgggaacaacacgggcgactacgcgcggctggccgcggcgctgcgggacggccacggcgtgccgtccgtcgtcgcccgggtctcgcgccccgactggctccgcaacgccgccgggctcgccgaccccagctactggcggggcaccctccgcccgcgccccgtcctcgactggtacctgaaccgggtggaggaagcggtgtccgaggccagggagctatcctctccagatgggaagctatcattgatagggcattcagctgggggctggctcgcgcgcgtgtacatggaggaattcgggacttctgacataagtttgctgctcacgnnggcactccccacctgcctcctcccaaaggtgtttctggcgtaattgaccaaactagaggactactgaactacgtcgagaagaattgtgcccccgcagtttacacaccagaactacgatatgtatgcattgctggaaggtacattcagggtgctcctttaactggaaactccctggctactaccacagatgagcttgtcgncgtggacgccccatcagaagtagctgaagcagtcatggccagtgccgacaacaaaaccgctccgacaggccccacctttcgggcccgtttcgtgggacaaggctacaaacaggtttgcggccgcgctgacgtctggggagatggggtcgtccccgaagtgtcagcgcacctggagggcgcactgaatataagcttcgacggcatttaccattctcctgtaggttctgatgatgaagagaggccctggtacggctcaccagcaatcctagagcaatgggtgcaccatctcctcagctaatgctacagaagctttaccaattccagaagtttgtcatgccccttttcactagtataaatagcacggcatagcaacatatacagtaaatcatgtacagaagatgcagctgtactctgttctcatacctttccagagtgcgtctagatgtctcaggcgccggcgttccttgtaccatgtactcagcaagagtgtaaccttgctaatctatctatatgaattcccaattctcaaaaaaaaaa

SEQ ID NO: 2836 - DNA, 1200 bp, Avena sativa
ggagagggaggcgcacgccgcgccacgccacgccacggcgagcccaccaacaccaccaccgcagcacacacaccggccatgctccccctcctcccgcccgcgcgcctccgcgccgcgccctccgacgtcgccgccgcagcatcgccgcgccgcccggccgtcatcctcccagggctcgggaacaacacgggcgactacgcgcggctggccgcggcgctgcgggacgaccacggcgtgccgtccgtcgtcgcgagggtgtcgcgccccgactggctccgcaacgccgcggggctcgccgaccccagctactggcggggcaccctacgcccgcgccccgtcctcgactggtacctgaaacgggtggaggaggcggtgtccgaggccagggagctatgccctccagatgtgaagctatcattggtagggcattcggctggcggttggctcgcgcgcgtatacatggaggaatttgggacgtctgacataagcctgctgctcacccttggcactccacacctgccacctccaaaaggcgtatctggcgtaattgaccaaactagaggactactgtaccacgtcgaggagaattgcgcccctgcagtttacacgccagaactacgctatgtgtgcattgctggaaggtacattcagggtgttcctctagctggaaattctgttgccactaccgaagagattgtcacagtggacgctccatcagacgttgctgaagcagtcatggtcagcgccgaagataaatccgctcgatcaggctccacctggcgagctcgcttcgttggacaaggctacaaacaggtttgtgggcgcgccgacgtgtggggagacggtgtcgtccccgaaatatcagcgcatctggagggggcgctgaatataagctttgatggcgtgtaccattctcctgtaggtgccgatgacgagaggccctggtacggctcaccagcgatcctcgagcagtgggtgcatcatctcctcagttgataccacggacggatttaccagttccaaaagcttgtcagcaagacggtgtattgacatgttgtcagtcgagtgtcagcaagacggatgcaagtttacatatgtacgcagcttaaactgtttcgactttaccttttgtcaaattgttaagtggactatagaacataatttcacatgttttgcccttttgccaaattgttgcaataa

SEQ ID NO: 2837 - DNA, 1229 bp, Panicum virgatum
cgcggcttcgcttcgagaggcgcacgccgcgccacggcgagccactccccacccccactcggcaggcatcgcacgcacagggacggcggcgacatgctcccgctcatctcgcctccggggcttcgtgccgccgccgcccgccaacgccggcggcactgccacgttcccgagaccgtccgtcatcctcccagggctcgggaacaacacgggcgactacgcgcggctcgccgcggcgctgcgggacgaccacggcctgccggcggccgtcgtggcgcgggtgacgcgccccgactggctccgcaacgccgcggggctcgtcgacgccaactactggcggggaacgctccgcccgcgccccgtcctcgactggtacctgaagagagtggacgaagcggtgtctgaggcgagggaactatgttctccaggtggaaagatatcattgatagggcattcagctgggggctggctcgcacgcgtgtacatggaagagtttgatgcttctgacataagtttactgctcacccttggcacccctcacttgcctcctccgaaaggtgtacctggggtaattgaccagactagaggattattgaactacgtcgagaagaattgtgctccagcagtttatacgccagaattgagatatgtgtgcattgctggaaggtacatccaaggtgctcctcttctgggggactctacagttacttcagatgaggtcctagcagtggacactacttcagaaggaggtgaggctgttattatcagtaccaatgacaaatctactccatcaagtaccacatggagagcccggtttgttggacaagggtacaaacaggtttgtggccgtgcggatgtgtggggcgatggtgttgttcctgaaatggctgcgcatctggagggtgcactgaacataagctttgacggcgtgtaccactcgcctgtaggtgctgatgatgaacagaggccctggtatggctccccagcaatcctgaaccagtgggtgcatcaccttctcagctgagctgacttatgagctagctacccgtcaagaaactggaaatgttatcaacgatcaacgttgacataccatcaggcacccaggggggcgctttttctcagcctgaaattggagtgtcaaggcatcttgtgtagtgtcgttcattggcagtttggcatgatagtaacacaatcctgggcaatagtatttttttgttccgttacacaatttt

SEQ ID NO: 2838 - DNA, 1530 bp, Theobroma cacao
gtgggctcgtcccagaaccggcccatccaacccctgcctgtctgtgctgctgcgcgcttatcctcgtatccatccaacacacaccctttggcttctcaaaaaaaaataatccaattctatccatcgccggcgaattatccgtccggtcaccctccgatctgatccatgaccttatcagacgacgaagacaagttcttggcaaacttcctcgaatccgaactctccaatgaggaggagagggaattggaggagcctgaagccaagcgattgcgcggaggaaaggatgatgaggaagaggaaccaaaacgcaagggagagggggcttcttgttccaatccgaatccggattcgggtccgggccaagtgaagaacaacagcagtataagtgttcctcggaggattgagagtggaacttttagcaagatccctcctgagctgttccctcacatcctcaaatttctttcatccgaggatcttgtatcgtgctcgctggtatgcagtttcctgaattacgcggcagctgatgagtccttgtggcgtcgcctgtattgtatgaggtggggtttgttgcctccaacaaaaataagagaatgtgcttggaagaagctttacattcagcgtgatgaggaggacatgattgaacttgttaggaactgtccatctgaatttaaagagtactacattcaaatgcaagcagcaaaaagaagccaagcacctcttccttcgcaggtgaaggatgacttgataattctggacaagacagttgctgatcaagtatctatgtggaaaagcagtcggggtctggctgataaggttgttgctgaccatgcttgttctggagaaacatgttcgtactaccaaattggagatgtatttgtttgtgagaagactgggcaggttcatgtatgtgatgatacttgtcgagaagtcattttggaccccaccaatgagcttttggtctgcacaatatcaggccactgttttgataggttactgtcaccatccgaaatggaattggatccagagcaacagcaaggaggtggcacagatgaagcagaaccattcatgggatctggccgatttgcacgagcttacttactaggatacaactgcgacgatgaaaaggagctggaagctgctttgaggttttgttgatccaaatctttgttaattttaggtgggtgtatttatgcgggtaaattagtaaaaggccaaggccacaaatgttcacatgtctggcatatgaatgtttaggttttgcttgattctacagttgtacgactgttagatataagtcagaccattcagttttaagctatcatattacttggttacatagtatgataaaaatcccccgtccctgaatcttaaattgtaacattttggcccaaggcgagtggcacatgatttcgattgaagtcaaagcattagcacatggttacccgtggatggatgataggcaattgatattgccaccctcaaactaaacaggaagtagtcgtggttggagcataaaattatgttattccc

SEQ ID NO: 2839 - DNA, 1299 bp, Theobroma cacao
  misc_feature (16)..(16): n is a, c, g, or t
  misc_feature (66)..(66): n is a, c, g, or t
  misc_feature (708)..(708): n is a, c, g, or t
  misc_feature (1254)..(1254): n is a, c, g, or t
cggggggcttctcaanaaaaataatccaattccatccatcgccggccggcgaattatccatccggncaccctccgatctgacccatgaccttatcagacgacgaagacaagttcttggcaaacttcctcgaatccgaactctccaatgaggaggagagggaattggaggagcctgaagccaagcgattgcgcggaggaaaggatgatgaggaagaggaaccaaaacgcaagggagagggggcttcttgttccaatccgaatccggattcgggtccgggccaagtgaagaacaacagcagtataagtgttcctcggaggattgagagtggaacttttagcaagatccctcctgagctgttccctcacatcctcaaatttctttcatccgaggatcttgtatcgtgctcgctggtatgcagtttcctgaattacgcggcagctgatgagtccttgtggcgtcgcctgtattgtatgaggtggggtttgttgcctccaacaaaaataagagaatgtgcttggaagaagctttacattcagcgtgatgaggaggacatgattgaacttgttaggaactgtccatctgaatttaaagagtactacattcaaatgcaagcagcaaaaagaagccaagcacctcttccttcgcaggtgaaggatgacttgataattctggacaagacagttgctgatcaagtatctatgtggaanagcagtcggggtctggctgataaggttgttgctgaccatgcttgttctggagaaacatgttcgtactaccaaattggagatgtatttgtttgtgagaagactgggcaggttcatgtatgtgatgatacttgtcgagaagtcattttggaccccaccaatgagcttttggtctgcacaatatcaggccactgttttgataggttactgtcaccatccgaaatggaattggatccagagcaacagcaaggaggtggcacagatgaagcagaaccattcatgggatctggccgatttgcacgagcttacttactaggatacaactgcgacgatgaaaaggagctggaagctgctttgaggttttgttgatccaaatctttgttaattttaggtgggtgtatttatgcgggtaaattagtaaaaggccaaggccacaaatgttcacatgtttggcatatgaatgtttaggttttgcttgattctacagttgtacgactgttagatataagtcagaccattcagttttaagctatcatattacttggttanatagtatgataaaaatcccccgtccctgaattttatattgtaata

SEQ ID NO: 2840 - DNA, 1093 bp, Saccharum officinarum
cggcgccgcggctgacgcggcagagagctgtcaacgtgccgcgccgcccccaacggtcactagagagcagaagaggcttgcattcccatctccagccaatcaatcgcctctcgcctttaaatcctgcgcgcaccgccgcctccactcggaccgctccctaatccgccgcctcccactcaatcgccgccaaggagaaaggactcgatcgtcagcgatggcccggggcgagaaccaggaatcgcagaccgggaacgtgcccgccgcatccgcggcgtcggcgggggccgggaagggcgcggagggccagtcggtggtgcggcggctgcagtcggagctgatggcgctgatgatgggcggtgacccgggcgtgtcggcgttcccggagggggacaacatgctccactgggtgggcaccatcgcgggctccgccgggacggcctacgagggcacctcctaccgcctcgcgctggccttcaccgccgagtacccgtacaagccgcccaaggtgcggttcgacaccccctgcttccaccccaacgtcgacgtgcacggcaacatctgcctcgacatcctccaggacaagtggtcctccgcctacgacgtgcgcaccatcctcctctccatccagagcttgctcggagagccgaacaacgaatcgccgctcaacacgcaggccgcggcgctctgggcgaaccaggaagagttcaggaagatggtggagaagctctacaagcccgccgcgtagaggaggaggaggacagcacccggcgcagatgtcgcctcgggttcttcaagcacttgctctcgcttggatcgattattaggtggatgggatggcttcgttgggttgggttcccagtctggtgctgtagcaggagtatgtgggtccctggagcctggcgattctgtaattgttctttgggtgtgttttgcctctgtaaaatttttaaaagtacagtaactctttcgtttgtatttggtaattagtgtccaaatcatggactaattaggttctaaaaaaaagaacaaaacaacgggcggccgctataaaccatccagacttacgagcgcatgcaacctaagatagatttat

SEQ ID NO: 2841 - DNA, 1094 bp, Saccharum officinarum
cggcgccgcggctgacgcggcagagagctgtcaacgtgccgcgccgcccccaacggtcactagagagcagaagaggcttgcattcccatctccagccaatcaatcgcctctcgcctttaaatcctgcgccgcaccgccgcctccactcccaccgctccctaatccgccgcctcccactcaatcgccgccaaggagaaaggactcgatcgtcagcgatggcccggggcgagaaccaggaatcgcagaccgggaacgtgcccgccgcatccgcggcgtcggcgggggccgggaagggcgcggagggccagtcggtggtgcggcggctgcagtcggagctgatggcgctgatgatgggcggtgacccgggcgtgtcggcgttcccggagggggacaacatgctccactgggtgggcaccatcgcgggctccgccgggacggcctacgagggcacctcctaccgcctcgcgctggccttcaccgccgagtacccgtacaagccgcccaaggtgcggttcgacaccccctgcttccaccccaacgtcgacgtgcacggcaacatctgcctcgacatcctccaggacaagtggtcctccgcctacgacgtgcgcaccatcctcctctccatccagagcttgctcggagagccgaacaacgaatcgccgctcaacacgcaggccgcggcgctctgggcgaaccaggaagagttcaggaagatggtggagaagctctacaagcccgccgcgtagaggaggaggaggacagcacccggcgcagatgtcgcctcgggttcttcaagcacttgctctcgcttggatcgattattaggtggatgggatggcttcgttgggttgggttcccagtctgatgctgtagcaggagtatgtgggtccctggagcctggcgattctgtaattgttctttgggtgtgttttgcctctgtaaaatttttaaaagtacagtaactctttcgtttgtatttggtaattagtgtccaaatcatggactaattaggttctaaaaaaaagaacaaaacaacgggcggccgctataaaccatccagacttacgagcgcatgcaacctaagatagatttat

SEQ ID NO: 2842 - DNA, 1111 bp, Sorghum bicolor
ccaccgctccgatctatcctccactcgatctctcgccgccgccgccgccgccgccgcctactcccactcaatcgccgccgacgagaaagcaccgactcgatcgtcagccatggcccggggagagaaccaggaggcgcagagcgggaacgtccccgacgcatcatccgcatccgcgccgaaaccggcgtcgtcgtcatcgtcggcgggggccgggaagggcttggagggccagtcggtggtgcggcggctgcagtcggagctgatggcgctgatgatgggcggcgacccgggcgtgtcggcgttcccggacccggacggggacagcatgctccactgggtgggcaccatcgcgggctccgcggggacgccctacgagggcacctcgtaccgcctcgcgctggccttcaccgccgagtacccctacaagccgccgcaggtgcggttcgataccccctgcttccaccccaacgtcgacgtccacggcaacatctgcctcgacatcctccaggacaagtggtcctccgcctacgacgtccgcaccgtcctcctctccatccagagcctgctcggagagccgaacaacgactcgccgctcaacacgcaggcggcggcgctctgggcgaaccaggaagagttcaggaagatggtgcagaagctctacaagcccgcagcgtaggggaggagccgaggaggacaaggacaagcccgctgcgggttcttcaagcactcatctcgcttgcgtcgataactcgatgtcgaattgtcgatggagaagacaagaaaatagatggatgcttttgttgggttgggtttcccagtctggtggtgtagcagaagacaagaaaacagtacgagtgttcttttgagttctgaatgtttagaggttcatttttacaggacttattttcgcccagattcagtgctgcttggcgatcaacgaaatttcagatgacctgcattcgcagtgttaatacccagatgaaaaccacatgtacttgatattgccgttcctcttctaacgcagtgttgttgctcggctgatgcatcaagaatccaagggtcaaatggaccctgtccaccaaagcgaattcatattttcagtaatgttggg

SEQ ID NO: 2843 - DNA, 919 bp, Triticum aestivum
gatccgatccgctcctctcctcgacccatcccccgcacggaacgagcgatggcgaggggcgagaacagcgagtcgcacggcagcggcaacgtcccggcggcccccgcaccaggggcagcgtcagcgtcctcggggaagcaggcgccggcggctgcgcgtggcgcggacgggcagtcggtcgtgcggcggctgcagtcggagctaatggcgctgatgatgggcggcgaccccggagtgtcggcgttcccggagggggacaacatcttccagtgggtcggcaccatcgacggatccgccgccaccgcgtacgagggcacctcctaccgcctcgcgctcgccttccccagcgactacccctacaagccgcccaaggtgcggttcgagaccccctgcttccaccccaacgtcgataaccacggcaacatctgcctcgacatcctccaggacaagtggtcctccgcctacgacgtccgcaccatcctcctctccatccagagcctgctcggagagccgaacaacgactcccccctgaacacacaggcggccgcgctctgggcgaatcaagaagagttcaggaagatggtggagaagctctacaagccggcgtaaagaggaacaagaaggcgggatctattggaatggcggctccacattggcgtcgattgatcgaatctgttgttggatagattctggagtgttgtttctcatgttggcgtcgattgatccaacagttggagcttcgattgctcggtgggtttagcaaacctgttgtttctcatgtcatgctgttctcccatcgctgagatgggcatatacttcactgaaataatcaggtgttcgatagattttcaactgttggatacttgcgacatgtaactgattcgagttccttttttggttggcatgttcgaaactgacc

SEQ ID NO: 2844 - DNA, 837 bp, Hordeum vulgare
atccgccctgccccgctcctctcctcgatccaccccccgcgcggaacgagcgatggcgaggggcgagaacagcgagtcgcacggcagcggcaacgtcccggcggcccccgcggcaggggcagcgtccgcgtcctcggggaagcaggcgccggcggctgcgcgtggcgcggacgggcagtcggtggtgcggcggctgcagtcggagctcatggcgctgatgatgggcggcgaccccggggtgtcggcgttcccggagggggacaacatcttccagtgggtcggcaccatcgacggatccgccgccaccgcgtacgagggcacctcctaccgcctcgcgctcgccttccccagcgactacccctacaagccgcccaaggtgcggttcgagaccccctgcttccaccccaacgtcgacaaccacggcaacatctgcctcgacatcctccaggacaagtggtcctccgcctacgacgtccgcaccatcctcctctccatacagagcctgctcggagagccgaacaacgactccccactcaacacacaggcggctgcgctctgggcgaatcaagaagagttcaggaagatggtggagaagctctacaagccggcgtaaagaggaacaagaaggcgggatctatcggattggcggctacacatgggcgtcgcttgatcggatctggtgttggatagattcttggctgttggttggatacttggacatgtaattgattggagcttcgattgctcggtgggtttagcaacctgttatgtcatgctgttctcttctcccatcgctgagatggacataactttactgaaataatcagttgctcgata

SEQ ID NO: 2845 - DNA, 927 bp, Hordeum vulgare
ccctccaaaccctctccaccctcccgccgatccgatccgatccgatccgccctgccccgctcctctcctcgatccaccccccgcgcggaacgagcgatggcgaggggcgagaacagcgagtcgcacggcagcggcaacgtcccggcggcccccgcggcaggggcagcgtccgcgtcctcggggaagcaggcgccggcggctgcgcgtggcgcggacgggcagtcggtggtgcggcggctgcagtcggagctcatggcgctgatgatgggcggcgaccccggggtgtcggcgttcccggagggggacaacatcttccagtgggtcggcaccatcgacggatccgccgccaccgcgtacgagggcacctcctaccgcctcgcgctcgccttccccagcgactacccctacaagccgcccaaggtgcggttcgagaccccctgcttccaccccaacgtcgacaaccacggcaacatctgcctcgacatcctccaggacaagtggtcctccgcctacgacgtccgcaccatcctcctctccatacagagcctgctcggagagccgaacaacgactccccactcaacacacaggcggctgcgctctgggcgaatcaagaagagttcaggaagatggtggagaagctctacaagccggcgtaaagaggaacaagaaggcgggatctatcggattggcggctacacatgggcgtcgcttgatcggatctggtgttggatagattcttggctgttggttggatacttggacatgtaattgattggagcttcgattgctcggtgggtttagcaacctgttatgtcatgctgttctcttctcccatcgctgagatggacataactttactgaaataatcagttgctcgatagattttttactgttggatacttgtgacatgtagctgattcgagttt

SEQ ID NO: 2846 - DNA, 836 bp, Triticum aestivum
gatccgatccgctcctctcctcgacccatccccgcacggaacgagcgatggcgaggggcgagaacagcgagtcgcacggcagcggcaacgtcccggcggcccccgcaccaggggcggcgtcagcgtcctcggggaagcaggcgccggcggccgcgcgtggcgcagacgggcagtcggtggtgcggcggctgcagtcggagctgatggcgctgatgatgggcggcgaccccggggtgtcggcgttcccggagggggacaacatcttccagtgggtcggcaccatcgacggatccgccgccaccgcgtacgagggcacctcctaccgcctcgcgctcgccttccccagcgactacccctacaagccgcccaaggtgcggttcgagaccccctgcttccaccccaacgtcgacaaccacggcaacatctgcctcgacatcctccaggacaagtggtcctccgcctacgacgtccgcaccatcctcctctccatccagagcctgctcggagagccgaacaacgactccccgctcaacacacaggcggccgcgctctgggcgaatcaagaagagttcaggaagatggtggagaagctctacaagccggcgtgaagaggaagaagaaggcgggatctgtcggattggcggcgccacatgggcgtcgattgatcggatctggtgttggatagatacttggacatgtaattggttggagcttcgattgctcggtgggtttagcaaacctgttgtttctgatgtcatgctgttctcccatcgctgagatgggcatatactttactgaaataatcaggtgttctatagatttttcaactgttggat

SEQ ID NO: 2847 - DNA, 930 bp, Triticum aestivum
gagtaaaatcaccgcccctctcgccgtctcaattccccaattcccccctccaaaccctctcaacctctccaccctcccgccgatccgatccgatccgctcctctcctcgacccatcccccgcacggaacgagcgatggcgaggggcgagaacagcgagtcgcacggcagcggcaacgtcccggcggcccccgcaccaggggcggcgtcagcgtcctcggggaagcaggcgccggcggccgcgcgtggcgcagacgggcagtcggtggtgcggcggctgcagtcggagctgatggcgctgatgatgggcggcgaccccggggtgtcggcgttcccggagggggacaacatcttccagtgggtcggcaccatcgacggatccgccgccaccgcgtacgagggcacctcctaccgcctcgcgctcgccttccccagcgactacccctacaagccgcccaaggtgcggttcgagaccccctgcttccaccccaacgtcgacaaccacggcaacatctgcctcgacatcctccaggacaagtggtcctccgcctacgacgtccgcaccatcctcctctccatccagagcctgctcggagagccgaacaacgactcccccctcaacacacaggcggccgcgctctgggcgaatcaagaagagttcaggaagatggtggagaagctctacaagccggcgtgaagaggaagaagaaggcgggatctgtcggattggcggcgccacatgggcgtcgattgatcggatctggtgttggatagatacttggacatgtaattggttggagcttcgattgctcggtgggtttagcaaacctgttgtttctgatgtcatgctgttctcccatcgctgagatgggcatatactttactgaaataatcaggtgttctatagatttttcaactgttggatgcttgtg

SEQ ID NO: 2848 - DNA, 631 bp, Pennisetum glaucum
tcgggcccgaagccggcgtcctcggcggccgggaagggcgcggagggccagtcggtggtgcggcggctgcagtcggagctgatggcgctgatgatgggcggcgacccgggcgtgtcggcgttcccggatggggacaacatcttcaactgggtgggcaccatcgccggatccgccggcaccgcctacgagggcacctcctaccgcctcgcgctcgccttcaccgccgagtacccctacaagccccccaaggtgcggttcgacacgccctgcttccaccccaacgtcgacgcccacggcaacatctgcctcgacatcctccaggacaagtggtcctcggcctacgacgtccgcaccatcctcctctccatccagagcctactcggagagccgaacaacgactcgccgctcaacacgcaggcggcggcgctttgggccaaccaggaagagttcaggaagatggtggagaagctttacaagcccaccgcgtagaggagaagagcgggaggaggaaggcgcccggcgatgatgccggctgcggttcgagggtggtggcatggtgaaggcatggtgaagctctgcaagcagtgatctcgcttggacgatgagggatttggtgcattctttggtcggg

SEQ ID NO: 2849 - DNA, 1325 bp, Sorghum bicolor
gcgaccagtgagtcgatggctatcgccgccgttcgccggcgcttgtggcgcgggctggggactgcggccgccgccgtggcctcggggacggacgggaatctgctcgctcgcctggtctcggagccggagtgccgcgtcaaggcgaccatggaggaggctgcctcctcggggacccaccgagacggcgccttctgggaacccctcgctgccgcgctcctccgcgcgtcgtctccgaccaaggctcacctcatattggagtgggaactagagaagctgctgaaggaaaacattcaagattgcgagccctactcgaggataatccgtttctgtggtcagacaaggaatgcaacgcttgcaatgagagttttcgaatgcgtggaggcgaagggaatccagctgaacactaacattttcaatgcccttattaatgctttcttgtcagccggtgacctcctttctgcaatgaccttatatgagagtatggaagacatggatggttgcaatcccaactcagctacatatgatgcattcatctgtgcattttcgctgcttggaagtggccatgctatgatgagctggtatgtagctgcaaagaatgctgggtttacgccaagtattcaaacttttgaatctttgatcacagggtttgttcagttgaacatgctagatgatgccaaaacaatttttgaggaaatgattgccttggagattaagccaaactctactattttggaggccagtcttgagattctctatagaaaggaggaggccagcagagtcagagactttttaaaacgtgtaagtgatggcaattgggagttgaacaaagctatagttgtgaggttgacaagaatatgcctagatggaggggaaatagatgaaatggagcagctacttgccctaatacaaaagggaccacacttgagttctgaaacacaactgcaccatggaattatcaggttctatgctaaggcagatcaattggcagatatggagcatgcgatttaccggatgttggacaacggtgtggtgtttatgtgcccagaggatgttgaggtcataatctgttcttattttcgtcacagggagtttgataggttggatctcttcttgaatcgcatccgaaatttgttcaagctcaacaggtctacatatgatatattggttgcaggataccgaaagtttgatttacatgaaagacttgattcaaccatagctgatatgagggaagctggatttgcatgagctcacaaagaactatctgtgcaccatgactttccacagtaatactttcagaatccttaagtgcatcaagcctggaaaac

SEQ ID NO: 2850 - DNA, 1489 bp, Sorghum bicolor
gtgccttgccttatataatgccaccttccgcttcccttccccgtcgcggcctcgccaacccaattcaatttcgattccacccacccagttcatccaacgcctcgcccatcttcgcttcgccaaccgatcggtagaagtaaacatcctcagtaaacacaacaatggccctgctcaaagccgcgcgcgtcgccgacgtgcccacgctggacgtggtggccccaggcctggtggtggaggcgggcacggcgtcggtggcgacgatggtgaagagcggcggcggcggcggcggcggcggcgggcggttctcggtgatcgggcaccgcggcaaggggatgaacgcgctggcgtcggcggacccgcggatgcaggaggtgcgcgagaacacggtccggtccttcaacgacgccgcgcgcttccccgtcgactacgtcgagttcgacgtccaggtcactaaagatggatgcccaatcatcttccatgacaacttcatcttcacccaagaagatggtaaaatttcacagaagcgtgtgaccgatattcatctggaagacttcctccagtatgggccccagaatgagcaggggaaggttgggaagcccctgcttcgcaggctgaaggatggtaggatggtgaactggaatgtgcaatcggaggatgctctttgcacacttgaagaagcgttcgagaaggtcaatacaagattgggcttcaacgttgagctgaaatttgatgacagtcttgaataccaggaggaagagctcactcgcatcctccaggccatcctcaaggtgatttttgagcatgccaaggataggcctatacttttctctagttttcagcccgatgctgcacagctcatgcgtaaattgcaaggcacatatcctgtctacttcctgacaaacggagggacagagctatacaccgacgtgagaaggaactcgttggaggaggccgtcaagctttgcctcgcgagtggcatgcaaggaatagtttcagaagcccgcgggatattcaggcaccctgctgctgtaccaaagatcaaagaggctaacctctccctgctaacctatggaacattgaataatgtgccggaggcggtgtacatgcagcacctcatgggagtgaatggggtgatcgtcgacctggtgccggagatcaccgacgcagtctcggagctcattgccctgcccgagcctgacctggaagtggacaacttgagcaaccaggcagctagaggagccacaacaccgaatttctcgcagcgcgagatctcgttcttgctgaggctaattcctgagcttgtccaataatgcctagacttccaggatgtctatcatggatgaatcatctaatgtattactgatctagtgatatgcatgtatacaagaaaagaagcccttgtgcagggtatttgtttgtcctggtcccagttttacttttggtgataggaatggggatttgataatgctggcaaaatattcagtgcaaa

SEQ ID NO: 2851 - DNA, 2012 bp, Saccharum officinarum
ggccacccaattcaatacgatttcagttcgattccagttcatccaacgcctcgccatcctcgccaacccatcggttgtacgtacgtacaagctcatcagtaaaacaatggccctgctcaaagccgcgcgcgtcgccgacgtgcccaccctggacgtggtggcccccggcctggtggtggaggcgggctcggcgtcggcgtcggcggcggtggcgatggtgaagaccggcgccgcggcggcgggcggcggcggccggttctcggtgatcggacaccgcggcaaggggatgaacgcgctggcgtcggcggacccgcggatgcaggaggtgcgcgagaacacggtccggtccttcaacgacgccgcgcgcttccccgtcgactacgtcgagttcgacgtccaggtcaccaaggatggatgcccaatcatcttccatgacaactttatcttcacccaagaagatggtaaaatttcacagaagcgtgtgactgatattattctggaagacttcctccagtatggcccccagaatgagcaggggaaggttgggaagcccctgcttcgcagactgaaggatggtaggatggtgaactggaatgtgcaatcagaggacgctctttgcacacttgaagaagcgttcgagaaggtcaatccaagattgggcttcaacgttgagctgaaatttgatgacagccttgaataccaggaggaagagctcactcgcatcctccaggccatcctcaaggtgatttctcagcacgccaaggataggcctatacttttctctagttttcagcccgatgctgcacagctcatgcgtaaattgcaaggcacataccctgtctacttcttgacaaacggagggacagagctatacaccgacgtgagaaggaactcgctggaggaggccgtcaagctatgccttgccagtggcatgcaaggaatagtttcagaagcccgcgggatattcaggcaccctgctgccgtaccaaagatcaaagaggctaacctctccctgctaacctatgggacattgaataatgtgccggaggcagtgtacatgcagcacctcatgggagtgaatggtgtgatcgtcgacctggtgccggagatcaccgacgcagtctctgagctcattgccctgcccgagcctgacctggaagtggacaacttgagcaaccaggcagctagaggagccacgacaccgaatttctcgcagcgcgagatctcgttcctgctgaggcttattcctgagcttgtccaataatgcctagacttccaggtgtctatcatggatgaatcatctaatgtattactgatctagtgatccgcatgtctgtcctgaagcttgtcctggtcccagttttacttttgctgacatgattggtgatttgataatgctgtaccgacaacagggggtgttgtgacttgtgaggcctggccacaatattctgatgacaagtgtttagaccgaacaaaagagtcttgagtgcaattaactgtttgagttaaaccaaaccatggtgtgttgggaattgtacgagcagggtgtttggttcgagaaatgaattgttatatcatcttttccctccacaaaacaacacccatccaaacctgactacggagatcgccccaaatcgccgtacgcaatcactcgcccccgtggcttctcccgtggacacccctacctacgcctatgcacgctccgcgctattccctccgccctccaactcaccacgcgggcgtgccgctcttacgaacacctccatctcacgccggcggtacgacagctccccaccttatcttattgaccatccacgcacaaccgcgtgagcggaggcaccaccatgcagccatgtagaaacaccactgctctccaccacttattacgctcgcatcgaccacacatcccctcgtcgtcgcggcctgtgtctaacacgaaacgagagctcaacccacgccctctctcactcagagatcgccgccgctgactattggagagtccaccgtcctcc

SEQ ID NO: 2852 - DNA, 1604 bp, Saccharum officinarum
ccacgcgtccgcggacgcgtggggccacccaattcaatacgatttcagttcgattccagttcatccaacgcctcgccatcctcgccaacccatcggttgtacgtacgtacaagctcatcagtaaaacaatggccctgctcaaagccgcgcgcgtcgccgacgtgcccaccctggacgtggtggcccccggcctggtggtggaggcgggctcggcgtcggcgtcggcggcggtggcgatggtgaagaccggcgccgcggcggcgggcggcggcggccggttctcggtgatcggacaccgcggcaaggggatgaacgcgctggcgtcggcggacccgcggatgcaggaggtgcgcgagaacacggtccggtccttcaacgacgccgcgcgcttccccgtcgactacgtcgagttcgacgtccaggtcaccaaggatggatgcccaatcatcttccatgacaactttatcttcacccaagaagatggtaaaatttcacagaagcgtgtgactgatattattctggaagacttcctccagtatggcccccagaatgagcaggggaaggttgggaagcccctgcttcgcagactgaaggatggtaggatggtgaactggaatgtgcaatcagaggacgctctttgcacacttgaagaagcgttcgagaaggtcaatccaagattgggcttcaacgttgagctgaaatttgatgacagccttgaataccaggaggaagagctcactcgcatcctccaggccatcctcaaggtgatttctcagcacgccaaggataggcctatacttttctctagttttcagcccgatgctgcacagctcatgcgtaaattgcaaggcacataccctgtctacttcttgacaaacggagggacagagctatacaccgacgtgagaaggaactcgctggaggaggccgtcaagctatgccttgccagtggcatgcaaggaatagtttcagaagcccgcgggatattcaggcaccctgctgccgtaccaaagatcaaagaggctaacctctccctgctaacctatgggacattgaataatgtgccggaggcagtgtacatgcagcacctcatgggagtgaatggtgtgatcgtcgacctggtgccggagatcaccgacgcagtctctgagctcattgccctgcccgagcctgacctggaagtggacaacttgagcaaccaggcagctagaggagccacgacaccgaatttctcgcagcgcgagatctcgttcctgctgaggcttattcctgagcttgtccaataatgcctagacttccaggtgtctatcatggatgaatcatctaatgtattactgatctagtgatccgcatgtctgtcctgaagcttgtcctggtcccagttttacttttgctgacatgattggtgatttgataatgctgtaccgacaacagggggtgttgtgacttgtgaggcctggccacaatattctgatgacaagtgtttagaccgaacaaaagagtcttgagtgcaattaactgtttgagttaaaccaaaccatggtgtgttgggaattgtacgagcagggtgtttggttcgagaaatgaattgttatatcatcttt

SEQ ID NO: 2853 - DNA, 1639 bp, Panicum virgatum
aatttcaattaggttcaacgccggcgctttccgccgcctcgccccggccaaatcctcctccggtcctctcaccccgccgatcgagcaggagaccaaccgcggccggcgcgatacgcacaatggcccagctcaaggccgcgcgcgtcgccgacgtgcccaccctggacgtggtggcccccggcctggtggtcgccggggcggacgcggcctccgcggcgcgcgcgccgggcgggcggttctcggtggtcgggcaccgcgggaaggggatgaacgcgctggcgtcggcggaccggcggctgcaggaggtccgtgagaacaccgtccgctccttcaacgacgccgcgcgcttccccgtcgactacgtcgagttcgacgtccaggtcaccaaggatgggtgcccaatcatcttccatgacaacttcatctacaccgaagaagatggcataatttcacagaagcgtgtcactgatcttcaattggaagacttcgtccagtatggaccgcaaaatgagcaggggaagatcgggaagcccctccttcgcaaaatgaaggacggcagaatgctgaactggaatgtgcagtcagaggatgctctttgcacgcttcaagaagcattcgagaaggtgaacccgagattgggcttcaacgttgagctcaaattcgatgactatcttgaatacgaggaggaggagctcactcgcatcctccaggccatcttgaaggtgatctatgagtacgccaaggacaggcctatactcttctctagcttccagcctgatgctgcgcagctcatgcggaaactgcagagcaaatactctgtatacttcttgacaaacggagggacagagatttacactgacgtgaggaggaactcgttggaggaggccatcaagctatgccttggcagcggcctgcaagggatagtttccgaggcccgtgggatattcaggcaccctgctgccataccaaagatcaaagaggccaacctctccctgctgacctacggaacattgaataacgtgccggaggccgtgtacatgcagcacctgatgggggtgaatggggtgatcgtcgacctggtgccggagatcaccgaggctgtctccgagctcatcgccctgccagagcctgaccctgaagtcgagaacttgagcaacaaccaggctgctaaaggcgctgcaacaccgaatttctcgcaacgcgagatctcgttcctgctgaggctcatacctgagcttgtccaataatgcctcgccttccagatgtctatcatgaatgaatgatctgatgtattactgatttagcgacccgcatacaagaaaaaaaaaagcccttgcgcagggttatatgtttatgtaggttgatgataagtctatcctgtccttaagcttgtcctgttttaattttgctgggaggattggggatttgatcaatgctgtagtaggcagggcaagtggtggagtgaggtctgacagaaacaagctgacaagtgtttggacccctgaaaggagtcttgagtgtagtatctgtaacgcaataccgagctgtttgagttaaatcataatgtattgatgagagttgttatgagcagtgtatttttaagatggatggagctggcctgccatagtattgacaggtt

SEQ ID NO: 2854 - DNA, 1558 bp, Brachypodium distachyon
gttgcaactcgtcaatccaccccggcctcgcgctttgccctgcccaatttccccacgcccgacgtcctcggcacgtgcctctagcaaaccaattcttcgttcgattcctcctatagcagatcggtcggtccaccaatggctctgctcaaggccgcccgcgtcgccgaggtgcccaccctcgacgtcgtcgtcccggacctcgccgccgcctccgcacgcattctcgaggtggacgcggcggtgaagaagcgcgcgggcgggcggttcgcggtgatcgggcaccgcggcaaggggatgaacgcgctggcgtcgcccgaccggcggctgcaggaggtgaaggagaactccgtcaggtccttcaacgaggcggcgcgcttccccgtcgactacgtcgagtttgacgtccaggtgaccaaggacgggtgtccaatcatcttccatgacaacttcatctttactgaagaacatggtaaaatttcagataagcgtgtcacagatcttcagttagaagacttcctcatgtatggcccacaaaataggcaggggaagaatgggaaacctttgctgcggaaaatgaaggatggtagaatgttgaattggaatgtgcaatcagatgatcctctttgcacgcttcaagaagcatttgctaaggtcaatccaagattgggcttcaatgttgagctgaaatttgatgactatcttgcataccaggaggaagagctctctcgcatcctccaggccatcctgaaggtggtgtttgagtatgccaaggataggcctattattttctccagcttccaacccgatgctgcacaactcatgcgaaaattgcaaagcacataccctgtttatttcttgacaaatggaggaacagagatatacaccgacgtgaggaggaattcgctggaagaggcggtcaagctatgcctcaccagcggcatgcaaggtattgtgtccgaggcccgagcaatattcaggtttccagcggccataccgaagatcaaggaggctgacctctccctgctgacttacggaacattgaataatgtgccagaggcagtgtacatgcagcacctgatgggggtgaacggggtcatcgtcgacctcgtgcaggagatcaccgaggccgtcactgatctcatcgcggtcccggagcctgatccggaagccaaggactcgagcagccaggtgacaagagatgccgcgtctacgcccaacttcactcagcgcgagatctcgttcctgctgaggctgatccctgagcttgtacaatagcgcaatgtccattgatggctttggagtagcatacaggaagaacccattggggagggcagtacaagtttatgtgaagtcctaaggcgaggtcctcttttgtttgtcttgggagaactggtgatggatatgttatatgtgtacatgtcgtagcgaggggaggggtccaattgaaactaccccagaaggaggatgattgttgtaccttcaacgacgtgtctaactgaaattacaaatctattgttgaatttggtatgggcagttctgcagtacaatattctttggt

SEQ ID NO: 2855 - DNA, 1654 bp, Oryza sativa
tcgcgtcgcgtcgcgtcacgtctcgttgttgcattgcattgcgcccacgatcctcctatacgcgcgcagctaggacatcctccgaatataatggcccagctcaaggccgcgcgcgtcgccgacgtccccatggcgctcgacgtcctcgccgccggcgcccccgccacctccgccatcctcgaggtggacgcggcgggtgctcggagcgccgcggcgggcggcggcggcggcggcggggggcagaggttcgcggtgatcgggcaccgcgggaaggggatgaacgcgctggcgtcgcccgaccggcggatgcaggaggtgaaggagaactcgctcaggtcgttcaacgaggccgcccgattccccgtcgactacgtcgagttcgacgtccaggttaccaaggatgggtgcccagtcatcttccatgataacttcatctttactaaagaagatggtaaaattttagataagcgtgtcacagaccttcagttggaagacttcctgctatatggcccacaaaatgagcagggaaagggtggaaaacccttgctacggaaactgaaagatggtcggatagtgaattggaatgtgcagtcagatgaccctctttgcacacttcaagaagctttcgagaaggtcaatcctagattgggcttcaatattgagctcaaatttgatgacaatcttgaataccaggaggaagagctcacttgtatcctccaggccatcctgaaggttgtttttgagtatgccaaggatcggcctattattttctctagcttccagcctgacgctgcacaggttatgcgaaaattgcaaagcacataccctgtttactttttgactaatggaggcacagaaatctacgctgacgttaggaggaactcattggaagaggccatcaagctatgcctcgccagcggcatgcaaggaatcgtgtcggaggcacgaggaattttcaggcaccccgctgctgtaccaaagatcaaagaggctaacctctccctactgacttatggaacactgaacaacgtaccggaggcggtgtacatgcaacatctgatgggggtgaacggtgtgatcgtcgacctagtgcaggagatcaccgaggccgtctctgagctcatcaccgtcccggagcctgacctgaacgccgataatttgagcaatggggcagcaaaagacgccgcaacgccacatttctcgcagtgtgaaatctcattcttgctgaggctcatccctgagcttgtgcaataatcgatccagttgccttgctggtctgcagactttagtgactgatctgtatacaggaagaagaggagagaccccttgtggagggttacaagtttacaaaacttttaaataggttgatgtactagagctaagccctggtcctgttttttaatttgccctggggacgtttggattcatgatggatcatggatgatgcatcctgtagcaaggagttgaaacagttgttgttactgttgtatctgtaagactgtaacgacgacctatttgggtggagttgaattgcaatgcggaatttggcaagggcagctgtaaaatgttgagctttgccaagataaattgttgcgaggattcaaatggatttgtggcagcaatttaaatgatcacatattccatctgtttttcc

SEQ ID NO: 2856 - DNA, 1370 bp, Panicum virgatum
gcggcgcgcgcgctgggcgggcggttctcggtggtcgggcaccgcgggaaggggatgaacgcgctggcgtcgccggaccggcgcctgcaggaggtccgcgagaacaccgtccgctccttcaacgccgccgcgcgcttccccgtcgactacgtcgagttcgacgtccaggtcaccaaggatgggtgcccaatcatcttccatgacaacttcatctacaccgaagaagatggtaaaatttcacagaagcgtgtcactgatcttcagctggaagacttcgtccagtatggacagcaaaatgagcaggggaagatcgggaagcccctggttcgcaaaatgaaggatggcagaatgcttaactggaatgtgcagtcagaggatgctctttgcacgcttcaagaagcattcgagaaggtcaacccgagattgggcttcaacgttgagctgaaattcgatgacgatcttgaatacaaggaggaggagctcactcgcatcctccaggccatcctgaaggtgatctttgagtacgccaaggataggcctatacttttctctagcttccagcctgatgctgcgcagctcatgcggaaattgcagagcaaataccctgtatacttcttgacaaacggagggacagagatttacactgacgtgaggaggaactcgttggaagaggccatcaagctatgccttggcagcggcctgcaagggatagtttccgaggcccgtgggatattcaggcaccctgctgccataccaaagatcaaagagactaatctctccctgctgacctacggaacattgaataacgtgccggaggcggtgtacatgcagcacctgatgggggtgaatggggtgatcgtggacctggtgccggagatcaccgaggctgtctccgagctcatcgccttgccagagcctgaccctgaagttgagaacttgaacaacaaccgggctgctaaaggtgctgcaacaccgaatttctcgcaacgcgagatctcgttcctgttgaggctcatacctgagcttgtccaataatgcctcgccttccagatgtctatcatgaatgatctgatgtattactgatttagtgacccgcatacaaggaaaaaaaagcccttgcgcagggctatttgtttatgtaggttgatgatacgtctatcctgttcttaagcttgtcctggtccagttttatttttgctgggagggttagggatttgatcaatgttgtaggcagggcaagtggtggagtgaggtctgacagaaacaagcgaaagtgtttggacccctgaaaggagtcttgagtgtaatttctgtaacacaatactgagctgtttgagttaaatcataatgtattgctgaaagttgttatg

SEQ ID NO: 2857 - DNA, 1929 bp, Sorghum bicolor
ctttacttcacacacctgtaacgccgcaccaggcagcggcacgccgcgttacgcgttacacttcccagctagcactggcaccgcactactgtactacgctacagaaacctccattgccagccagccgcgcttgccactgcccactgccgcgtataagttcctttcttccttggccgcttctgcgctcgcctcccttctccagttctcctccacaccccctctctcccttctagatccactcctccccgtgctcacggctcatctgcgagcagattgagcggggagccgggaggggcaggccgaggagcggcgagggggagctagattgagccatggcctcctccacttgcgctcttgccctggttcttgcgctgtcggtcggtgcaagcgtggcgcgtggctccgagccctggtggaacgagacgcaggtgtacaccaccaccgccaactccggtggcagcaacggcgtcttcgtcggcctcaccctcatccagtcggcggcggccaagggagcggtgtgcttggatggaagcttaccaggttaccacctgcacagagggtttggatcaggagcgaacagttggcttgtcaatctcgagggtggaggctggtgcaatgatgtcagcagctgtgtgttccgcaagggtagtcgtcgtggatcatcaaatcacatggagcggcaactccagtttacagggataatgagtaacagacctgatgagaatcctgatttctacaactggaatagagtgaaggtccggtactgtgacggtggatccttcactggtgatggctctgatgcggctgcaggcctttatttccgaggtcagcgtatttggcaggccgctatggatgacctaatggcccaaggaatgcgttatgctaatcaggcccttctttctggatgctctgccggtggtgtttctaccatacttcactgtgatgaattccgtggattgtttccatcaaataccagagtcaaatgcctggctgatgctggaatgtttcttgacactgttgatgtttctggccgtcgggaaatgagatcttttttcaatggcattgtgagattgcagggttctggaagaagcttgcctaggtcttgcaccgcacgcatggacaaaacctcgtgctttttcccgcagaacgtgttaccaaacattcaaaccccaacttttgttttgaacactgcctatgacgtgtggcagcttcaacaaagtgtggcccccagaacagctgatccccaaggtctttggtcaaagtgtaggacgaaccacgctttctgtaatagcaaccagcttcagtttttgcaagggtttaggaaccaaatgcttgatgccgtgaagggtttttctgcgtcaaggcgaaatggtttgttcatcaactcatgttttgctcattgccagagcgagagacaggatacttggtatgcgaacaactcgccacgtcttggtaacaagaaaatcgctgacgctgtcggtgattggttctttgagaggggagacgccaagtacacagactgcccatacccttgcgatggcacttgccatcatcttgtgttcaggggagaccattaagactattcttcaacacgaacaattcagaaatttcagatggtaaaaggaacaaaccccaatgggtacagaaacaaggtatagatacagagaaggtgcaagtggttggcttgcccatgtatgttcatcagtcgatcatatgattgataggacagggacctcgcctgcgaatgcgcggaggtctctgcattagcttcacatatcatcatgatatcgatttttttcattggaaaaatgtatgattacctaccagaacatttggaccctattgcctatctgtataacattataacgtacattacatattcatttgtgtaacaggaagaagtatcttgcgcttgtcctgccgatggta

SEQ ID NO: 2858 - DNA, 1899 bp, Pennisetum glaucum
gagggaagaggggacgttcgggagaggacgacggaggggacgagatggggtgcgcgcagtcgcggatcgagaacgaggaggcggtggcgcgctgcaaggagcggcggcatctcctccctttggcctcttctgctgctcgccgctcttctccctcctccatccgagccctcccaccccagatccgtttcttccccggccgtgctcacgcctccccagagcagggagagcccgaggcagccaagcaggggggaaggaggaggcaaagaaccatggcttctcgtcttgttgccgtgattctcgccttcctcctgggagcaggagcgggcgcggcgcatggctccgagccgtggctgaacgagacgcaggtgtacggcaccgccgccagctccggcggcggcggcggcaacggcgtcttcgtcggcctcacactcatccagtcggcggccgccaagggagccgtgtgccttgatggaagcttaccaggttaccacctgcaccgggggtttggatccggagcaaacagttggcttgtcaacctggagggtggaggctggtgcaatgatgttagcagctgtgtgttccgcaagggcagtcgtcgtgggtcgtcaaatcacatggagagacagctccagtttactgggataatgagtaacagacctgaagagaatcctgatttctacaactggaacagagtgaaggtccggtactgtgatggcggatccttcactggtgatggttctaatgcggctgcaggcctgtatttccgaggtcagcgcatttggcaggctgctatggatgacctgatggcacaaggaatgcgttacgctaatcaagcccttcttgctggatgctctgctggtggtgtttctaccatacttcactgcgatgaattccgtggactgtttccatcaaacaccagagtcaaatgtctggctgatgctggaatgtttcttgacaccgttgatgtttctggtcgtcgggaaatgagatccttcttcaatggcattgtgagattgcagggttctggaagaagtttgcctaggtcttgcacctcccgcatggacaaaacctcgtgctttttcccacagaacgtggtgccaaacattcagaccccaactttcattttgaacaccgcctatgatgtgtggcagcttcaacaaagtgtggcccccaaaactgctgacccccaaggtctatggtcaaaatgtaggacaaaccatgccttttgtaatagcaaccaactgcagtttttacaaggttttaggaatgaaatgctcgcctctgtaaggggtttctccgcatcaacgcaaaatggtgtgttcatcaactcatgttttgctcattgtcagagcgagaggcaggatacatggtacgcaagcaactcgccacgtcttggtaacaagagaattgctgaagctgtcggggactggtacttccagaggggagacgccaagtatacagactgcgcatacccttgcgacaacacttgccacaacctcgtgttcaggggagaccattaaggttaactattctttgccactcatgattcagatggtgaaaggaacataccccaacgggtacagaatcaaaaaggttcagatacaaggtatagagatatagagagggtgcaagcgtcatggctcgccctttgttcgtcacttgagcagatgatatggttgatagggcaggggcctcgaccgcaaatgcgaggcggcctctgcgttagttccacataccatgacatcgattcttttcgttgcacacatcattcatcattgtgcctgaacatttgggccctattggtgtaactgtataatgttatacattcatgtatgagacgtgataatagtgtgaagggaattggtgcgatgaagaagtaccttaatttgtggtgtcaat

SEQ ID NO: 2859 - DNA, 1603 bp, Setaria italica
gccgtggctgaacgagacgcaggtgtacggcaccaccgccagctccggcggcagcaacggcgtcttcgttggcctcacactcatccagtcggcggccgccaagggagccgtgtgcttggatggaagcttaccgggttaccacctgcaccgagggtttggatcaggagcaaacagttggcttgtcaacctggagggtggaggctggtgcaatgatgttagcagctgtgtgttccgcaagggcagtcgtcgtgggtcatcaaatcacatggagaggcagctccagtttactgggataatgagtaacagacctgaagagaatcctgatttctacaactggaacagagtgaaggtccggtactgtgatggcggatccttcactggtgatggttctaatgcggctgcaggcctttatttccgaggtcagcgcatttggcaggctgctatggatgacctgatggcacaaggaatgcgttatgctaatcaggcccttcttgctggatgctctgctggtggtgtttctaccatacttcactgtgatgaattccgtggattgtttccatcaaacaccagagtcaaatgcctggctgatgctggaatgtttcttgacaccattgatgtttctggtcatcgggaaatgagatccttcttcaatggcattgtgagattgcagggttctggaagaagcttgcctaggtcttgcacctctcgcatggacaaaacctcgtgctttttcccgcagaacgtggtgccaaacattcagactccaacttttattttgaacaccgcctatgatgtgtggcagcttcaacaaagtgtggcccccaaagctgctgacccccaaggtctatggtcaaaatgtagaacgaaccacgctttttgtaatagcaaccaacttcagtttttacaaggtttcaggaatgaaatgctcgactctgtaaggggtttctctgcgtcaaggcaaaatggcgtgttcatcaactcatgttttgctcattgtcagagtgagaggcaggatacatggtacgcaagcaactcgccacgtcttggtaacaagagaattgctgaagctgtcggggactggtacttccagaggggagacgcgaagtacacagactgcgcatacccttgcgataacacttgccatcatctcgtgttcaggggagaccattaatattagttattctttgccacccatgattcagatggtgaaaggaacataccccaacgggtacagaatcaaaagttcagaaacaaggtatagatatagagagggtgcaagcgtcatggcttgcccttgttcatcacgatgatatgattgatagggcaggggcctcgcccgcaaatgcgaggaggcctctgcgttagctccacataccatgatatcgattcttttcgttgcacacatcattcatcatgtgcctgaacatttggccctattggtgtactgtataatgttatacattcatgtatgaaacgtgataatagtgtgaagagaatttgtgcggtgaagtaccttaatttgtggtgccaattgtacttggtatccttgtgatatgtgtcatggtggttgttccggcaatgattctggtttatgagaaaaaaa

SEQ ID NO: 2860 - DNA, 1848 bp, Brachypodium distachyon
gtaacaccacgtttacactaagcaccaagccaagctacgctacagaatctccggaagcagcagctgcttttcttttgtcagccattgccggccagctgtgcttgcacgcacttgggggctgctcactcgcggtataagttcctttcttcttttctcactcccgtgatcccttcttcctccccctgtccagatccatccctctccctggactcactcgcctagctctcccctgtgaggagagagagggggagggtaacggaggccgggcagagagccatgggttcttgggttctccttgccttggttctccggctcttcttggtgggagcagcgcgtggctccgagcagtggtcgaacgagacgcaggtctacgccaccaatggcaactccggcagcaacggcgtcttcgtcgggcttaccctcatccagtcggccgccgccaagggagctgtgtgcctggatggaagcttaccgggttaccacctacaccgggggttcggatcagggtcaaagaattggcttgtcaatctggagggcggaggctggtgcaacgatgttaagagctgtgtgttccgcaagagcagtcggcgtgggtcatcaaatcacatggaaaagcaactccagtttacagggataatgagtaacagacctgaagaaaatcctgatttctacaactggaatagagtgaaggttcgttattgtgatggtggatctttcaccggtgacggggctgatgcggcttcaggcctttatttccgaggtcagcgtatttggcaggctgctatggatgatctgatgtcccaaggaatgcgttctgctagtcaggcccttctttctggatgctctgctgggggtgcttctaccatacttcactgtgatgaattccgcggattgtttccgtcgaatactagagtcaagtgccttgctgatgctggaatgttcctcgacactgttgatgttgccggtcgtcgtgagatgagagagttcttcaacggcattgtcagattgcagggttctggaagaagcttgcctaggtcttgtacctcccgcatggacaaaacctcgtgctttttcccgcagaacgtgttaccaaacattcaaactccaacgtttattttaaacactgcttatgacgtgtggcagcttcaacaaagtgtagctcccaaaactgctgatcctcaaggtctatggcaaagatgcaagcagaatcatgccttttgtagtggcaatcaacttcagtttttaaatggctttaggaatgaaatgcttgatgccgtgaagggtttctccgggtcaaggcaaaatggtgtattcatcaactcatgcttcgctcattgccagagcgagagacaagatacatggtactcaaataactctcctcgtctcggtaacaggagaattgctgaagcagtcggtgattggttcttcgagaggggtgatgccaagtacaccgactgcacgtacccttgtgatggcacgtgccatcaccttgtgttcagggggaggggactgtaagattatcaccattatttgacaccagcagttgaggtgtcaaacgaccccagtggtaactactacaaattaaagaaggacaaggtatagatagaagaagaggcgcaagttcctccacttgcccggtttctgatatgacagggcagagggcctcgcgcccgaaggcggtgcgaggcctcagagttattttagtttcacatatcgattcattcaattgccgttgttaccttgatgtatctgaatatttggtccacattggtgtataacctttacataattcatgtattggaaatgattgtatcaataatgtgctcaagagaaattcaatctttagac

SEQ ID NO: 2861 - DNA, 2176 bp, Oryza sativa
gcgaagaagcgcaagcgaggaagtgaccagcctgcctacggccgctgctcagctcagctcccagctgtcacttgctccaatggagacgagtacgcccaccaaaaaagcagtaattgcacttcacagttttccccaccctttcgccgccctcccctggattccgtagttccgtcatcaccaccaccacgttccgggcgactccttccattgcttcttttcttcttcttcttcttctccatttctacagcctcacaagatagggagatgctttgcttcacaactgtaattgcactacacgttttttcactggaagcactagtgcagctgcactagtagcagtgcacaccgctccacagaatctcccagaagcagccgcttttgttttgtcagccattgccagcatccagctgcacttggctccgcgtataacttcctttcttgcttggccgcttctgctcctccattcttccctcctcctcttccccttcttccagatccattcctcaggaagaaggcagaggctgggagtgggaggaaggcccaagaaccagcaaagaaagaagagaaccatcaaccatgggttgttcttgggctcttgctgctctggttcttggcttcttggtggtggcagtccatggctctgagccgtggctgaatcagacgcaggtctactccaccaatgccaactctggtagcaatggcgtcttcgtcgggattacgctcatccagtcggcggccgccaagggagccgtatgcttggatgggagcttaccagggtatcacctacaccgagggtttggatcaggggcaaacagttggcttgtcaatttggagggtggaggctggtgcaacgatgttaaaagctgcgtgtttcgcaagagcagtcggcgtggttcatcaaatcacatggagagccaactccagtttactgggataatgagtaacaggcctgaagaaaatcctgatttctacaactggaacagagtgaaggttcgatattgtgatggcggatccttcactggtgatggggctgatgcgtctgcaggcctttatttccgaggtcagcgtatttggcaggctgctatggatgatctgatggcccaaggaatgagatatgctaaccaggcacttctttctggatgctctgctggtggtgtttcaaccatacttcactgtgacgagttccgtggattgtttagcggcagtacaaacgtgaagtgccttgctgatgctggaatgtttctggactttgttgatgtttctgggcaacgagaaatgagggacttcttcaatggtattgtgagattgcagggttccggaagaagcctgcctaggtcttgtacctcccgcatggataaaacttcgtgctttttcccccagaatgtggtgccaaacattcaaactccaacttttattttgaacactgcttatgatgtgtggcagcttcaacaaagtgtggcccccaaaagggctgatccgcaaggtctatggcgaggatgtaggatgaatcatgcctcctgtaatagcaaccaactgcaatttttacaaggtttcaggaatcaaatgctcgatgcggtgaggggtttctccggcgcaaggcagaacggtctttttatcaactcctgtttcgcacattgccaaagtgagagacaggacacatggtacgcaggggattctcctcgtctcggtaacaagagaattgctgaagcagtaggcgactggtttttcgatagggcagacgcgaagtacacagactgtgcatacccttgtgatggtacctgccatcatcttacattcaggggagattactaagattcattcttagaccaccaccaaatgtaggtggcaaaaagaggggaaaaaagggacacccaatgggaatatatacagaataagaggaaggtatagatagaggatgcaaagctagtgacttgcatggacatgttcatcattactcagatatgatcttagggcagggcctggtgtgcttgctaatgtggcatgatcaggcctctgcatttagctccacacaccgattgattcttttccattgcctgaattccctggatgatgtatctctgaacatttggaccccaatggtgtatctgtatcataaatttacatatccatgtactaaacgtgataatatgaatgaaataagtaatgtgcctgcaag

SEQ ID NO: 2862 - DNA, 1788 bp, Triticum aestivum
  misc_feature (856)..(856): n is a, c, g, or t
  misc_feature (859)..(859): n is a, c, g, or t
  misc_feature (887)..(887): n is a, c, g, or t
  misc_feature (889)..(889): n is a, c, g, or t
gagctgcgcttgcacttgcgctcggccggcctccgctccgcgtataagttccttccttgctttggccacttccgccacgatcccttctccctcttccagatccattcctctcccagccccaggcctcgctcgcctcccccgttgggacggagagagctcggaagggcagggagccatgggttcctgggtccttcttgctgtggttctcgggtccttggtgggagctgcgcgcggctccgagccgtggtcgaacggcacgcaggtctactccaccaatgccaactccggcagcggcagcaacggcgccttcgtcgccctcactctcatccagtccgcggccgccaagggagccgtatgcttggatggaagtttaccgggttaccacctacaccggggatctggatcagggtcaaacaattggcttgtcaatctggagggtggaggatggtgcaatgatgttaaaagctgtgtgttccgcaagggcagtcggcgtgggtcatcgaaccacatggagaggcaactccagtttacaggcataatgagtaacaggcctgaagaaaatcctgatttctacaactggaacagagtgaaggttcggtattgtgatggtggatccttcaccggtgatggggctgacgcggcttcaggcctttatttccgaggtcagcgtatttggcaggctgctatcgatgacttgatggcccaaggaatgcgttctgctagtcaggcccttctttcgggatgctctgctgggggtgcttctgccatacttcactgtgatgagttccgtggaatgtttccatcaaataccagagtcaagtgcctcgctgatgctggaatgttccttgactctgtnganattgcgggtcgtcgagaaatgagagacntnttcaatggcattgtgagattgcagggttctggaagaagcttgcctcggtcttgtacctctcgcatggataaaacctcatgctttttcccgcagaacgtgttgccaaatattcaaactccgacttttatcttgaacactgcttacgacgtgtggcagcttcaagagagtttggctcccagaacggctgatccccggggtctatggcaaagttgcaagcagaattacgcctcttgcaatagcaatcagcttcagtttttaaatggcttcaggaatgaaatgcttaacgctgtgaagggtttctctgggtcagggcagaatggggtgtttatcaactcttgtttcgcccactgccagagcgagagacaggatacatggtactcaagcaagtctcctcgtcttggcaacaagagaatcgcagaagcggtcggtgactggttcttcgagaggggcaacgccaagtacaccgactgcgcgtacccttgtgacggcacgtgccatcaccttgtgttcaaagggaggcatctctaatacgatcatatcctttgataccagcagctgaagtgctgaaaacccagcgagtgggtacaaccgaaaaaaggaaggtatagatagaagaagatgggtgcaagttggtggcttgcccggcgtccatcgcctcagatatgatagggcagggcctcacatgcaaacgcgatgaggtcctctgcgttattttagtttcatatatcgtcgattctttccattgccaattgctactccctcgatgtatctgaatatttgaaccacactggtgtataaccttacatgttcatgtattgaatgtggtaatatgaaattatgaataatgtgcttagttcagagacatattggctgctcgtgaactgctgaaaactgcaacc

SEQ ID NO: 2863 - DNA, 1788 bp, Triticum aestivum
gagctgcgcttgcacttgcgctcggccggcctccgctccgcgtataagttccttccttgctttggccacttccgccacgatcccttctccctcttccagatccattcctctcccagccccaggcctcgctcgcctcccccgttgggacggagagagctcggaagggcagggagccatgggttcctgggtccttcttgctgtggttctcgggtccttggtgggagctgcgcgcggctccgagccgtggtcgaacggcacgcaggtctactccaccaatgccaactccggcagcggcagcaacggcgccttcgtcgccctcactctcatccagtccgcggccgccaagggagccgtatgcttggatggaagtttaccgggttaccacctacaccggggatctggatcagggtcaaacaattggcttgtcaatctggagggtggaggatggtgcaatgatgttaaaagctgtgtgttccgcaagggcagtcggcgtgggtcatcgaaccacatggagaggcaactccagtttacaggcataatgagtaacaggcctgaagaaaatcctgatttctacaactggaacagagtgaaggttcggtattgtgatggtggatccttcaccggtgatggggctgacgcggcttcaggcctttatttccgaggtcagcgtatttggcaggctgctatcgatgacttgatggcccaaggaatgcgttctgctagtcaggcccttctttcgggatgctctgctgggggtgcttctgccatacttcactgtgatgagttccgtggaatgtttccatcaaataccagagtcaagtgcctcgctgatgctggaatgttccttgactctgttgacattgcgggtcgtcgagaaatgagagacttgttcaatggcattgtgagattgcagggttctggaagaagcttgcctcggtcttgtacctctcgcatggataaaacctcatgctttttcccgcagaacgtgttgccaaatattcaaactccgacttttatcttgaacactgcttacgacgtgtggcagcttcaagagagtttggctcccagaacggctgatccccggggtctatggcaaagttgcaagcagaattacgcctcttgcaatagcaatcagcttcagtttttaaatggcttcaggaatgaaatgcttaacgctgtgaagggtttctctgggtcagggcagaatggggtgtttatcaactcttgtttcgcccactgccagagcgagagacaggatacatggtactcaagcaagtctcctcgtcttggcaacaagagaatcgcagaagcggtcggtgactggttcttcgagaggggcaacgccaagtacaccgactgcgcgtacccttgtgacggcacgtgccatcaccttgtgttcaaagggaggcatctctaatacgatcatatcctttgataccagcagctgaagtgctgaaaacccagcgagtgggtacaaccgaaaaaaggaaggtatagatagaagaagatgggtgcaagttggtggcttgcccggcgtccatcgcctcagatatgatagggcagggcctcacatgcaaacgcgatgaggtcctctgcgttattttagtttcatatatcgtcgattctttccattgccaattgctactccctcgatgtatctgaatatttgaaccacactggtgtataaccttacatgttcatgtattgaatgtggtaatatgaaattatgaataatgtgcttagttcagagacatattggctgctcgtgaactgctgaaaactgcaacc

SEQ ID NO: 2864 - DNA, 1373 bp, Panicum virgatum
aagggagccgtgtgcttggatggaagcttaccgggttaccacctgcaccgaggatttggatcaggagcaaacagttggcttgtcaacctggagggtggaggctggtgcaatgatgttagcagctgtgtgctccgcaagggcaatcgccgtgggtcgtcaaatcatatggagaggcagctccagtttactgggataatgagtaacagacctgaagagaatcctgatttctacaactggaatagagtgaaggtccggtactgtgatggtggatccttcactggcgacggttctaattcggctgcaggcctttatttccgaggtcagcgcatttggcaggctgctatggatgacctgatggcccaaggaatgcgttatgctaatcaggctcttcttgctggatgctctgctggtggtgtttctaccatacttcactgtgatgaatttcgtggattgtttccatcaaataccaaagtcaaatgccttgctgatgctggaatgtttcttgacactgttgatgtttctggtcgtcgggaaatgagatccttcttcaatggcattgtgagattgcagggttctggaagaagtttgcctaggtcttgcacctcccgcatggacaaaacctcgtgctttttcccgcagaacgtagtgccaaacattcagaccccaactttcattttgaacactgcctatgatgtgtggcagcttcaacaaagcgtggcccccaaaaccgctgacccccaaggtctatggtcaaaatgtaggacgaaccatgcctactgtaatagcaaccaacttcagtttttacaaggtttcaggaaccaaatgcttgattctgtaaggggtttctctgcgtcaaggcaaaatggcatgttcatcaactcatgctttgcgcactgtcagagcgagaggcaggatacatggtacgcaaacaactcaccacgtctcggtaacaagagaattgctgaagctgtcggtgactggttcttcgagaggggtgtcgccaagtacacagactgcgcatacccttgcgataacacttgccatcacctcgtgttcaggggagaccattaagactaattattcttcaccgcccatgattcggatggtgaaaggaacattaccccccaacgggtatagaatcaaaagttgaaaaaaggatacagatatagagagggtgcaggcgtcccgaaaaatgcgaggtccctgcgttagcttcacaaccatgatatcgattctttttcattgaacacaccattcatcatgtgcctgaacatttaattagaccctatcattgtactgtatgatgctatatattcatgtaagaaacgtgattatagtatgaaggaaaattgtgcgtggagtttagttaccct

SEQ ID NO: 2865 - DNA, 814 bp, Triticum aestivum
gttttgagtctttgatcagttgagcagcttaagaaaaataccagaatggactccggcgagcagggtgagacctccaaggcccccctcagcaggggggtcagtaaaggagtgtccatgctggacctcatacttcgcgtcattgcggtcatcggcacccttgcgagcgccattgccatggggactaccaatgagacgcttcctctgttcacgccgttcatccagttcaaagcgcgatacagcgatctcccggctctcacgttcttcgtggtggcaaattctattgtgagcgcctatctcatcctttcgctcccactgtcaattgtgcacataattaggagcggggctaaatatagcaggctggtcttgatcattttcgacgcggcaatgctagctctggtgaccgcagcgtcatctgcagcaacagctattgtctacttagcacacaagggtaatgtcagggcaaactggcttgctatatgccagcagttggattctttctgcgagcgtacctctggctccctggttggctcgtttggagccatggttctgctgatactgctcatcttactctcagctatggccctagccaggcgctagaccgaattatccatcatttgctccctgaagtataagtgtgatatcccagcaaaaaaaaatatatgtgtgatatgggtggttcttgtacttgcttccttcatgtgggcctattctcttgctaccatcttctatattgtgcaccgccttgacggtgttgcttcgtttgtatcggcctttgtacttcttatacagtttttacagaaaataaatgtcatgg

SEQ ID NO: 2866 - DNA, 838 bp, Triticum aestivum
gttttgagtctttgatcagttgagcagcttaagaaaaataccagaatggactccggcgagcagggtgagacctccaaggcccccctcagcaggggggtcagtaaaggagtgtccatgctggacctcatacttcgcgtcattgcggtcatcggcacccttgcgagcgccattgccatggggactaccaatgagacgcttcctctgttcacgccgttcatccagttcaaagcgcgatacagcgatctcccggctctcacgttcttcgtggtggcaaattctattgtgagcgcctatctcatcctttcgctcccactgtcaattgtgcacataattaggagcggggctaaatatagcaggctggtcttgatcattttcgacgcggcaatgctagctctggtgaccgcagcgtcatctgcagcaacagctattgtctacttagcacacaagggtaatgtcagggcaaactggcttgctatatgccagcagttggattctttctgcgagcgtacctctggctccctggttggctcgtttggagccatggttctgctgatactgctcatcttactctcagctatggccctagccaggcgctagaccgaattatccatcatttgctccctgaagtataagtgtgatatcccagcaaaaaaaaatatatgtgtgatatgggtggttcttgtacttgcttccttcatgtgggcctattctcttgctaccatcttctatattgtgcaccgccttgacggtgttgcttcgtttgtatcggcctttgtacttcttatacagtttttacagaaaataaatgtcatgggattgagtactataaaaaaaaaaa

SEQ ID NO: 2867 - DNA, 770 bp, Triticum aestivum
cctcgtgccgcagttttgagtctttgatcagtccagcagcttaagaaaaataccagaatggactccggcgagcagggtgagacctccaaggcccccctgagcaggggggtcagtagaggagtgtccatactggacctcatacttcgcgtcattgcggtcatcagcaccctcgcgagcgccattgccatggggactaccaatgagacgcttcctctgttcacgccgttcatccagttcaaggcccgatacagcgatctcccggctctcacgttcttcgtggtggcaaattctgttgtgagcgcctatctcatcctttcgctcccagtgtcaattgcgcacataattaggagcggggctaaatatagcaggctggtcttgatcatttttgacgcggcaatgctagctctggtcaccgcagcgtcatctgcagcaacagctattgtctacttggcacacaagggcaatgtcagggcaaactggcttgctatttgccagcaattggattctttctgcgagcgtatctctggctccctggttggctcgtttggagccatggttttgctgatactgctcatcatactctcagccattgccctggccaggcgctagaccaaattgtccatcatttgctccctgaagtataagtgtgatatggtgtggttcttgtacttgcgtgcttaatgtaataatctgtgagcctatattgtgcaccgccttgatggtgtgttacttcttctgtatcggcttttgtacttcttatacggtgtaca

SEQ ID NO: 2868 - DNA, 829 bp, Triticum aestivum
cctcgtgccgcagttttgagtctttgatcagtccagcagcttaagaaaaataccagaatggactccggcgagcagggtgagacctccaaggcccccctgagcaggggggtcagtagaggagtgtccatactggacctcatacttcgcgtcattgcggtcatcagcaccctcgcgagcgccattgccatggggactaccaatgagacgcttcctctgttcacgccattcatccagttcaaggcccgatacagcgatctcccggctctcacgttcttcgtggtggcaaattctattgtgagcgcctatctcatcctttcgctcccagtgtcaattgcgcacataattaggagcggggctaaatatagcaggctggtcttgatcattttcgacgcggcaatgctagctctggtgaccgcagcgtcatctgcagcaacagctattgtctacttagcacacaagggcaatgtcagggcaaactggcttgctatatgccagcaattggattctttctgcgagcgtacctctggctccctggttggctcgtttggagccatggttctgctgatactgctcatcatactctcagccatggccctagccaggcgctagaccaaattatccatcatttgctccctgaagtataagtgtgatatcccagcacaaaaaaatatgtgtgagggtggttcttgtacttgcttccttcatgtaataatgtgtgggcctattctcttgctaccatcttctatattgtgcactgccttgacggtgttacttcttttgtatcggcctttgtacttatacagtttttacagaaatataaatgtcatgg

SEQ ID NO: 2869 - DNA, 3037 bp, Sorghum bicolor
cccttttccactccactctgttttctggaggcctctaaacccttcttctccccacgccctcacccgacgccgccgccgccgccgcttgccggggtgctatagccatgtcacccgcggcagcctctgcatcacccgacgaccgcatccgaaactacgaagacttcgtgcgggtgcacgcgtacctgctggccgcggccggcatcccgccgtcgctgcaccagaggctgtaccgcaagctcgcggacgaggtgttcgacggcggggaggtctttgccgtcgagccgtgcgaggacgggaggcagcggcgcctcgtgctctccgccgatgagtctctgcgaaaggagtccgatgtcttcctcgtcgaccacgcgtggtccttccgccttcctgatgcgctcaagcagttgcgggaagtgccaggactggctgaaaggatggcagcattgatgtgtgtggatttggaccgcaggatagaaactgaagaggcagatgagaaggatggtcacgagagtgggagcttggagcatgtattgcaggtagtcgagaaagagaaggctagagttcaggagaggggaagggattctgcggcatggctggaacttgaagaactcggaattgatgatgacatgctagtagccttggatctatctgcaaaatttccgaatctggtagctctgaacctatggggaaacaagctgcaggatctagagaaagttatgcaagaaatcaggaagtgtgcaaagctaaaggcactgtggttgaacgagaatcctgttcttggcaaaagtattgacaaagctattctagatggtctctctggattggaaatatacaattcacattttacgagtaaagctggagagtgggcattaggtttttgtgcagacattgttggagcagataatccctgttcttctgtggaaagcacactgttagggagtattgagattattgacctttctgatagatgcattcacaagctaccagaggtattatctcctagtaatttcccatctctgtcaaaattgaacatccgtggtaatcctctggatcaaatttctggcgatgatctcttaaagctatttggtggattcacaaagttacaagagttggaggtcgacattcctggccctctgggaaacagcgcaatctccattcttgagtctctccctaatttatctttgctaaatggtgtggattcctcaagtataatagagagtgggaagcatatagttgactctgcacttgaaccacggcttccagaatggtcacctgaagaaccccttgctgaaagagttattggtgcaatgtggttgtatcttatgacataccggcttgctgatgaggaaaagattgatgaaacacctgtttggtatgtcatggacgagttgggctcagccatgcgccacagtgattatgcaaacttcagaatagctccattcttgttcatgccagaagggaaactagacactgctataagttacacaattctgtggcccactcatgatgttcatactggagaagaatgtacccgtgatttcttgtttggtattggcgaggacaaacagcgttcggctaggcttacagcttggttccgcacacctgagaactactttattcaggaattcaggaggtaccaggaacaacttcaatcaaatagcatttgttcttcgacaaaaatagaagagacgccctctaccaaaagtatacgtccaagtgatggtcgtgcacttcgagtatatactgacatacctcatgtagaggagtttttaacgcggccagagtttgttctcacaactgatccaaaggaggctgacattatctgggtaagcatgcaagtggattcagaagtaaagaaagctgtagggctcacagaccaacaatacacaaatcaatttccttttgaagcttgccttgtcatgaagcaccatcttgcggagaccatccacaaggcttggggttcacctgaatggcttcaacctacatataacctagagacccatttgtctccacttattggtgattattttgtgaggaaacgagatggcatggacaatttatggatcatgaagccttggaacatggcgagaacaatcgataccacagttactggtgatttgtctgctattatcagacttatggagacaggccccaagatatgccaaaaatatattgaacgccctgcacttttccaaggaaggaagtttgatcttcggtacattgttttggtccgtagtatccgccctttggaaatatttctatctgatgttttctgggttaggttagcaaacaatcagtacactttggagaagactagcttttttgagtatgagacccatttcactgtgatgaattatattggaaggatgaaacatatgaatacaccagagtttgtcaaggagtttgagaaggagcaccaagttaaatggctggacatccatgaaagtatacggtctacgatacgttgtgtctttgagtcagccgcagctgttcatcctgagatgcagaacccattctccagggccatgtatggtgtagatgttatgcttgataacagattcgaaccaaagattctagaggtgacatactgtccggactgcgggagggcgtgcaaatatgacacgcaagctctggtagggagccagggtacaatcagaggccgtgattttttcaacgccgtgtttggctgcctctttcttgacgagcaaacaaatgtatcgcccttgtaagcatcgcccgagtggctgctgtaacatcagatctatcacaacatgacatgtataacctgcttgtctgttgccatatgagataggacttgggagctgttgctcgttttttttttggtcagcttattctcaaatctcaatgaatcgtactgtgcccaggcttgccgagggtatagcggggacttgtattcgtgatgctgtttgttaaatcgcgcttcagtcggagtgtgctacacctacagatacagattcattcttgaaggcaaggtagaccttacccctctgttactcatacaaatagtaactttaaa

SEQ ID NO: 2870 - DNA, 2925 bp, Brachypodium distachyon
gctcgcggtgaactatcgccatgtcacccgctgccgccgccgtcccatgcgacgatcgcatccgcagctacgatgacttcgcacgggtgcacgcgtacctgctcgccgcggccggcgtcccgccgtcactgcatcagcggctgtaccgcaaactcgccgacgaggtgttcgacggcggggagagctttgcggtggagccctgcgagggagggaggcaacgtcgcctcgtgctcgcctccgagacccctctagggagggagtcggacgtcttcctcgtcgaccacgcgtggtccttccgcctctccgatgcgctcaagcagttgcgggaagtaccgggattggccgagagaatgtcagcgctaatgtgcgtggatctggacaggagaactgagattgaagagtcagatgagcaggaccgtgaaatgagtgggggtttggagcatgtcttgcaggttgtgcagaaagaaagaacgagaacccaggagaagggtagtgattttgcagcatggctggagcttgaggaacttggaattgatgatgatatgctagtatcactggatctttcagcaaattttccgaatctggtagccctaaacctttggggaaacaagctgcaagatccagaaaaaataatgcaagaaatcagaaaatgtggaaggttaaaggcactttggttgaacgagaaccctatccttaaccagggtattgacaaagctgttcttgatggtctccctgaattggaaatctacaattcacattttacaaggaaagctagagagtgggctttaggtttctgtggaaatatggttggagcagataatccatgttcttctgtggaaagcatatcattggataatattgcgactcttgacctttctgataggtgtattcacaaactaccagaggttttctgccctagtaagctgtcatctctttcaaacttgaacatccgcggcaatcctttggaccaagtgcccggtgatgatctcttgaatttatttagtggttttacacagttacaggagttggaggttgacattcctggccctcttggaaacagtgcacttcccattcttgaggctcttccaaatctaactttgctaaatggtgttaatgcgttgagtatagcagagagcggtaagcatgtagttgattctgcacttcaaccacgtgttccagaatggtcacctgaagaatctcttgctgaaagagttattggtgcaatgtggctatatcttatgacataccggcttgctgatgaagaaaaggtcgatgaaacacctgtttggtatgtcatggatgagttgggctcagccatacgccatagtgatgatgcaaactttagaatcgctcctttcttgttcatgccagaagggaaactagcttctgctataagttacacaattctctggcctgtcggtgatgttcatactggagacgaatgtacccgagatttcttgttcggaattggcgaagacaaacaacggtcagctaggcttacagcttggttccacactccagagaactattttattcaggaattcagaaagtaccaggagcaacttcaatcaactggtatttgtccttcaacaaaagagaagccctcaactaaaagtttacgcccaagtgatggccgcgcacttcgagtatttactgatataccccaagtagatgagtttttaacacgcccagagttcgttctcacaactgaccctaaggacgctgacatcatctgggtgagtatgcaagtggattcagaattgaagagttctctagagcttacagaccaacaatacacaaatcaatttccttttgaagcttgcctagtcatgaagcatcacctggcagacactatccacaaggcatggggctcgcctgagtggcttcaacctacatataacctagagacccatttgtctcaacttattggagattattgtgtgaggaaacaagataatatggacaacttgtggatcatgaaaccttggaatatggccagaacaattgataccactgttactggtgatctatctgctatcatcagacttatggagacaggtcccaagatatgccaaaagtatattgagtgtcctgcacttttccaaggaaggaagtttgatattcggtacattgttttggtccgcagtatatgccctttggagatctttctttctgatgttttttgggttaggttagcaaacaatcaatacactctggagaaaactagccttttcgaatacgagacccatttcactgtgatgaattatactggaaggatgaaccatatgaatacgccggagtttgttaaggagtttgagaaggagcaccaagttaaatggttggacatccatgaaagcatatgtaatatgataaggcgcgtctttgagtcagcctcagcagttcatcctgagatgcaaaacacattctccagggccatctatggtgttgatgttatgcttgataatagattcaagccaaagattttagaggtgacatattgcccagactgcacgagggcatgcaaatatgacacgtcggctgtggttggaaaccagggtgccattagagggagtgatttcttcaacacagtatttggctgcctctttcttgatgacttgacgaatgtatcgccactgtaatcatcatcccagattcttttttggatgttgtaacacccatgttctcgcaccatgatatatacaagctgttgaacttacacccgtgacaggataaatggaccatgttcatcacgcgtctcctagagtacaacattgattgtaaactgtggtggtgtttgaactgtgacggtgaagatggaatttactttctgtgttcgcctgtgtgcttctgataccaacgttatgcttagaataccaatggagcatggaatatgcaatggtacttgtatgtgtttgaacaagcttt

SEQ ID NO: 2871 - DNA, 2905 bp, Oryza sativa
agggtgtgaggcggtttcaccagtcgctagctcaagcctctaaacccttcttctccccagctcaccccgttcgccgccgccgacgccgctcgccgggggctatcgccatgtcgccggccgccgcctcaccggatgatcgcatccggagctacgaggatttcgcgagggtgcacgcgtacctgctggccgcatccgggatcccgccgtcgctgcaccagcggctttaccgcaagctcgccgacgaggtgttcgacggcggggaggccttctcggtagagccctgcgagggagggaggcagcggaggctcgttctcgccgctgagtggactctagggagggagtccgatgtcttcctcgtcgaccacgcctggtccttccgcctctccgatgcgcttaagcagttgagggaagtaccaggactggctgaaagaatggcagcattgatgtgtgtggatctggacgagagaactgaacttgaagaagcagatgaacaggacaatgggaatggagggagtttggagagtgccttggaggtagttgagaaagaaaggactagaatccaggagaagggaagtgactttgcagcatggctggaacttgaggagcttggaattgatgatgacatgctaatagctttggatctatcttcaaaatttccgaatatggtagccctcaacctatggggaaacaagcttcaggatccagagaaaataatgaaaggaataggggaatgtagaaggctaaaggcactttggttgaatgagaaccctgcactgaaggaaggtgttgacaaagttattcttgacggtctacctgaattggaaatatacaattcacattttacgaggaaagctggagaatgggctttaggtttctgtggggatattattggagcagacaatccctgttcctcagcggaaagcataccattggagaatattgcgtctctcgatctctcagataggtgtatccacaaactaccagtggtgttctctcctagaaaactttcctccctgttgagcttgaacatccgtggtaatcctttggatcaaatgtccagtgacgatctcttgaagttaattagtggatttacccagttacaagagttggaggttgatattcctggctctcttggaaacagtgctatttccattcttgagtgtcttcctaatctatctttgctaaatggtatcaatgtggcaagtataatagagagtggtaagcatataattgattctgcacttaaaccacgtctgcctgaatggtcaccacaagaatcccttcctgaaagagttattggtgcaatgtggttatatcttatgacataccggcttgctgatgaagaaaagatcgatgaaacacctgtttggtatgtcatggatgagctgggttcagctatgcgccacagtgacgatgcaaacttcagaatagcacctttcctgttcatgcccgatggtaaactagcttctgccataagttacacaattttgtggcctgttcatgatgttcatactggagaagagtgcactcgtgatttcttgtttggtgttggcgaggacaaacaacgctcggctaggcttacagcctggttccacacaccagagaattattttatccaggaattcagaaagtacaaggaacaacttcaatcaagcagtatctgtccttcaagaaaagtaacaccggtgaccaaaagtatccgtccaagtgatggccatgcacttcgagtatttaccgacataccccaagtagaggagtttctaacacgtccagaatttgttctcacatctgatccaaaggaagctgacatcatttgggtaagcatgcaagtggattcggaattaaagaatgcactaggacttacagaccaacaatatacaaatcaatttcctttcgaagcttgcctggtcatgaaacatcacttggcagagactatccacaaggcatggggttcacctgaatggcttcaacctacgtataacctggagacacatttatctccactcattggagattactgtgtgagaaagagagatggtatggataacttatggattatgaagccttggaatatggcaagaacaattgacactactgttactggtgatttatctgctatcattagactcatggagacaggtcccaaaatatgccaaaaatatatcgaatgccctgcacttttccaaggaaggaagtttgatctgcggtatattgttttcgtccgcagtatatgccctttagagatatttctttctgatgtgttttgggttaggttagcaaacaatcagtacactctggagaaaacaagcttttttgaatatgaaacccatttcaccgtgatgaattatattggaaggatgaaccatatgaacacaccagagtttgtcaaggagtttgagaaggagcaccaagttaaatggctggagatccatggacgcatacgggatatgatacgatgtgtctttgagtcagccacagctgttcatcctgagatgcagaacccgttctctagggctatctatggggttgatgtcatgcttgataataaattcaatccgaagattttggaggtgacatattgtccggactgcacgagggcatgcaaatatgacactcaagctctcgtgggaagccagggtgtcatcaggggcactgaatttttcaatacagtgtttggctgcctctttctggacgagcttaaagatgtatcgccgctgtaatcaccacaacaaggttgctgtaacaccgaagttcaacacaatacacgcacatgtgagttgtgatcctgtcgttttatatgccatacatatcaaatttgctcagtacaattacaaagggggtgtgatgctgcctcctgcctgtaccatgcttcggatcagattgaaatgagcttgacgaatcctcc

SEQ ID NO: 2872 - DNA, 2503 bp, Panicum virgatum
gcctccgaggaaccgctggggaaggagtccgatgtcttcctcgtcgaccacgcgtggtccttccgcctccctgatgcgctcaagcagttgcgggaagtaccaggattggctgaaaggatggcagcattgatgtgtgtggatttggaccggaaggtcgaaactgaagagtcagaagatgagcaggacgatgagaagaatgtgagcttggaacatgtcttacaagtagtggagacagaaagggctagagtacaggaaaggggaactgattctgcagcatggctggaacttgaggaacttggaattgatgatgatatgctagtaaccttggatctatctgcgaaatttccgaatcttgtagctctcaacctgtggggaaacaggctgcaggatacagagaaagtcatacaagaaatcaggaagtgtccaaagctaaaggcactttggttgaacgacaatcctgttcttggcaaaggtattgacaaagcagttctagatagtctctctggattggaaatatacaattcacgttttacgagtaaagctggagagtgggcattgagtttctgtgctgacattgttggagcagataatccctgttcctttgtggaaagcacattgttggatagtattgccactatcgatctttctgataggtgcattcacaagttaccagaggctctctctcctagtaaactgccatctctgtcaaaattgaacatccgtggtaatcctctggatcaaatttctggtgacgatctccttaagttacttagtggatttactcagttacaagagttggaggttgatattcctggtcctctgggaaacagtgcaatttccattcttgagtctcttcctaatttatcgtttctaaatggtgtgaattcttcaagtataatagagagtgggaagcatatagttgactctgcacttcaaccgcggcttccagaatggtcaccagaagaatccctcgctgaaagagttattggtgcaatgtggttgtatcttatgacataccggcttgctgatgaagaaaagattgatgaaacacctgtctggtacgtcatggatgagttgggctcagccatgcgccacagtgatattccaaacttcagaatagctccattcttgttcatgccagaagggaaactagcctctgctataagttacacagttctgtggcccactcatgatgttcatactggagaagagtgtacccgggatttcttgtttggtattggcgaggagaaaacaacgttcagctaggcttacagcttggtttcacacaccagagaactactttattcagggaattcaggaggtaccaggaacaactacaatcaaatagcatttgttcttcgacaaaaattaaagagacaccctcaaccaaaagtgtacgtccaagtgatggccgtgcacttcgagtatatactgacatacctcatgtagaggagtttctaacacggccagagtttgtcctcacaactgatccaaaggaagcagacatcatctgggtaagcatgcaagtggattcagaagtaaagaaggcaatagggcttacggaccaacaatacacaaatcaatttccttttgaagcttccctggtcatgaagcaccacctagcggagaccatccacaaggcatggggctcacctgaatggcttcaacctacatataacctagaaacccatctgtctcaactgattggtgactattgtatgaggaaacgagatggcctggacaacttatggatcatgaagccttggaacatggcaagaactattgacaccacagttaccggtgatttatctgctatcatcagacttatggagacaggtcccaagatatgccaaaaatatatagaacgccctgccctttttcaaggaaggaagtttgatcttcggtacattgttttggtccgcagtatacgccctttggagatatttctttctgatgttttctgggttaggttagcaaacaatcagtacactttggagaagactagcttttttgagtatgagacccatttcactgtgatgaattatattggaaggatgaaccatatgaacacgacagagtttgtcaaggagtttgagagggagcaccaagttaaatggctggagatccatgaaagcatacgttctatgatacggtgtgtttttgagtcgactgccgctgttcatcctgagatgcagaaccctttctccagggccatctatggggtagacgttatgcttgatagcagattcaagccaaagattttagaggtgacgtactgtccagactgcgggagggcgtgcaactatgacacgcaagctctggtagggagcaagaataccatcagaggcagtgattttttcaatacggtgtttggctgcctctttctcgacgagcaaacaaatgtatcgccattgtaaccatcacccgaaaggctgttgtgactcgtaactcgtaacatcaaatttattacatggcatttataagctgtcaggttttttttttt

SEQ ID NO: 2873 - DNA, 2910 bp, Triticum aestivum
agccgccgccgccgccgcgcctgacgcggtgaactatcgcgatgtcgcccgctgccgccgcccccgcgccatgcgatgatcgcatccgcaccttcgaggacttcgcgcgggtgcaccagttcctgctgattgcggccggcgtgccgccgtcgctgcatcggcggctgtaccacaagctcgccgccgaggtgttcgacggcggggagagattctacgtagagccctgcgaggaagggaggcagcgccgcctcgtgctcgcctcggacacggctctaaggggggagtcggacgtcttcctcgtcgaccatgcgtggtccttccgcctctccgatgcgctcaagcagctacgtgaagtaccaggattggccgagagaatggcagctctaatgtgcgtggatctggataggaaaactgaggtcgaagagtcagatgagcaaggcagtgaaaatggtgggggtttggagcatgtcttgcaggtgctggagaacgaaaaagctagaatccaggagaggggaagttattttgcagcatggctggagcttgaggagcttggaattgatgatgatatgttagtggcactggatttatctgcaaattttccgaatctggtagccctcaatctatggggaaacaagctgcaggatccagaaaaagtaatgcgagaaatcgggaagtgtggaaggttaaaggcactttggctgaatgagaaccctatccttaaccaatgcactgagaaagatgttcttgatggtcttcctgaattggaaatctacaattcacattttacaaggaaagctagagagtgggctttaggtttctgcggagatatggttggagcagaaaatccctgtttgtctgtgggaaacatatcattggataatattgtgacccttgacctttctgataggtccatccacaaactacctgaggtgttctctagtaaactgtcatctctttcaaagttgaacatccgtggcaatcctttggaccaaatgtctggtgatgatctcttgaagttatttagtgggtttacacagttacaggagctggaggtagacattcctggccctcttggagacagtgcgatttccattcttgagtctcttcccaatataaatttgctgaatggtgtcaatgcgtcaactatagtcgagaacgctaagcatgtagtggactctgcacttagaccacgtgttccagaatggtcacctgaagaatccctggctgaaagagttattggtgcaatgtggctgtatcttatgacataccggcttgccgatgaagaaaagtttgatgaaacacccatttggtatgtcatggatgagttgggctcagcgatgcgccatagtgatgatgcaaactttaggatatctccttttttgttcatgccagaaggaaaattagcttctgctataagttacacaattctgtggcctatttgtgatgttcatactggagaagaatgtacccgagatttcttgtttggtattggcgaagacaaacaacgctcagctaggcttacagcttggttccacacaccagagaagtattttattcaggaattcaggaagtaccaggagcagcttcagtcaactactatttgtcctacaaaagaggcgccctcaaccaaaagtgcacttccaagtgatggccgtccacttcgagtattcactgatataccccaagtagaggagttcttaacacgtccagagtttgttctcacaactgatccgaaggatgcagacatcatctgggcaggcatgcaaattgattctgaattaaagagttcactaggtctcacagaccaacaatacatgaatcagtttccttttgaggcttgtctggtcatgaagcaccacctagcggatactatccacagggcatggggctcacctgagtggcttcaacctacatataacctagagacccatttgtctcaactaattggtgattactctgtgaggaaacgggatggtaaggacaacttatggatcatgaagccttggaatatggcaagaacaattgataccactgtcagtggtgatctatctgctatcatcagacttatggagacgggtcccaagatatgccaaaagtatattgagtgtcctgcacttttccaaggaagaaagtttgatcttcggtacattgttttagtccgcagtatatgccctttggatatacttctttgtgatgttttttgggtcaggttagcaaacaatcagtacactttggagaaaactagcctttttgagtacgagacccatttcactgtgatgaactacaatggaaggatgaaccatatgaatactccagagttcgtcaaggcgtttgagaaggagcaccaagttaaatggctggagattcatgaaagcatacgtattatgataaggcgtgtctttgagtcagcctcagctgtccatcctgagatgcagaactcattctgccgggccatctatggtgttgatgttatgcttgatgataaattcaagccaaagattttggaggtgacatattgcccggactgcacgagggcgtgccaatatgacacacaagctctcgttggaagccaaggccccatcagaggcagtgattttttcaacacggtgtttggctgcctctttctcgatgatttgacgaatgtgtcaccactgtaatcatcttgtcaagagccgtttctccctcgaataccaagagctgttgtaacaccaatgtccttgcatcatgatatgatcaagggttcttgtacgcttatgcatcaacgaactgcatttgtgtcaggatatgatcatgtattcatgtgaatgaagcttaagatggatttgcttgtgttacttgataaatattgctgcttctgatactaatgttgcatgcatatgagattgaactatatcaagtagcaaattatta

SEQ ID NO: 2874 - DNA, 1881 bp, Saccharum officinarum
agaggataggaggagaacaaaggtcgcgtctcgaaggttcttgccttgttgggaagggagggatggcgtcggaggtggaggacgacgcggcggccgcgggggcgccgctggtcgccaacggtgcagccgacgtccgccggagaagggatcaggcgaaggcgattctgtccaagcaggccgtcaagatcgccaccaaggccgagcagcacgagcgcttcatctttaaggtcacacacttgctgggtgttcttggatttgggggattttgctatctcttgggtgccagaccacaggatgtgccatatgtgtactgcctgttctacgtcatattcgttccgctccgctggatttactaccgctacaagaaatggcattactatctcctggacttctgctactatgccaacacctttctccttgtaatgattctcttctatccaaaggatgaaaaacttttcatggtttgcttctcgtttgcagagggtccgcttgcttgggcattaattgtgtggcgttgcagcttggtttttagttcatttgacaaacttgttagtgtcctgatacatctcttacctgggattgttctattcactatccggtggtggaatccacaaacatttgctgccatgcacccagaaggaagagatgccagggacacatggccatatgtggaggacaaatcatatctgtggacatggctcttttttgttccactagctgcttacaccctgtggcaacttatgtatttcctcatagttaatgtcctgcgtcgacagaggttgttaagggaccctgaagtcatgacatcctacagggagctcatcaccacctccgcgctcgaagctcctcccaaacccgcatcgtcgccatggcatccgccttgcctgtaagccccaaggaagcgctgccgtctcccctgacctccgcctccgagccccctcccctcttcgatggcaccaccaggttgtacgttgcctatcattgcccgttcgcgcagcgcgcttggattgccaggaactacaagggtttgcaggacaagattaagatagtcgccatcgatcttgctgacaggccagcatggtacaaggagaaggtttatccagaaaacaaggtgccttctctggagcacaacaaccaggtgaaaggagagagcttggatctggttaagtactttgacaacaacttcgaaggtccatcgttggtccctgaggatcctgcaaagaagcagttcgctgacgagctgcttgcatatactgatgcatttaacaaagcattatactcatctttactcagcaaggaagacgtgtctgaggaaactgttgctgctttggataaaatagaagacgccctagggaaatttaatgacggcccattcttccttggtcagttcagtctggtggacattgcttatgtaccattcatcgagaggtttcagatattctattccaacataaagaactatgatatcacaaagggcagacccaaccttcagaagttcattgaggaagtgaacaagatcgatgcatatacacagactaaactggacccacagtttttacttgagcagacaaagaagcggcttgggattgcttaaagcttgtgaccaaggatgaaactctcgccagaagtaccagcatagtagatcgagactcgtttagtcgtttgtgtgcttgaataatgaatattacatatggttttcaataagacatggtcttctatactggttgtgcttctgaaaataaactagttgtcactgtataaaaggatcatttggtaaggtgttgatgtcactgtatatgaaagggtggggagagagagaatgatatgcagtgtgttctgtcaaatgttgctgaattcaatggatcattcattattcgtcat

SEQ ID NO: 2875 - DNA, 1784 bp, Saccharum officinarum
  misc_feature (262)..(262): n is a, c, g, or t
  misc_feature (379)..(379): n is a, c, g, or t
gggggcgccgctggtcgccaacggtgcagccgacgtccgccggagaagggatcaggcgaaggcgattctgtccaagcaggccgtcaagatcgccaccaaggccgagcagcacgagcgcttcatctttaaggtcacacacttgctgggtgttcttggatttgggggattttgctatctcttgggtgccagaccacaggatgtgccatatgtgtactgcctgttctacgtcatattcgttccgctccgctggatttactaccgntacaagaaatggcattactatctcctggacttctgctactatgccaacacctttctccttgtaatgattctcttctatccaaaggatgaaaaacttttcatggtttgcttctcgttngcagagggtccgcttgcttgggcattaattgtgtggcgttgcagcttggtttttagttcatttgacaaacttgttagtgtcctgatacatctcttacccgggattgttctattcactatccggtggtggaatccacaaacatttgctgccatgcacccagaaggaagagatgccagggacacatggccatatgtggaggacaaatcatatctgtggacatggctcttttttgttccactagctgcttacaccctgtggcaacttatgtatttcctcatagttaatgtcctgcgtcgacagaggttgttaagggaccctgaagtcatgacatcctacagggagctcatcaccacctccgcgctcgaagctcctcccaaacccgcatcgtcgccatggcatccgccttgcctgtaagccccaaggaagcgctgccgtctcccctgacctccgcctccgagccccctcccctcttcgatggcaccaccaggttgtacgttgcctatcattgcccgttcgcgcagcgcgcttggattgccaggaactacaagggtttgcaggacaagattaagatagtcgccatcgatcttgctgacaggccagcatggtacaaggagaaggtttatccagaaaacaaggtgccttctctggagcacaacaaccaggtgaaaggagagagcttggatctggttaagtactttgacaacaacttcgaaggtccatcgttggtccctgaggatcctgcaaagaagcagttcgctgacgagctgcttgcatatactgatgcatttaacaaagcattatactcatctttactcagcaaggaagacgtgtctgaggaaactgttgctgctttggataaaatagaagacgccctagggaaatttaatgacggcccattcttccttggtcagttcagtctggtggacattgcttatgtaccattcatcgagaggtttcagatattctattccaacataaagaactatgatatcacaaagggcagacccaaccttcagaagttcattgaggaagtgaacaagatcgatgcatatacacagactaaactggacccacagtttttacttgagcagacaaagaagcggcttgggattgcttaaagcttgtgaccaaggatgaaactctcgccagaagtaccagcatagtagatcgagactcgtttagtcgtttgtgtgcttgaataatgaatattacatatggttttcaataagacatggtcttctatactggttgtgcttctgaaaataaactagttgtcactgtataaaaggatcatttggtaaggtgttgatgtcactgtatatgaaagggtggggagagagagaatgatatgcagtgtgttctgtcaaatgttgctgaattcaatggatcattcattattcgtcat

SEQ ID NO: 2876 - DNA, 1042 bp, Pennisetum glaucum
actgcatcgccgccgtgctgaagccctcccgaatcgtcgccatggcagccgccgcaccggcaagctctgtcaaggaagtgctcccgtctcctttaacctccgtctccgagccccctcctctctttgacggcacaaccaggttgtatgttgcgtaccactgcccgtatgcgcagcgcgcttggattgccaggaactacaagcgtttgcaggacaagatcaagatagtcgcgatcgatctcgctgacaggccgtcatggtacaaggagaaggtttatccagagaacaaggtgccttccctggagcacaacaaccaggtgaaaggagagagcttggatttggttaagtacattgagagcaatttcgaaggcccgtcattgcttcctgatgatcctgcaaagaagcaattcgctgaggagctgcttgattataccgatgaatttaacaaagcattatactcatctatactctccaaggaagatgtgtccgaggaaactgttgctgctctggataaaatagaagaggccctggggaaattcaacgatggtccattctttctcggtcagttcagtctggtggacatagcatatgtaccatttatcgagaggtttcagatattcttttccaacatcaagaattacgatatcacgaagggcagacccaatcttcagaagttcattgaggaagtgaacaagatcgatgcatacacacagaccaaacaggacccacagtttttgcttgagcacacaaagaagagacttgggattgcctaaagcttgtgaccaaggatgaaactcttgccatgggattaccatcacagacttgcatagtaggtccagactcatttgtatgcttgaatgttatatgcacatttacaataagacatgtccttctatgctggtcgtgcttttgaaaataaactattctgtcaggtgttaagctttctagtgcatcatcataatcagtatcctacctgacatggagatgtaatgatgtgtactgtgctgtcaaatgttgctgatttcaatatatcagtgttcttctc

SEQ ID NO: 2877 - DNA, 1319 bp, Pennisetum glaucum
gtaatcggctgggaagcctgaactgacgtgcccactccgccaatcactgcctcgcacatccacacctcgccgccatgaattcgctcgctttcactcgatgctgcccgtcaccgctgacgcaggcctccacctcttcccccgtcgcctcttatgccctatcggcgagtataaagattcgccgcccgcgccgcgccgctcactgcatcgccgccgtgctgaagccctcccgaatcgtcgccatggcagccgccgcaccggcaagctctgtcaaggaagtgctcccgtctcctttaacctccgtctccgagccccctcctctctttgacggcacaaccaggttgtatgttgcgtaccactgcccgtatgcgcagcgcgcttggattgccaggaactacaagcgtttgcaggacaagatcaagatagtcgcgatcgatctcgctgacaggccgtcatggtacaaggagaaggtttatccagagaacaaggtgccttccctggagcacaacaaccaggtgaaaggagagagcttggatttggttaagtacattgagagcaatttcgaaggcccgtcattgcttcctgatgatcctgcaaagaagcaattcgctgaggagctgcttgattataccgatgaatttaacaaagcattatactcatctatactctccaaggaagatgtgtccgaggaaactgttgctgctctggataaaatagaagaggccctggggaaattcaacgatggtccattctttctcggtcagttcagtctggtggacatagcatatgtaccatttatcgagaggtttcagatattcttttccaacatcaagaattacgatatcacgaagggcagacccaatcttcagaagttcattgaggaagtgaacaagatcgatgcatacacacagaccaaacaggacccacagtttttgcttgagcacacaaagaagagacttgggattgcctaaagcttgtgaccaaggatgaaactcttgccatgggattaccatcacagacttgcatagtaggtccagactcatttgtatgcttgaatgttatatgcacatttacaataagacatgtccttctatgctggtcgtgcttttgaaaataaactattctgtcaggtgttaagctttctagtgcatcatcataatcagtatcctacctgacatggagatgtaatgatgtgtactgtgctgtcaaatgttgctgatttcaatatatcagtgttcttctcaaaaaacaaaaaaaaaaaaaaaaaaagtaaaactaactagacgttagtaaaactacgtaagaactacgtaccgaaacgg

SEQ ID NO: 2878 - DNA, 1435 bp, Hordeum vulgare
cggcacgaggccggccggccgaccccatccatggagcatcacccgaatcgacgtgtcgaatccacatttactgccgcaccaatgagttcgctcgctttcccctgccgctcgtcaccactgacgcccgcctccaattcccctcccgtcccgtcgccgtgtataaagatccgccgctcgcgacgagctgctccccatcgccacctcatcgccgccaggaattcgagctccccccggaccgtcgccatggccgccgcagccgctgccgcaccggtcatctccccgaaagaaaatctgcccccttcgctgacctccacctccgagcccccgccactcttcgacggcacgaccaggttgtatgttgcatatcactgcccgtacgcgcagcgcgcttggattgccaggaattacaagggtttgcaagacaagatcaagatagtcgcagtcgatcttgcagacaggcccgcctggtacaaggagaaggtttacccacagaacaaggtgccttcactggagcataataaccaagtgaaaggagagagcttggatttggtcaagtacattgacagcaatttcgatggccctgcattgcttcctgatgattctgcaaagaagcagttttccgaggagctgcttgtgtataccgatgagttcaataaagcactatactcatccataacctccaagggagatgttgcagaggaaactgttgctgcgctggataaaatagaagccgccctgggaaagtttagtgatggccctttcttccttggccagttcagtttggtggacattgcatatgtgccatttatcgaaaggtttcagatattcttttctggtataaaaaactatgatatcaccaaggacagacctaacattcagaaattcatcgaggaagtgaacaagatcgatgcatacacacaaacgaagctggacccacaatttctgcttcaacacacaaagaagcggcttgggattgagtgaagatatgaccaagcatgaacagaggccagggaactactgcagcatggaagatggagactagacaatcaggagcgttcttgcttgctactgtagtatataccatactatgaataaaaagatgcatgctactaaggtcctgccttttgagaataaattaagtggttgattgtgattatagtattttaagcacgttttgtgattgcggtttgacagtgtgccagtgcttatgaaggaacatcatcttgtgttgtgtacttgttgaatgcttattttttgaacgggttagtctctgggtctctacatcttctgatgcacacaagcatagttttgtttagaaaggtgccaagcaataagaccagacgcttcatttcagctttaaaaacgagatcatcccttggcctcaactatttactgctgtaacctattttcaaagaatataagggttaccagacaa

SEQ ID NO: 2879 - DNA, 1096 bp, Triticum aestivum
gccgctcgtcaccactgacgcccgcctccatttcccctcccgtaccgtcgccgtgtataaagatccgccgctcgcgaccagctgctccccatcgccgcctcatcgccgccaggagttcgagttccccccgaaccgtcgccatggccgccgccgctgccgctgccgcaccggtcatctccccgaaagaaaatctgcccccttcgctgacctccacctccgagcccccgcccctcttcggcggcaccaccaggctgtatgttgcatatcactgcccgtacgcgcagcgcgcttggattgccaggaactacaagggtttgcaagacaagatcaagatagtcgggatcgatctcgcaaacaggccggcttggtacaaggagaaggtttacccacagaacaaggtgccttcactggagcataacaaccaagtgaaaggagagagcttggatttggtcaagtacattgacagcaatttcgatggcccagcattgctccctgatgattctgcaaagaagcagtttgctgaggagcttcttgtgtacaccgacgagttcaataaagcactatactcatccataacctccaagggagatgtggcagaggaaactgttgctgcgctggataaaatagaagctgccctgggaaagttcagtgatggccctttcttccttggccagttcagtttggtggacattgcatatgtgccatttatcgaaaggtttcagatattcttttctggtatcaaaaactatgatatcaccaaggacagaccgaacattcagaaattcatcgaggaagtgaacaagatcgatgcgtacacgcaaacgaagctggacccacaatttctgcttgaacacacaaagaagcggcttgggattgagtgaagatgtgaccaaggatggccaagaggacagggaactactgcagcatggaaggtgaggatgaagacactcaggagtgtgcttgcttgctagtactatatactatactttgaataaaaagatgcatgctactaaggccctgccttttgagaataaattaagtggttgttctgtattatagtctttttaggcgttctggattgggtttcacagtgtac

SEQ ID NO: 2880 - DNA, 1234 bp, Triticum aestivum
catcactccgcaatcggcgtgtcgaatccacatttactgccgcacaagctcgcaccaatgacttcgctcactttcccctgccgctcgtcaccactgacgcccgcctccatttcccctcccgtcccgtcgccgtgtataaagatccgccgctcgcgacgagctgctccccatcgccgcctcatcgccgccaggagttcgagctccccccgaaccgtcgccatggccgccgccgctgccgctgccgcaccggtcatctccccgaaagaaaatctgcccccttcgctgacctccacctccgagccccctccactcttcgacggcaccaccaggttgtatgttgcatatcactgcccgtatgcgcagcgcgcttggattgccaggaactacaagggtttgcaagacaagatcaagataatcgggatcgatctcgcagacaggccggcttggtacaaggagaaggtttacccacagaacaaggtgccttcactggagcataacaacgaggtgaaaggagaaagcttggatttggtcaagtacattgacagcaatttcgatggcccagcattgctccctgatgattctgcaaagaagcagtttgccgaggagctgcttgtgtacaccgacgagtccaataaagcactatactcatccataacctccaagggagatgtggcagaggaaactgttgctgcgctggataaaatagaagcggccctgggaaagttcagtgatggacctttcttccttggccagttcagtttggtggacattgcatatgtgccatttatcgaaaggtttcagatattcttttctggtatcaaaaactatgatatcaccaaggacagacctaacattcagaaattcatcgaggaagtgaacaagatcgatgcgtacacgcaaacgaaactggacccacaatttctgcttgaacacacaaagaagcggcttgggattgagtgaagatgtgaccaaggatgaccaagaggccagggaactactgcagcatggaagatgaagatgaagacactcaggagtgtgcttgcttgctagtactatatactatactttgaataaaaagatgcatgctactaaggccctgccttttgagaataaattaagtggttgttttgtgattatagtctttttaggcgttctgtgattgtggtttgacagtgtacaatattgtgagtatgtacgtgcaattaatatactgcctaatatcaattatcctagt

SEQ ID NO: 2881 - DNA, 1411 bp, Triticum aestivum
aatcggcgtgtcgaatccacatttactgccgcacaagctcgcaccaatgacttcgctcactttcccctgccgctcgtcaccactgacgcccgcctccatttcccctcccgtcccgtcgccgtgtataaagatccgccgctcgcgacgagctgctccccatcgccgcctcatcgccgccaggagttcgagttccccccgaaccgtcgccatggccgccgccgctgccgctgccgcaccggtcatctccccgaaagaaaatctgcccccttcgctgacctccacctccgagccccctccactcttcgacggcaccaccaggttgtatgttgcatatcactgcccgtatgcgcagcgcgcttggattgccaggaactacaagggtttgcaagacaagatcaagataatcgggatcgatctcgcagacaggccggcttggtacaaggagaaggtttacccacagaacaaggtgccttcactggagcataacaacgaggtgaaaggagaaagcttggatttggtcaagtacattgacagcaatttcgatggcccagcattgctccctgatgattctgcaaagaagcagtttgccgaggagctgcttgtgtacaccgacgagtccaataaagcactatactcatccataacctccaagggagatgtggcagaggaaactgttgctgcgctggataaaatagaagcggccctgggaaagttcagtgatggacctttcttccttggccagttcagtttggtggacattgcatatgtgccatttatcgaaaggtttcagatattcttttctggtatcaaaaactatgatatcaccaaggacagacctaacattcagaaattcatcgaggaagtgaacaagatcgatgcgtacacgcaaacgaaactggacccacaatttctgcttgaacacacaaagaagcggcttgggattgagtgaagatgtgaccaaggatgaccaagaggccagggaactactgcagcatggaagatgaagatgaagacactcaggagtgtgcttgcttgctagtactatatactatactttgaataaaaagatgcatgctactaaggccctgccttttgagaataaattaagtggttgttttgtgattatagtctttttaggcgttctgtgattgtggtttgacagtgtacaatattgtgagtatgtacgtgcaattaatatactgcctaatatcaattatcctagtcacaaaaaagccaagcgcagcgccagagatcccaagtcccatcctggcgccgcctccgatcgggttcccggggtcccgggtgcacctggcgaccatcccacaacgggaaccggataaaccggcaggtcctcgggccgcaacatcccaacagaagcaggctggaagacaccgctttccggcgggcccta

SEQ ID NO: 2882 - DNA, 1124 bp, Festuca arundinacea
  misc_feature (75)..(76): n is a, c, g, or t
  misc_feature (81)..(81): n is a, c, g, or t
  misc_feature (111)..(111): n is a, c, g, or t
  misc_feature (117)..(117): n is a, c, g, or t
  misc_feature (138)..(138): n is a, c, g, or t
  misc_feature (141)..(141): n is a, c, g, or t
  misc_feature (147)..(147): n is a, c, g, or t
  misc_feature (219)..(219): n is a, c, g, or t
  misc_feature (387)..(387): n is a, c, g, or t
  misc_feature (411)..(411): n is a, c, g, or t
  misc_feature (421)..(421): n is a, c, g, or t
  misc_feature (646)..(647): n is a, c, g, or t
  misc_feature (679)..(680): n is a, c, g, or t
  misc_feature (773)..(773): n is a, c, g, or t
  misc_feature (922)..(922): n is a, c, g, or t
  misc_feature (943)..(943): n is a, c, g, or t
ggcacgaggatccgccgctcgcgacgaacagccaaccgccatttccaccgcctcgccgccagcacccggaattcnncccgnaccgtcgccatggccgccaccgccgctgcngcaccngtcatctccccgaaagaaaanctncccccnatcctgacctccacctccgagccccctcccctcttcgacggcaccaccaggctgtatgttgcataccactgnccgtatgcgcagcgcgcttggattgccaggaactacaagggtttgcaggacacgatcaagatagtcgcgatcgatctggcggacaggccggcttggtacaaggagaaggtttacccagggaacaaggtgccttcgctggagcataacaaccaggtgaaaggagagagnttggatttggtcaagtacatcganagcaacttcnaaggcccagcattgcttcctgatgattctgaaaaaaagcagttcgctgacgagctacttgtgtataccgatgagttcagtaaggcagcgtactcatccataacctccaagggagacgtttcagatgaaactgttgctgcgctggataaaatagaagctgccctggggaagttcacagatggccctttcttccttggccagttcagtttggtggacattgcgtatnngccattcatcgaaaggtttcagatattctttnntggtatcaagaactacgatatcaccaagggcagacctaaccttcagaaattcgttgaggaagtgaacaagatcgatgcttatacacaaaccanactggacccacaatttctgcttgaacaaactaagaagcggcttgggatcgagtgaagctgtgaccaaggatgaacaagagatgaaatttcagtcactcaggaacgtgcttgcttgcagaatgctaaatatggaataaatgatgcatgcnactaggctcctgccttttgantataaaatatttattttgtggttatagttcgacagtgtgcccatgcttgtgaaggaggatgatcatatactgtagtactgtactataagttccatgaaccgatgctcttatgttcttaatgtcgttaataatgctcatgtgaatatttgaacttcctaatcaaacaacagggtggatatga

SEQ ID NO: 2883 - DNA, 3370 bp, Sorghum bicolor
ccagcagattcgaaattcacgggcaggcccctggaccccgggaaagcgagcggtggttccgtcactgacgtgcggggccctgcgcaagccgcaccgcctagagagctagagggtatctcttcgcgtggaagcaaacgaggcgtgataaagaggggctccggtgtcccggcgttgcccgcatcgacactcgacacgcaccgcccccgccaccaccacaagctgcggctcacggctacgcagcccgctctcccgcgactcccccgtcccctcctcctcctctccttcctactagcacctagagtttcgcccgaatcgatcgccgactgactccgctagggttcggcccgatcgccacttcgtcctcccggctcccgcggggacccgtcgccgcgatgtctgaccggagctcgtcggctgggccgacgtttttcccctttggcccgcaggccgaggcgtgggacgtcaccttcaaggtcaaatatggtgatactctcaaaaggttttatggttgtgccaatgggaatcattttgacatgaatttgtctgctctgcgggcaaagatagctactgcctttaagtttggttctgatgctgacttcattctgacttacactgatgaggatggggatattgtcatgctagatgatgatgatgacttgcgtgatgcagctctgcgtcagaaattaaaccctctgaggattactgttcaactgaagaaaaatcaaccaactgataaaaaagatgtctctgcacctgtgaaacccattactcaggattcactatcccagataatgtcagctattgaatttttgaagcctgtccaggaagatagtcttgctcatataaaatcagctattggtgaagcaatcaagtctgtcccagagccaatacctgatgcccttgcaaaactttctcatgaaatacttgatgcagcaccaccaccattagctgagttgatgaaaccttttgcacaattgatggcaccaaacaataatggcaatgggccatctgatgtgcatgctgaggggtcatctacctcttccagtggtgtgacacagacaccggcgccggcaccggcaccggtgccggccgaagctaaaaatgagcccaaagttacgccaagtttgggtcttagggctgtgttcaaggaggctgcttctcctgttcctaatgctggagcttctcaagttcaacagccatcaatgtacccatctgttgaggagttgctgttcccccgtaattcagtagacaaacctgtctgcaaagggaagactgatgctcaaagtaagggaaaatctgttatgtcctcacttacccaacctgccccttactctctacctactcatgccccacctccgccgcctccatgcatttcagaatggtcccgaccacgaagaagtttacaacacccatggcaatatgaagacaatgcaaaagccactagtgattctagatggcgcattccaatgtacaaaatgccctatgcaccacctcctccagcagtgccacctccaggctatggaccttctccacattttccttatccaggccgcctcttgtcttcgggacatccatacggagatcttgctggtaacatggaaaactcagcacaacgtagtctgcatagatggattcagtgtgatggttgtggagtgcaaccaattgttggtccgcgttataaatctaatgtgaaggaagactatgatttatgtgattcctgtttccaacgcatgggaaatgaaatggagtacaccaaaatagacaaacctatttcaccccacaagtttctcagagatcctcatgcgacccgaaaggtgcaccacacacgggttctaatgaagtcaaaacgggagaaacttgaaagtcgcttcattttggatgtaactgtccttgatgggacactgatgacaccttctacctcgttcactaagatttggcgcatgcataacaatgggtctgttgtgtggccacttggcacacagcttatctgggttggtggagatcagtttgcattgcagtcatctgttccgttagagattcctgtggatggctttcctgtggacaaagagattgatgttgctgttgattttgtggcacctagaaggccagggagatacatatcatactggaggttggcttcaccttctggtcagaaatttggtcagcgagtttgggttcatatccaggtggaagacccttcttttgttaatgacaataacaggagtgctgctattaatctgaacctgcctccagagagcaatagtgcaaacacaaccaatttaattgatgtgaacattgagcctgttgactcagcccttactgccaaacgcacaaaagagttccatttctgttcaactgatgtttctgggcccaagaaatctctgcctgccacgttggttgctacctcttcgtctgcagcagctcctgcaaacccaaccggtgatgttcccatgtccagtgcacctgctgctgcttttgtgccctctgttaatgtgcctatgcctgaagttgtaactcatacaccatcacctgctatgcccgtgctgcctacaactatacctatgtcagctccagtatctgcgcctgcaattgcccctgtgtctgcatctggggctgtgcctgcgcctccacctgttagtgccgtggttcctgagctgtccgacctagatgttcacaatgaggagaagttgctgagggagctggaggaaatgggctttaggcagatcgatctcaacaaagaaatccttaggcagaacaattacaacctggagcagtctgttgatgacctatgtggcgtcaatgaatgggatccactccttgcagagttggaagagatgggatttgatgacacagaggtgaacaaggagctgcttgcgaagaacggaggaagcatcaagcgagctgtgatggacctgattgccagggagaaaaaggacaagtgaagatcgtgtgccagtgtgcgctgtgtgcacatagctatctagacctagtatatatgggtaaataatgagacggctgtgccattgtggtgcagccctagtgcgtctcagagcttgcttatggtgaactgttcgtgcttgcgtgtggtgtcgatgaactctagtatgtgcgcgtgtgcctcagcatttctttatgtgtctgtcgtgcgtgcggtgtcgatgaactctagtatgtgcgctcgtgcgcctcagtagtaaaccttggcatgccccaggtatactgcttctgcttgtatgatatgatgcgtggaccaatgtttgatgcttgtgctctcgcccttataatgtattcccttcattccaaattacaaccgttccaaattataggatattctaagagttttgaagagtcaaagatattaaataaatat

SEQ ID NO: 2884 - DNA, 3122 bp, Saccharum officinarum
caccaccaccaccaccaccaccaccactgctgcggctcacggctacgcagcccgccctcccgacccccgtcccctcctctccctgctactagcacctagagtttcgcccgaatcgatcgccgactgaccccgctagggttcggcccgatcgccgcttcgtcctcccggctcccgcggggaccccgccgcgatgtctgaccggagctcgtcgactgggccgacgtttttcccctttggcccgcaggccgaggcatgggacgtcaccttcaaggtcaaatatggtgatacgcttaaaaggttttatggttgtgtcaatgggaatcattttgacatgaatttatctgctctgcgggcaaagatagttactgcctttaagtttggtgctgatgctgacttcgttctgacttacgccgatgaggatggtgatattgtcatgctagatgatgatgatgacttgcgtgatgcagctctgcgtcagaaattaaaccctctgaggattactgttcaactgaaaaaaaatcaacctactgaaaaaaaagatgcctctgcacctgtgaaacccactgcccaggatccactatcccagataatgtcagctattgaaggcttgaagcctgttcaggaagatagtctggctcatataaaatcagctattggtgaagcaatcaagtctatcccagagccaatacctgatgcccttgctaaactctctcatgaaatacttgatgcagcaccgccaccattagctgagctgatgaaaccttttgcacagttgatggcaccaaacagtaatggcaatgggccatctcatgtgcatgctgaggggtcatctagctcttccagtggtgtgacccagacacaggcgccggccccggccccggccccggctgaagctaaaactgagcccaaagttaagccgagtttgggtcttagggctatgttaaaagaggctgctgcacctgttcctaatgctggagcttctcaagttcaacagccatccatgtacccatctgttgaggagttgctgttcccctgtaattcagttgacaaatctgtttgcaaagggaggactgatgctcaaaataagggcaaatctgttatgtcctcagtcacccaacctgccccttactctcttcctactcatgccccacctccgccaccttcatgcatttcagaatggtcccgaccacgaagaagccaacaacacccatggcaatatgaagacaatgcaaaagccactagtgatagatggcacattccaatgtacaaaatgccctatgcaccaccttcttcagcagtgccacccccgggctatggcccttttccacatttttcttatccaggccgcctcttgtcttctggacatccatacggagatcttgcgggtaacatggaaaactcagcagcacgtagtctgcacagatggattcagtgtgatggctgtggagtgcaaccaattgttggtccgcgttataaatctaatgtgaaggaagactatgatttatgtgattcctgtttccaacgcatgggaaatgaaatggagtacaccaaaatagacaaacctattttaccccacaggtttctgagagatcctcatgcgaaccgaaaggtgcaccacacacgagttctaatgaagtcaaaacgggagaaacttgaaagtcgcttcattttggatgtaactgttattgatggaacactgatgacaccttctaccccgttcactaagatttggcgcatgcataacaatggatctgttgtgtggccacttggcacacagcttatctgggttggtggagatcagtttgcattgcagacatctgttccattagagattcctgtggatggctttcctgtagacaaagagattgatgttgctgttgattttgtggcacctacaagaccagggaggtacatatcttactggaggttggcttcaccttctggtcagaaatttggtcagcgagtttgggttcatatccaggtggaagacccttcttttgttaatgacaatagcaagaatgctgctattaacctgaacctgcctccagagagcaatagtgcaaacacaaccaatttaattgatgtgaacattgagcctgttgactcagcccttagcgcacacgccaaacgcacaaaagagttccatttctgttcaactgatgtttctgagcccaagaaatttctgcctgccacgttggtcaatacctctttgtctgcagcagctcctgcaaacccaaccggtgatgtttccatatccagtacgtctgctgctgcctttgtgccctctgttaatgtgcccatgcctgaagttgttactactcatacatcattacctgctatgcctgtgctgcctacaaatatacctatttcagctccagtatctgctcctgcaattgcccctgtgcctgtgcctccacctgttagtgcgcctcaacctgttaatgccgtggtacctgagctgtctgacctggatgttcacaatgaggagaagttgctgagggagctggaggaaatgggttttaggcagatcgatctcaacaaggaaatccttagacagaacaattacaacctcgagcagtctgttgatgacctatgtggtgtcaatgaatgggatccactccttgcagagctggaagagatgggatttgatgacacagaggtgaacaaggagctgcttgcgaagaatgggggaagcatcaagcgagctgtgatggacctcattgccagggagaaaaaggacaagtgaagatcgtgtgccagtgtgctgtgtgcacatagctatctagacctaagtatatatgggtaaataatgagatggctgtgccactgtggtgcagccctagtgcgtctcagagcttgcttatggtgaactgttcgtgctatgtttctttatgtatctgtcgtgcgtgtggtgtcgatgaaccctagtatgtgcgcgtgtacgccccagcagttaccttgccatgctccaggtatactgctgctgcttgtatggactggctgtcgtatctcctatgttactgagatgtgaatctttctatatttgtaatgatgcgtggaccaatgtttgatgctttccgaaaaaatgtcgaatattggattctttgagggttgttactagt

SEQ ID NO: 2885 - DNA, 3151 bp, Saccharum officinarum
  misc_feature (3084)..(3084): n is a, c, g, or t
caccaccaccaccaccaccaccaccactgctgcggctcacggctacgcagcccgccctcccgacccccgtcccctcctctccctgctactagcacctagagtttcgcccgaatcgatcgccgactgaccccgctagggttcggcccgatcgccgcttcgtcctcccggctcccgcggggaccccgccgcgatgtctgaccggagctcgtcgactgggccgacgtttttcccctttggcccgcaggccgaggcatgggacgtcaccttcaaggtcaaatatggtgatacgcttaaaaggttttatggttgtgtcaatgggaatcattttgacatgaatttatctgctctgcgggcaaagatagttactgcctttaagtttggtgctgatgctgacttcgttctgacttacgccgatgaggatggtgatattgtcatgctagatgatgatgatgacttgcgtgatgcagctctgcgtcagaaattaaaccctctgaggattactgttcaactgaaaaaaaatcaacctactgaaaaaaaagatgcctctgcacctgtgaaacccactgcccaggatccactatcccagataatgtcagctattgaaggtttgaagcctgttcaggaagatagtctggctcatataaaatcagctattggtgaagcaatcaagtctatcccagagccaatacctgatgcccttgctaaactctctcatgaaatacttgatgcagcaccgccaccattagctgagctgatgaaaccttttgcacagttgatggcaccaaacagtaatggcaatgggccatctcatgtgcatgctgaggggtcatctagctcttccagtggtgtgacccagacacaggcgccggccccggccccggccccggccccagctgaagctaaaactgagcccaaagttaagccgagtttgggtcttagggctatgttaaaagaggctgctgcacctgttcctaatgctggagcttctcaagttcaacagccatccatgtacccatctgttgaggagttgctgttcccctgtaattcagttgacaaatctgtttgcaaagggaggactgatgctcaaaataagggcaaatctgttatgtcctcagtcacccaacctgccccttactctcttcctactcatgccccacctccgccaccttcatgcatttcagaatggtcccgaccacgaagaagccaacaacacccatggcaatatgaagacaatgcaaaagccactagtgatagatggcacattccaatgtacaaaatgccctatgcaccaccttcttcagcagtgccacccccgggctatggcccttttccacatttttcttatccaggccgcctcttgtcttctggacatccatacggagatcttgcgggtaacatggaaaactcagcagcacgtagtctgcacagatggattcagtgtgatggctgtggagtgcaaccaattgttggtccgcgttataaatctaatgtgaaggaagactatgatttatgtgattcctgtttccaacgcatgggaaatgaaatggagtacaccaaaatagacaaacctattttaccccacaggtttctgagagatcctcatgcgaaccgaaaggtgcaccacacacgagttctaatgaagtcaaaacgggagaaacttgaaagtcgcttcattttggatgtaactgttattgatggaacactgatgacaccttctaccccgttcactaagatttggcgcatgcataacaatggatctgttgtgtggccacttggcacacagcttatctgggttggtggagatcagtttgcattgcagacatctgttccattagagattcctgtggatggctttcctgtagacaaagagattgatgttgctgttgattttgtggcacctacaagaccagggaggtacatatcttactggaggttggcttcaccttctggtcagaaatttggtcagcgagtttgggttcatatccaggtggaagacccttcttttgttaatgacaatagcaagaatgctgctattaacctgaacctgcctccagagagcaatagtgcaaacacaaccaatttaattgatgtgaacattgagcctgttgactcagcccttagcgcacacgccaaacgcacaaaagagttccatttctgttcaactgatgtttctgagcccaagaaatttctgcctgccacgttggtcaatacctctttgtctgcagcagctcctgcaaacccaaccggtgatgtttccatatccagtacgtctgctgctgcctttgtgccctctgttaatgtgcccatgccagaagttgttactactcatacatcattacctgctatgcctgtgctgcctacaaatatacctatttcagctccagtatctgctcctgcaattgcccctgtgcctgtgcctccacctgttagtgcgcctcaacctgttaatgccgtggtacctgagctgtctgacctggatgttcacaatgaggagaagttgctgagggagctggaggaaatgggttttaggcagatcgatctcaacaaggaaatccttagacagaacaattacaacctcgagcagtctgttgatgacctatgtggtgtcaatgaatgggatccactccttgcagagctggaagagatgggatttgatgacacagaggtgaacaaggagctgcttgcgaagaatgggggaagcatcaagcgagctgtgatggacctcattgccagggagaaaaaggacaagtgaagatcgtgtgccagtgtgctgtgtgcacatagctatctagacctaagtatatatgggtaaataatgagatggctgtgccactgtggtgcagccctagtgcgtctcagagcttgcttatggtgaactgttcgtgctatgtttctttatgtatctgtcgtgcgtgtggtgtcgatgaaccctagtatgtgcgcgtgtacgccccagcagttaccttgccatgctccaggtatactgctgctgcttgtatggactggctgtcgtgtctcctctgttactgagatgtgaatctttctatatttgtaatgatgcgtggaccaatgtttgatgctttncgaaaaaatgtcgaatattggattctttgagggttgttactagtggggggggcggccggtttaagga

SEQ ID NO: 2886 - DNA, 922 bp, Sorghum bicolor
gacccaaaaaaggcagggcattcgcatcaagcatcccccgtcgagagcgcgagcaacccacacccacgccgccccgctgtctccgccggtccgccccctctgcctctgcctctgcctctgcgcctcccccgtccccgaatcgcgtcggcccgtctcctcgtgtcgcgaaaccctcggccatggcggaggcgcccgagaccgccgctcccaccccgcccccgtcgccgccagcgccggtgacttcgtccccgcctcccaagtcggggatcccgccgcggtacgacctggacgccaagtgggacgcgtgcctcgacctctccatccgccgcgtcgcctactcctccctcgctggcgccttcgcgggtctcctcctcttccgtagccctactactcgctgggcatcagttgcccttggagctggtgtggggataggagctgcatacactgaatgctcatacttattcaatggtgctcctccaaagtggtcacccaaagtctcaactattccttctgctcactctgaaggaggagacaagtaaacccttaccgaaggattggtccatctcggtggagttttggagtgtgtgaagtacttggtggtttcctgctggatattacgctacctgtggccatagtatgtcattaaagttagatttgcctcacttgagagttttgttgcaaacctattccaattgtggtctgaatgtctgatgacccacccttggcaaagagcttttgcaagctgacgttgaaacggtggcttggtgaccggtaataaatttttcatcatgtgaacttgtttgcagaatgctttgtgccttacatgagtatatacatttacacattgcacgacccttttctggggctattgttgcctaagcctgtgagtgttgcacactagcacttgtttcacttcgttccc

SEQ ID NO: 2887 - DNA, 800 bp, Saccharum officinarum
gcagatcggcttggcacccgacccaaaaaaggcagggcattcgcatcaagcatcccctccccgtccagcacagccacgccgccccgctgtctccgcccctctgcctctgcctctgcctctgcctctgcgcctccctcccccgaatcgcgtcggcccgtctcctcgtgccgcgaaaccctcgccatggcggaggcgcccgacaccgccgctccgtccccgcctcccaagtcggggatcccgccgcggtacgacctggacgccaagtgggacgcctgcctcgacctctccatccgccgcgtcgcctactcctccctcgccggcgccttcgcgggcctcctcctcttccgtagccccactactcgctgggcatcagttgcccttggagctggtgtggggataggagctgcatacactgaatgctcatacttattcaatggtgctcctccaaagtggtcacccaaagtctcaactattccttctgctcactctgaagggaaagacaagtaaatccttaccgatggattggtccatctcggtagagttttggagtgtgtgaagtactggttgtttcctgctggatattgcagtacctgtggccatagtaatgccattaaagttagattcgcctcacttgagagttttgttgcaaacctattccaatcgtggtctgaatgtctgatgacccccggcaaagagcttttgcaagctgacgttgaaacggtggcttggtgactggaaataaatttttcatcatgtgaacttgttctcagaatgctttgcgccttacatgagtatatata

SEQ ID NO: 2888 - DNA, 739 bp, Zea mays
acggcatttcgcacgaatcgtccccgtccagagcgcgagcaacccacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtctcaactattacctctgcacactctgatgggggagataagtaaacccttgctgttggattggtccatctcggtggagtttttgtatgtgtgaagtaccggttgtttcatgctggatattgcgctacttgtggccatagtatgtcattgaagctagatgcgcctcacttgagagttttgttgcaaacctattccaattgtggtctgatgacccctggcaaagagcttttgcaagctgacgttgaaacggtggcttggtgaccgctaataaattttccatcatgtgaacttgttctc

SEQ ID NO: 2889 - DNA, 739 bp, Zea mays
acggcatttcgcacgaatcgtccccgtccagagcgcgagcaacccacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtctcaactattacctctgcacactctgatgggggagataagtaaacccttgctgttggattggtccatctcggtggagtttttgtatgtgtgaagtaccggttgtttcatgctggatattgcgctacttgtggccatagtatgtcattgaagctagatgcgcctcacttgagagttttgttgcaaacctattccaattgtggtctgatgacccctggcaaagagcttttgcaagctgacgttgaaactgtggcttggtgaccgctaataaattttccatcatgtgaacttgttctc

SEQ ID NO: 2890 - DNA, 799 bp, Saccharum officinarum
  misc_feature (83)..(83): n is a, c, g, or t
  misc_feature (85)..(85): n is a, c, g, or t
  misc_feature (88)..(89): n is a, c, g, or t
  misc_feature (91)..(91): n is a, c, g, or t
  misc_feature (99)..(99): n is a, c, g, or t
  misc_feature (103)..(103): n is a, c, g, or t
  misc_feature (107)..(107): n is a, c, g, or t
  misc_feature (534)..(534): n is a, c, g, or t
  misc_feature (537)..(537): n is a, c, g, or t
  misc_feature (607)..(607): n is a, c, g, or t
gcagatcggcttggcacccgacccaaaaaaggcagggcattcgcatcaagcatcccctccccgtccagcacagccacgccgcncngcnncnccgccccnctgnctcngcctctgcctctgcctctgcgcctccctcccccgaatcgcgtcggcccgtctcctcgtgccgcgaaaccctcgccatggcggaggcgcccgacaccgccgctccgaccccgcctcccaagtcggggatcccgccgcggtacgacctggacgccaagtgggacgcctgcctcgacctctccatccgccgcgtcgcctactcctccctcgccggcgccttcgcgggcctcctcctcttccgtagccccactactcgctgggcatcagttgcccttggagctggtgtggggataggagctgcatacactgaatgctcatacttattcaatggtgctcctccaaagtggtcacccaaagtctcaactattccttctgctcactctgaagggaaagacaagtaaatccttaccgatggattggtccatctcngtngagttttggagtgtgtgaagtactggttgtttcctgctggatattgcagtacctgtggccatagtaatgncattaaagttagattcgcctcacttgagagttttgttgcaaacctattccaatcgtggtctgaatgtctgatgacccccggcaaagagcttttgcaagctgacgttgaaacggtggcttggtgactggaaataaatttttcatcatgtgaacttgttctcagaatgctttgcgccttacatgagtatatata

SEQ ID NO: 2891 - DNA, 862 bp, Panicum virgatum
caagtgcaagcaaccaacgccgcccccgcggtctccgcctctctctgtgtctctttctgcctcccccgaatcgcgtcggaccctctcctcgtctcgcgaaaccctcgccatggcaggagcgcgcccgagaacgccgcccccacccccaccccgaccccgccggcgccggcgacctcgtccccgcctcccaagtcggggatcccgccgcggtacgatctggacgccaagtgggacgcgtgcctcgacctctccatccgccgcgtcgcctactcctccctcgccggcgccttcgcgggcctcctcctcttccgtagccctactactcgctgggcttcagttgcccttggagctggtgtggggataggagctgcatacacggaatgctcatacttattcaatggtgctcctccaaagtggtcacccaaagtagggactgttccttctgcctactctgaaggggaggacaagtaatcgctgcccgttgaatcggtccattttgatggagttttggagtgttcttgaagtgattgtttcgtgttggataccaggctacccctctggccatagtatgccattaaagttagatgtgactcacttctgagttttgtttacacttgtgcaaacctattccaattgtggtctggtgaccgggatgcacactgcatgagctttgtaagctttcttgaaatgacggcttggtggccaggaataagtttttttttatcatgtgaactagttcgcagcatgcatgcgcgttacattggtgtacgcattattactcaattcgtttcgggtgtgccgtgtgcgccttaagcttatctgtatacaaacttgagtgatgatcactcatttcactttgttc

SEQ ID NO: 2892 - DNA, 770 bp, Zea mays
gacaagaaaacaaggggctatgttccttggaatgatgagatggataaggtactccttgatacatttgtggactattacaataaaggtgatagatgtcagaatgggtggaagtctcatgtatacacagctgctgtgaagaatgtttgtgagaagtgcaatgccaccattacaaaggaaaatattagctctcgcagcaagacctttgataagcactacaatatcattaatggtttgttgtccactagtggttttggatgggattgggagaagaacaagctcaaagttgatagtgacactgtatgggatgagtacgttgaggaagcaaaaggatatagacataaggttgtgaagttttgggatctactcagcctagtgtacaataaagaccaagcaaatagagagggtgctaaaacagcagctggaagttcaaaggaaatggcaaaagagaatgataccggaggcaaggatgctccatattctgtatcttcctcaagtagtttaaaaagacaaagatcagatgattcatttaactctatgtggtgtgataagtttgacatgcttacatctgcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgtagatc

SEQ ID NO: 2893 - DNA, 745 bp, Zea mays
gacaagaaaacaaggggctatgttccttggaatgatgagatggataaggtactccttgatacatttgtggactattacaataaaggtgatagatgtcagaatgggtggaagtctcatgtatacacaactgctatgaagaatgtttgtgagaagtgcaatgtcaccattagaaaggaaaatattagctctcgcagcaagacctttgataggcactacaatatcattactggtttgttgtccactagtggttttggatggattggtagaagaacaagctcaaagttgatagtgacactgtatgggatgagtacattgagaggaataaggagatctactaagcctagtgtacaataaagaccaagcaaatggagagggtgctaaaacaacagctgaaagttcaaaggaaatggcaaaagagaatgataccggaggcaaggatgctccatattctgtatcttcttcaagtagtttaaaaagacaaagatcagatgattcatttaactctatgtggtgtgataagtttgacatgcttacatctgcactgaaagatgacggtccgaagctaccctcttccgccgaagttctcgccgcgttacaagaggttgagggacttgatgaagacacaaaacttgagctttatgacatcctcacctctaatgcacacaagtttgagttgatgatggcactcccaatggaaaggaggaagaggtggcttatgatgcagctaaggaagtgagacagctta

SEQ ID NO: 2894 - DNA, 1390 bp, Zea mays
gagttggaacaaacgaacttaacgttataactttgttcggttacatcgaaggggagtgaagaggcccagagggggatcggagtcggagtggaaggggacaacccaacccgtgcctgactgccgttggccgttgccataccataggctatagcggctagcccatgacccttgtaaaaaaatactcctagtaatagcaaaacaaaaatcaggggcgaaaaggcgaaaaaacaattaattttccgagggaaaaccgcccggatcgctttaaatagcgccctcgcctcacagccctcccccattcctctccgccccctcccaccccaccccaccccacccgcaagcgaggcagcctaggacgcagcagcgcacccccgatcctcgcctgtcgcctccatctccattcgcaggcctgagaccctcgcccgcaccgcgctgccgccagccatgggaatggggcctctcgagaacgccgcgtcggccgctgagtccgcggccttgccggaggccggcgccgccgcggcagcgggctcgtacgcggtgctgcagtgcggcgaggactcggagtacgtgcggcagaagtacggcggctacttcgccgtcttccgcgcgctgctggaggaggacggcgagagctggcgcgtgtacggcgccgtccgcggggagctccccaccgacgccgaggcggccggcttcgacgggttcgtcatctccgggagctgctccgacgcgcacggcgacgagccctggatcctggacctcgtcggcctcatccgccgcctccacgccgccggcaagcgcatcctcggcgtctgcttcggccaccagatcctgtgccgggcgctgggcgggcgcaccgggcggtcgaccaagggctgggacatcggggtgagctgcatccacccgacggcggcggcggcgcggctgttcgcgccgctgaagctgccggtgcacatgccggtgatcgagttccaccacgacgaggtgtgggagctgcccgccggcgccgaggtgctggcgcggtcggaccagacccgcgtcgagatgttccgcctgggggaccgcgccatgggcgtccagggccacccggagtacagcaaggacatcctcatgagcatcgccgaccgcctcctccggcataaccacatcctggactgccaggtggacgtggccaaggcgagcttcgacgtgcggcagccggacaaggagctgtggaagaaggtgtgcaggggcttcctcaaggggaggctgcagtcgcagcagcaattccactaaccgctgcagaggaggaaattgggatgtcttaggttaatttttaattcacccttgttttgattgtgcttcagagctcaagagttgtacataaactactattgtccgaagcattaataaa

SEQ ID NO: 2895 - DNA, 1093 bp, Zea mays
attcctctccgccccctcccaccccaccccaccccacccgcaagcgaggcagcctaggacgcagcagcgcacccccgatcctcgcctgtcgcctccatctccattcgcaggcctgagaccctcgcccgcaccgcgctgccgccagccatgggaatggggcctctcgagaacgccgcgtcggccgctgagtccgcggccttgccggaggccggcgccgccgcggcagcgggctcgtacgcggtgctgcagtgcggcgaggactcggagtacgtgcggcagaagtacggcggctacttcgccgtcttccgcgcgctgctggaggaggacggcgagagctggcgcgtgtacggcgccgtccgcggggagctccccaccgacgccgaggcggccggcttcgacgggttcgtcatctccgggagctgctccgacgcgcacggcgacgagccctggatcctggacctcgtcggcctcatccgccgcctccacgccgccggcaagcgcatcctcggcgtctgcttcggccaccagatcctgtgccgggcgctgggcgggcgcaccgggcggtcgaccaagggctgggacatcggggtgagctgcatccacccgacggcggcggcggcgcggctgttcgcgccgctgaagctgccggtgcacatgccggtgatcgagttccaccacgacgaggtgtgggagctgcccgccggcgccgaggtgctggcgcggtcggaccagacccgcgtcgagatgttccgcctgggggaccgcgccatgggcgtccagggccacccggagtacagcaaggacatcctcatgagcatcgccgaccgcctcctccggcataaccacatcctggactgccaggtggacgtggccaaggcgagcttcgacgtgcggcagccggacaaggagctgtggaagaaggtgtgcaggggcttcctcaaggggaggctgcagtcgcagcagcaattccactaaccgctgcagaggaggaaattgggatgtcttaggttaatttttaattcacccttgttttgattgtgcttcagagctcaagagttgtacataaactactattgtccgaagcattaataaa

SEQ ID NO: 2896 - DNA, 1139 bp, Setaria italica
ctcccacctcgccacaagcgaatcagccacacccgcccgatccccgcctccgcctccattcccgggcccggagaccgcctcgccgcgccgccgccagccatgggaatggggccgctcgagagcgccgccgcggcggtcgcggccgtcccggtcgcggcggggtcgtacgcggtgctgcagtgcggcgatgactcggagtacgtgcgcaaggcgtacaacggctacttccaggtgttccgcgcgctgctggaggaggacggcgagacgtggcgcgtctaccgcgccctccgcggggagctccccaccgacgccgaggcggcgggcttcgacggcttcgtcatctcgggcagctgcgccgacgcccacggggacgagccatggatcctcgcgctcgtcgacctcatccgccgcctccacgccgccggcaagcgcatcctcggcgtctgcttcggccaccagctgctgtgccgggcgctgggcgggcgtacggggcggtcgaccaagggttgggacatcggggtgagctgcatccacccgacggcggcggcggcgaggctgttcgcgccgctgaagctgccggtgcacatgccggtgatcgagttccaccaggacgaggtgtgggagctgccccccaacgcggaggtgctggcgcggtcggacaagacccgcgtcgagatgttccgctacggggaccgcgtcatgggcgtccagggccaccccgagtacagcaaggacatcctcatgagcatcgctgaccgcctcctccagcgcagcctcatcctggactgccaggtggacgtggcgaaggcgagcttcgacgtgaggcagccggacaaggagctgtggaagaaggtgtgcaggggcttcctcaaggggaggctccagtcgcagcaggagcagcagcaggtggtggtgctatagcttactgctactgctacactagtttattgggaggggagggagcaagttaaagcggaggaaattgggagcatttggatgcctagattaattcaaccttattttgtgcttcagagctcagagttgtacaggtactactgcttgtccgaagcatcaataagagagaaaaatggttgttttttttatcaatccttggccccccagttcgttctcaaactgcc

SEQ ID NO: 2897 - DNA, 1043 bp, Brachypodium distachyon
cccgcccgatccctctcgccatgggaatggggccgctggagaacgccgcccccgccgccgccgacggcgccgcgccggtgatggcggcgccggcggtggtggcgaaggcggggtcgtacgcggtgctgcagtgcggggaggactcggagtacgtgcgcaaggcgtacgggggatacttcgaggtgttccgggcgctgctggcggaagaaggggagcgctggcaggtgtacaaggccgtgcgcggggagctccccggggaggccgaggcggccgggttcgacgggttcgtcatctccggcagctgcagcgacgcgcactcagacgagccgtggatcctcgcgctcgtcgacctcatccgccgccagcacgccgcggggaagcgcgtcctcggcgtctgctttggccaccaggtcctgtgccgtgcactgggcggcaagactgggagatcctgcaagggctgggacatcggcgtgagctgcatgcaccccaccgctgctgcggccaggctcttcgctcccctcaagctgcccgtccacatgcccatcatcgagttccaccaggacgaggtgtgggagctgcctcctggcgctgaggtgctggcccgttctgacaagaccagcgtcgagatgttccggctcggtgaccacgccatgggcgtccagggccaccctgagtacagcaaggacatcctcatgagcatcgctgaccgcctcctccagcgggacctcatcctggactgtcaggtggacgtggcgaaggcgagcttcgacgtgcggcagccggacaaggagctgtggaagaaggtgtgcaggggcttcctcaaggcgaggctccagtcgcagcagcagaagcaacataagttgctataggagtttacagtgagtgagcaactgaggaaagaggaggagaagagtagtagcattgagagagagggagttgtgagcgctaggttaatccttatttttctgcttcgagcgttgaccatcttgtacagaaacctatttattcgaagcattaataaaaaaaaattgggtgctttggcg

SEQ ID NO: 2898 - DNA, 1204 bp, Triticum aestivum
  misc_feature (345)..(345): n is a, c, g, or t
  misc_feature (351)..(351): n is a, c, g, or t
  misc_feature (354)..(354): n is a, c, g, or t
  misc_feature (356)..(356): n is a, c, g, or t
  misc_feature (402)..(402): n is a, c, g, or t
  misc_feature (429)..(429): n is a, c, g, or t
  misc_feature (435)..(435): n is a, c, g, or t
  misc_feature (447)..(447): n is a, c, g, or t
  misc_feature (561)..(561): n is a, c, g, or t
ttcggcacgagggccagccagccagcgagcgcaatccctagcgtcgacgcccattcccccgtccgcccgcccgcccttccccgcccattcctgccacgatccctcggccgcggtcgggtcgccatgggaatggggccgctcgagaacgccgcggccgtcgatggcgcgccggtggtgaccgcggcggcggcgggaggggggtcgtacgcgctgctgcagtgcggggaggactcggcgtacgtgcgggacgcgtacgggggctacttcgaggtgttccgcgcgctgctggccgaggacggggagcggtggcgggtgtaccgcgccgtgcgcggggagctgccgtcngacgangangnggccggcatcgacgggttcgtcatctccggcagctgcagcgacgcncacggcgacgagccctggatcctcgcnctcgtngacctcatccgncgccagctcgccgccggcaagcgcgtcctcggcgtctgcttcggccaccagatcctgtgccgggcgctgggcggcaagaccgggaggtcgtgcaaggggtgggacatcggcgtnagctgcatccaccccaccgccgcggcggcgaggctcttcgcgccgctcaagatgccggtgcacctgcccatcatcgagttccaccaggacgaggtgtgggagctgccagctcacgcggaggtgctggcccggtcggacaagaccggcgtggagatgttccggctgggcgaccgcgccatgggcgtccagggccaccccgagtacagcaaggacatcctcatgagcatcgccgaccgcctcctccgccagaacctcctcctggactgtcaggtggacgtggccaaggcgagcttcgacgtgcggcagccggacaaggagttctggaagaaggtgtgccggggcttcctcaagggcaggctccagccgcagcagcagcagcagccgaagcagcaacataaggtgcagctataggagtcggaggatgaaacggcggcagctccgacaagaaggcggtgccgccggaggaggaggaggagaaggacatagtagcgttactgagctgggggggttgcgattgcgagcctagaattaatccttatttttctgcttcggagcttgacattcaccatcatcatcatcatcatcatcttgtacagaaaccgcctatttattcgaagcattaataaacagcgatcgatgctaa

SEQ ID NO: 2899 - DNA, 989 bp, Pennisetum glaucum
ccgtcccggtcgcggcggcgcctgcggcggggtcgtacgcgctgctgcagtgcggcgaggactcggagtacgtgcgcaaggcgtacaacggctacttccaggtgttccgcgcgctgctggaggaggacggcgagacgtggcgcgcctaccgcgccatccgcggtgagctccccaccgacgccgaggcggccggcttcgacggcttcgtcatctccggcagctgcgccgatgcccacggcgacgagccgtggatcctcgcgctcgtcgacctcgtccgccgcctccacgccgccgggaagcgcatcctcggcgtctgcttcggccaccagctgctgtgccgtgcgctgggcgggcggacggggcggtcgaccaaggggtgggacatcggggtgagctgcatccacccgacgtctgcggcggcgaggctgttcgcgccgctgaagctgccggtgcacatgccggtgatcgagttccaccaggacgaggtgtgggagctcccgcccaacgcagaggtgctggcgcggtcggacaagacccgcgtcgagatgttccgctacggggacggcgtcatgggcgtccagggccacccggagtacagcaaggacatcctcatgagcatcgccgaccgcctcctccagcgcagcctcatcctggactgccaggtggacgtggcgaaggcgagcttcgacgtgaggcagccggacaaggagctgtggaagaaggtgtgcaggggcttcctcaaggggaggctccagtcgcagcagcagcaggaggtggtggtggtggcgctatagcaagcatactgctactgctacactagttttactggaaggggagggagaaagttaaaagcggaggaaattgggatcattgggatgcctagaattaatccatccttattttgtgcttcagagctcagaggttgtacaggaactactgcttgtccgaagcatcaataagagataaaaaaatatggttggttgtttttt

SEQ ID NO: 2900 - DNA, 1281 bp, Avena sativa
cgaatttgtttaacccgagaaacacaatccctagccccgctcgccgttccccctgtcccgtctctccgctcccattcccccggcccgatcgtcgctcgcgctgacgccatgggaatggggccccagctggagaacgccgccgcctcggcggtcgcggtcgcggtgccaccggctacggcgcctgcgcctgcgatgatcccggcggcagcggcagcggcagggtcgtacgcgttgctgcagtgcggggaggactcggcgtacgtgcgcgacgcgtacgggggctacttcaacgtgttccgggcgctgctggaggaggacggggagcggtggcgcgtgtaccgcgccgtgcgcggggagctcccctcggacgccgaggccgcggcgctggacgggttcgtcatctcgggcagctgcagcgacgcgcacggcgacgagccgtggatcctcgcgctcgtcgacctcatccgacgcgcgcacgccgcagggaagcgcatcctcggcgtctgcttcggccaccagatcctgtgccgtgcgctgggaggaaggaccgggaggtcgaccaagggctgggacatcggcgtcagctgcatgcaccccactgccgccgcggcgaggctcttcgcgccgctcaagctgccggtgcacatgcccatcatcgagttccaccacgacgaggtgtgggatctgccccctcatgccgaggtgcttgctaggtcagacaagaccggcgtggagatgttccggctcggcgaccgcgccatgggcgtccaaggccatcccgagtacagcaaggacatcctcatgagcatcgctgaccgcctcctccagcacaacctcatcctggactgccaggtggacgtggcgaaggcgagcttcgacgtgcggacgccggacaaggagctatggaagaaggtgtgcaggggtttcctcaagggcaggctccagtctcagcagcagcagccgcagccacaacagcagaagcaacataataagctgctataggagggaggaggggcattcagccagcggcaactgatagcgttattgagagtgggagggggtttatgagcctagaattaattaatcctttatttttctgctgcgggcaccttaaccatctttgtacagaaatatttatccccggcattaataaagaggaggaaatgggtactaatttgctagtctcctctcatctcgtttctgtcagttaactgtagttttcccttctcccgaacttgaatccccgcatgttcttttccaaaagagaagggtattaccaag

SEQ ID NO: 2901 - DNA, 1215 bp, Hordeum vulgare
agcgagccaatttagccagccagccagccagcgagcgagcgcaatcccgtccgtcgcccaatcccattccccgatccctcctcctcggcgctcgctcgctcgctcgctcgccgacgccgcggtcggcatggggatggggccgctggagaccgccgtcgaggctggccgcgccgccgcgccggtgccggtggtgaccgcggcgggaggggggacgtacgcgctgctgcagtgcggggaggactcggcgtacgtgcgggacgcgtacgggggctacttcgaggtgttccgcgcgctgctggcggaggacggggagcggtggcgggtgtaccgcgccgtgcgcggggagctgccgtccgacgaggacgcggcgggggtcgacggcttcgtcatctccggcagctgcagcgacgcgcacggcgacgagccgtggatcctcgccctcgtcgacctcgtccgccgccagctcgccgccggcaagcgcgtcctcggcgtctgcttcggccaccaggtcctgtgccgggcgctgggcggaaagacggggaggtcgtgcaaggggtgggacatcggcgtgagctgcatccaccccaccgccgcggcggcgaggctcttcgcgccgctcaagatgccggtgcacctgcccatcatcgagttccaccaggacgaggtgtgggagctgcctcctcacgccgaggtgctggcccggtcggacaagaccggcgtggagatgttccggctcggcgaccgcgccatgggcgtccagggccaccccgagtacagcaaggacatcctcatgagcatcgccgaccgcctcctccgccagaacctcctcctgggctgtcaggtggacgtggccaaggcgagcttcgacgtgcggcagccggacaaggagttctggaagaaggtgtgcaggggcttcctcaagggcaggctccagccgcagcagcagcagcagaagcagcaacataagctgcagctataggagttggagcaggaggaggaggagacggcggcgggtctgagaaggaggccgtcgccgccgccggaggaggaggaggaggacatagtagcgttactgagctggaggggattgttattgcgagcctagaattaatccttatttttctgcttcgaagcttgacaccatccaccatcatcatcttgtacagaaaaccgcctatttattcgaagcattttaataaagagcgatcgggtgct

SEQ ID NO: 2902 - DNA, 1244 bp, Triticum aestivum
gccagcgcgatccctagcgtcgaggcccattcccccccgcccgcccattccacgatccctcggccgcggtcgggtcgccatgggaatggggccgctcgagaacgccgcggccgtcgatggcgcgccggtggtgaccgcggcggcggcgggaggggggtcgtacgcgctgctgcagtgcggggaggactcggcgtacgtgcgggacgcgtacgggggctacttcgaggtgttccgcgcgctgctggcggaggacggggagcggtggcgggtgtaccgcgccgtgcgcggggagctgccgtcggacgaggaggtggccggcatcgacgggttcgtcatctccggcagctgcagcgacgcccacggcgacgagccctggatcctcgcgctcgtggacctcatccgccgccagctcgccgccggcaagcgcgtcctcggcgtctgcttcggccaccagatcctgtgccgggcgctgggcggcaagaccgggaggtcgtgcaaggggtgggacatcggcgtcagctgcatccaccccaccgccgcggcggcgaggctcttcgcgccgctcaagatgccggtgcacctgcccatcatcgagttccaccaggacgaggtgtgggagctgccagctcacgcggaggtgctggcccggtcggacaagaccggcgtggagatgttccggctgggcgaccgcgccatgggcgtccagggccaccccgagtacagcaaggacatcctcatgagcatcgccgaccgcctcctccgccagaacctcctcctggactgtcaggtggacgtggccaaggcgagcttcgacgtgcggcagccggacaaggagttctggaagaaggtgtgcagggggttcctcaagggcaggctccagccgcagcagcagcagcagccgaagcagcaacataagctgcagctataggagtcggaggatgagacggcggcgagtccgagaagaaggccgtcaccggtgccgccggaggaggaggaggaggaggacatagtagcgttactgagctgggggggttgccattgcgagcgtagaattaatccttatttttctgcttcggagtttgacatcaccatcatcatcttgtacagaaacccaaaccgcctatctaatcgaagcattaataaagagcgatcgatgctaaaaaaaaaaaaaaaaaaaactcgaactagccggcaggcccgcggcgaggatccgggtcccccggccgtcctccgcttccgtccag

SEQ ID NO: 2903 - DNA, 3821 bp, Brachypodium distachyon
cggctgcggaggccaccatggaggacgtgtgcgaggggaaggacttctccttcccggcggaggaggagcgcgtcctcaagctgtgggcggagctggacgccttccacgagcagctccggcgcacggagggcggcgaggagttcatcttctacgacggtccccctttcgccacgggcctcccccactacggccacatcctcgccggcaccatcaaggacgtggtcacgcgccaccagtccatgcgcggccgccacgtcgcgcgccgcttcggctgggactgccacggcctccccgtcgagttcgagatcgacaagcagctcggcatcaccaaccgccagcaggtgctcgactacggcatcgccaggtacaacgaggcctgccgcagcatcgtcaccaagtacgtcaaggagtgggaggccgtcgtcacgcgcacggggaggtggattgacttcaaggccgattacaagaccatggacatcaacttcatggagagcgtctggtgggtcttcgggcagctctgggccaaggacctcgtgtacaagggcttcaaggtgatgccttacagcactggttgcaaaactgctctgtcaaacttcgaggcaggactggactataggactgttccagacccagcagtgatggtgtctttccctgttgtcagtgatgttgacaatgcagctctcgttgcctggactacgacgccttggacactcccaagcaacctagcattgtgtgtcaatgccaatcttgtgtattctaaggttaaggacaagtccaatggaacagtatacattgtcgcagaaagtaggcttggccagttgccagttaaagccaaagcttctggaaagaagcaagctcctcctaagggaagcacccctgatggtggtcagggtggtttggacactgaatcatatgaattattggcaaagtttcctggatcatgcttagtaggcctaaaatacactcctctgtttgattttttcctggagtttaaagagactgcgtttagggtgattgcggataactatgtaactgatgacagtggaactggtgttgtccattgtgctcctgcatttggtgaagatgatcatcgtgtttgccttgctgctgggataattgaggccagtggacttgttgtcgctgttgatgatgatggttgctttatcgaaaagataactgagttcagagggcggcatgtcaaagaggctgacaaggatatcatcagcgctgttaaggataagggaagacttgttagtaaagggagcatcgagcactcttatccattttgttggcgctcgggtactcctcttatctaccgggctgttccaagctggtttatcaaggttgaaaagattagagatcagttactggaatgtaacaaggagacctactgggttccagattatgtcaaggaaaagagattccataactggctagaaggtgctagggactgggctgttagcagaagtagattctggggtactccacttccagtgtggatcagccaagatggtgaagaaattgtagtcatggattccatcgagaaacttgaaaaattatctggtgtcaaggttaccgatcttcatcgccaccatattgatgatattacgattccctctagcagaggaccagagtttggggtgctcaaacgtgttgaggatgttttcgactgctggtttgagagcgggtctatgccatatgcctacattcattatccatttgagaaccgggaactatttgagaagaattttcctggcaattttgtggcagagggcttagatcaaacacgcggatggttttacactttgatggtgttatcaacagcattatttgggaagcctgcttttaagaatcttatatgcaatggtcttgttttggccgaggatggtaagaaaatgagcaagagcaaacagaattacccttcacccgtaggggtcattaatgaatatggagcggatgctttgaggctgtatttagtaaattctccagttgtgcgtgcagaatctctacgatttaaaaggataggtgtttatggtgttgtgaaagatgtctttctcccgtggtataatgcttatagattccttgtccaaaacacaaagagacttgaagttgagggtcttgcagcattttctccaattgaccaagattcacttcggaagtcatctaatgtgttagatcactggatacactctgcaactgaaagtctggttagctttgttcatcaggagatggatgcatatcggctttacacggttgtgccatatttggtaaaatacatcgataatcttaccaatatatatgtgcggttcaaccgcaaacggttaaaaggacgcactggagaagaagactgcagaatttctctttcaactctgtaccatgcactcgtgacaacttgtgtggtgatggctccatttacgcccttctttactgaagctctttatcaaaatctgcgaaaggtgtcgagtaaatcagaggagagcattcacttttgcactttcccttccaccactggggagagagatgagcgtgttgaacaaagtgtaaataggatgatgaccatcattgatcttgcgcgcaatattcgggaacggcatagcaaagctctcaaaacgccactgaaggagatggtggttgttcatcccgacaatgaatttcttgaagacatcactggcaaactaaaagagtatgtcatggaggagatgaatgtcaagactgttactccatgtaatgatcccatgatgtatgcttctctacgggcagaacccaattttagtgtgctaggcaaaagactgggaaaagacatgggcaaagtgtccaatgaagtgaagaaaatgtctcaggaacaaatcttggcatttgagcaaagcggagagatttcgttccatggtcattgcttgaagctagatgacattaaggtggttcgacagttcaagcgtcctgcagatgtgtcagagaaggaaattgatgccgcaggagatggtgacgtgttagtcattttggatcttagagccgatcaatcgttgttcgaagctggcatggcccgagaggttgtaaacaaaatccagaaattgcggaagactgctcagctagaacctacagatttaattgatgtatactacaaatctgtgaacgacgacagcaatgcactcgaagaaattgtgcagtcgcaggatcagtatattagggacgtgcttggtaattccctagttccaaaggcaatggcaccatcagatatggttgtcatgtgcgaggagtctcacattgtacatgacatgtcgtttgtcatctacattgcaaggtgcatccctgtgctcacacctgagctccttccccatgcctcaggcaacagtgaccatgttgatgcgttaagggtgtatttgttgtcaagatccatttacagattgaagaacgaattccagactggaaatggcaagattactgtcaagtgcattgaaggctacccaccaattgatctgcatctaggaaaacatgtttttcttagtgcaggtgatttctatcaggctaatcgttcttgattctcaagcatcccaattttgagtggtttgtaattttgaaccgcaatacttctaatcatgctgatcctatttgtggctcacaaaagcaaacgtgtttacattcatctgttgccaaccatggaaaggagatgaaattgtcgagtgtgtattagtggtaaattttcatgtattactatagcttacttatattttgacacattagctaaatgtgcagaaaatagctgctaaatcagttgttcaatttagcaatacaagttgttgtgtccagctattgcgaggacttca

SEQ ID NO: 2904 - DNA, 4074 bp, Sorghum bicolor
attcggaccgtcagtagcacgtcagctgacctctaaaccctcgtcttcccgtcccaaacgtccatcccctgcctttcgccgccgccgcaccatcgcccgaaaccctaaccccttcgccgcctcgctcggaatcccagcccccttcggcgccgccgcgaccgccggagcggaggccatggacgacgtgtgcgaggggaaggacttctccttcccgcagcaggaggagcgggtgctccagctgtgggcgaagctcgacgccttccacgagcagctccggcgcacggagggcggtgaggagttcgtcttctacgacgggccccccttcgccacgggcctgccccactacggccacatactcgccggcaccatcaaggacgtcgtcacccggcaccagtcgatgcggggccgccacgtctcgcgacgcttcgggtgggactgtcacggactccccgtcgagttcgagatcgacaaggcgctcggcatcaccaaccggcagcaggtgttcgacctcggcattggcaagtacaacgagacgtgccgcagcatcgtcaccaagtacgtctccgagtgggaggccatggtcacgcgcacggggaggtggattgacttcaagaacgactacaagaccatggacatcaacttcatggagagcgtctggtgggtgtttgcccagctctgggagaaggacctcgtctataagggcttcaaggtcatgccttacagcacaggatgcaaaactgcactgtcaaactttgaggcagcactggactataggactgttcctgacccagcggtgatggtatccttccctattgttggtgatgcggacaatgcagctcttgttgcatggactacaacaccctggacacttccaagtaacctagcgctgtgtgtcaatgccaatctcacgtatgcaaaggttaaagacaaatcaaatggagcagtatatgttattgcagaatctaggcttgggcagttgccagttaaggcgaaatcttcaggaaagaagcaggcaccttcaaagggaggcaatgctgaagctgttcaggatggtttggacaaggaatcatatgagctgttggcaaagattcctggggcatccttggttggcttaaaatatactcctctattcgattttttcattgaacttcaagagactgcatttagagtgattgcggataactatgtcacggatgatagtggaacgggtgttgtccattgtgctcctgcttttggtgaagacgaccatcgtgtttgccttgctgctgggatatttgagactgctggacttgttgttgctgttgatgacgacgggtgctttattgaaaaaatatctgtttttaaagggcgatatgtcaaagaagccgacaaggatatcatcaatgctgataaaggaagactcgttagtaaagggagtattgagcactcttatccattttgttggcgatcgggaactcctcttatttatcgggctgtcccaagctggtttgtcaaggttgagaagattaaggaccagttgctggaatgtaacaaggagacttactgggtgcctgactatgttaaggaaaaaagatttcacaactggcttgaaggagcacgtgattgggctgttagcagaagtagattctggggtactccacttccactgtggataagtcaagatggtgaagaaattgttgttattgattctatcgagaagcttgaaaaattatctggagtcaaggtcactgatcttcatcgacactatgttgatgatattacaattccctctaagagaggacctgagtttggggtgctcaaacgtgttgatgatgtttttgactgctggttcgagagtgggtcaatgccatatgcctacattcactatccatttgagaatcgggaactatttgaaaagaactttcctggcaattttgtggcagagggtttggatcaaacccgtggatggttctatactttgatggttctctcaacagcactgtttgggaagcctgcatttaagaatcttatatgcaatggccttgtcttggctgaggatggtaagaaaatgagcaagagtaaaaagaactatcctccacccaaagatctcattgacgagtttggagcggattctctgcgactatatttggtaaactctccagttgtacgtgcagagtctctacgattcaaacgtgctggtgtctttgctgttgtgaaagatgtcttcctgccatggtataatgcgtacagattctttgtccaaaatgcaaagagactggaatttgagggtcttgcctcattttctccgatggaacaagcagtacttctgaagtcatccaatgtgttggatcactggataaactctgcaactgaaagtcttgttagctttgttcaccaggagatggatgcatatcggctttacacggttgtgccatatttggtaaaatacattgactatcttactaacatatatgtgcgtttgaaccgcaaacggttcaaaggacgtactggagaagaagactgcagaatttctctttcaacactctaccatgttcttgtaacaacttgtgtggtgatggctccatttacaccattctttactgaagttctttatcaaaatttgcggaaggtgtcaagtaaatctgaggagagcattcacttctgcaagttcccttccacaactggcgagagagatgagcgtgttgagcaaagtgtaaataggatggtgaccatcattgatcttgcacgtaatattcgtgagcggcataacaaagctctcaaaacaccactcaaggagatggtggttgtgcatccagacaatgactttcttgaagacatcactggcaaactaaaagagtatgtcatggaggaaatcaatgttaagactgtcactccatgtaatgaccccttggtgtacgcttctctgcgagccgagcctaatttcagcgtgctaggaaaaagacttggaaaagacatgggcaaagtatcaaatgtggtgaagaagatgactcaggaagagatcttagcctttgaaaaaagtggagagatttcattctttggtcattgcttgaagctagatgatatcaaggtcgtccgacaattcaagcgtcctgaaaatgtgtcagagaaggagattgatgctgcaggagatggtgatgttttagtcattttagatctacgagctgaccagtcattgtttgaagctggagtggcccgagaggttgtgaacaggatccagaaattgcggaagactgctcagcttgaacctgctgatccagttgatgtgtattatgaatctgtgggtaatgacaaaaacacactgggagagattttgaagtcacaggatcagtatatcagaggcgcacttggttcaccaattgttccaaaggaaatagcaccaacagatgttgtagtacttggcgaggagtcgcacaatgtacacgacatgtcatttgtcatatgcattgcaaggtccaccccaattctttcaccagatcttctttctcatgcctcaggcaacagcaatcatgtggaggcattgagagtatatcttctgtcaaggtctctttccagattgaagaacgatttccaaagtggaaatggcatgattacggtcgacagcattgaaggttatccaccaatcagcttacagctaggaaagcatgtttttctaagtgcaggggatttttatctggctactcgatcctaatttcgtttgcagcaccccaattttgactgattcacccattattttgtcgcaatcagcttgaacagcttggttccatttatacatggcaccaaagtcatgtattcacattcatcagttaaaggttgaaaaatctcaatgtatgctataccatgatatgcatctgtgccccctgggcacatgtgaattttcaaataccaggctatgggcttccatacgtatggtgaattatgagcagatagcatgtttacaagtctcttgggtgtttggtttttgaggatctgtggggtccatcagactttgatgaatgaatccattgcattctacaaaccgacgagtggtaagacgaaaggccactcagtttctcaaaccaagctcctctcccaaag

SEQ ID NO: 2905 - DNA, 4093 bp, Zea mays
gtagcacgtgagcatagcttcagctggccactaaaccctcgtcttccccttccaagcgaatcccattccctacctttcgccgccgcctacgcaccatcgctcgaaaccctagccccattccccgtctcgctcggaatcccagctacctccagcgccgccgcgactgcaggataggaggccatggacgacgtgtgcgaggggaaggacttctccttcccggagcaggaggagggggtgatcgagctgtgggcgaagctcgacgccttccacgagcagctccggcgcacggagggcggcgaggagttcgtattctacgacggtccccccttcgccacgggcctgccccattacggccacatactcgccggtaccatcaaggacgtggtcacccggcaccagtcgatgcgaggccgccacgtctcgcgacggttcggatgggactgtcacggactccccgtcgagttcgagatcgataaggcgctcggcatcaccaaccggcagcaggtgttcgacctcggcatcggcaagtacaacgagacgtgccgcagcatcgtcaccaagtacgtctccgagtgggaggccatggttacacgcacggggaggtggattgacttcaagaacgactacaaaaccatggacctcaacttcatggagagcgtctggtgggtgtttgcccagctatgggagaaggacctcgtctataggggtttcaaggtcatgccttacagcacaggatgcaaaactgcactgtcaaactttgaggcagcactggactataggactgttcctgacccagcggtgatggtatccttccctattgttggcgatgcggacaatgcagctcttgttgcatggactacaacaccctggacacttccaagtaacctagcgctgtgtgtcaatgccaatcttacatatgcaaaggttaaagacaaatcaaatggagcagtatatgttattgcagaatccaggcttgggcagttaccagttaaggccaaagcttcaggaaagaagcaggcaccttcaaagggaagcaatattgaagctgttcaggatggtttggacaaggaatcatatgagctgttgtcaaagattcctggggtatccttggttggcttaaaatatactcctctatttgactttttcattgaacttcaagggactgcctttagagtgattgcggataactatgtcacggatgatagtggaacgggtgttgttcattgtgctcctgcttttggtgaagacgaccatcgtgtttgccttgctgctgggatatttgagactgctggacttgttgttgctgttgatgacgacggatgttttattgaaaaaatatctgattttaaagggcgatatgtcaaagaagccgacaaggatatcatcaatgctgttaaggataaaggaagactcattagtaaagggagtattgagcactcttatccattttgttggcgatcgggcactcctcttatttatcgggctgttccaagctggtttgtcaaggttgagaagattaaagaccagttgctggaatgtaacaaggagacttactgggtgcctgactatgttaaggaaaaaagatttcacaactggcttgaaggtgctcgtgattgggctgttagcagaagtagattctggggtactccacttccactgtggataagtcaagatggtgaagaaattgttgttatggattctatagagaagcttgaaaaattatctggagtcaaggtcactgatcttcaccgacactatgttgatgatattacaattccctctaagagaggacctgagtttggggtgctcaaacgtgttgatgatgttttcgactgctggttcgagagtgggtcaatgccatatgcctacattcactatccatttgagaatcgggaactatttgaaaagaactttcctggcaattttgtggcagagggtttagatcaaacccgtggatggttctatactctgatggttctctcaacagcactgtttgggaagcctgcatttaagaatcttatatgcaatgggcttgtcttggctgaggatggtaagaaaatgagcaagagtaaaaagaactatcctccacccaaggatctcattgatgagtttggagcggatgctctgcgactatatttggtaaactccccagttgtacgtgcagagtctctacgattcaaacgtactggtgtctttgctgttgtgaaagatgtcttcctcccatggtataacgcatatagattttttgtccaaaatgcaaagagactggaagttgagggtcttgcctcattttctccgatggaacaagtggtacttctgaagtcatccaatgtgttggatcactggataaactctgcaactgaaagtctagttagctttgttcaccaggagatggatgcatatcggctttacacggttgtgccgtatttggtaaaatacattgactatcttactaacatatatgtgcgtttgaaccgcaaacggttcaaagggcgtactggagaagaagactgcagaatttctctttcaacactctaccatgttcttgtaacaacttgcgtggtgatggctccatttacaccattctttactgaagttctttatcaaaatttgcggaaggtgtcaagtaattctgaggagagcatccacttttgcaagttcccttccacaactggcgagagagatgagcgtgttgagcaaagtgtaaagaggatggtgaccataattgatcttgcacgtaatattcgtgagcggcataacaaagctctcaaaacaccactcaaggaaatggtggttgtgcatccagacaatgacttccttgaagacatcactggcaaactaaaggagtatgtcatggaggaaatcaatgttaagaatgtcactccatgtaatgaccccttgatgtatgcttctctgcgagccgagcctaatttcagcgtgctaggaaaaagacttggaaaagacatgggaaaagtatcaaatgtggtgaagaagatgactcaggagcagatcttagcatttgaaaaaagtggagaggtttcattcttcggccattgcttgaagctagatgatatcaaggttgtccgacaattcaagcgtcctgaaaatgtgtcagagaaggagattgatgctgcaggagatggtgatgttttagtcattttggatctacgaaccgaccagtcattgtttgaagctggagtggctcgagaggttgtgaacaggatccagaaattacgaaagactgctcagcttgaacctgctgatccagttgatgtgtattacgaatctgtgggcaatgacaaaaacactctggaagagatattgaagtcacaggatcagtatattagagacgcacttggctcaccaatcgttccaaaggaaatggcaccaacagatgtcgtagtacttggcgaggaatcgcacaacgtacatgacatgtcatttgtcatatgcatcgcaaggtccaccccgattatttcaccagatcttctttctcatgcctcaggcaacagcaatcatgtcgaggcgttgagagtatatcttctgtcaaaatctctatccagattgaagaaccagttccaaagtggaaatggcgtgattacggtcgactgcatcgaaggttatccactaatcaggttacagctaggaaagcatgtttttctaagtgcaggggatttttatctggctagtcgatcctaatttttgtgtgcagcatcccaattttgactgattcacccatcattttgccgcaatcggcttaaacagcttggttccatttatgcattcagattcacttgttaaaggtgaaaaatcccaatttatgatataccatggtactctccgttctttttttatttgtcgtgttttagttcaaaaatgaactagccggtgacaaatatttttttttattttgtcgtgttttagttcaaaaataattagccggtgacaaatattcgagtaagctataggttcccatacccctagtgaattatgagtagataacatgtatgtttgtaatctcttgggtgtttggtttttgaggattgatgtggtccatcagattttgatgaatgaatgcatttcattttacaaa

SEQ ID NO: 2906 - DNA, 3940 bp, Zea mays
ggttgcattcggaccgtccgtagcgcccagctgacctctaaacccttgtctccctcccccaagtgaatccgtgttgtacctctcgccgccgccgtaccatcgcccgaaatcctagccccattcaccgcctcgctcggaatccaagccccattcggcgccgccgcgaccgccggacaggaggtcatggacgacgtgtgcgaggggaaggacttctccttcccggagcaggaggagcgggtactcgagctgtgggcgaagctcgacgccttccacgagcagctccggcgcacggagggcggtgaggagttcgtcttctatgacggcccccccttcgccactggtctgccccactacggccacatactcgccggcaccatcaaggacgtggtcacccggcaccagtcgatgcggggccgccatgtctcgcgacggttcgggtgggactgtcacggcctccccgtcgagtttgagatcgacaagctgctcggcatcaccaaccggcagcaggtgttcgacctcggcatcggcaagtacaacgagacgtgccgcagcatcgtcaccaagtacgtctctgagtgggaggccatggtcacacgtacggggaggtggattgacttcaagaacgactacaagaccatggacctcaacttcatggagagcgtctggtgggtgtttgcgcagctctgggagaaggacctcgtctataagggcttcaaggtcatgccttacagcacaggatgcaaaactgcactgtcaaactttgaggcagcactggactataggactgttcctgacccagcggtgatggtatccttccctattgttggtgatatggacaatgcagcttttgttgcatggactacaacaccctggacacttccaagtaacctagcgctgtgtatcaatgccaatctcatgtatgcaaaggttagagacaagtcaaatggaaaagtatatgttattgcagaatctaggcttgggcagttaccagttaaggccaaagcttcaggaaagaagcaggcaccttcaaagggaagcaatgctgaagctgctcaggatggtttggataaggaatcatatgagctgctggtaaagattcctgggccatatttggttggcttaaaatatactcccctatttgattttttcattgaactacaagagactgcctttagagtgattgcggataactatgtcaccgatgatagtggaactggcgttgtccattgtgctcctgcatttggtgaagacgaccatcgtgtttgccttgctgctgggatatttgagactgctggacttgttgtcgctgttgatgatgatgggtgctttattgaaaaaatatctgattttaaagggcgatatgtcaaagaagctgacaaggatatcatcagtgctgataaaggaagacttgttagtaaagggagcattgaacactcttatccattttgttggcgatcgggtactcctcttatttatcgggctgttccaagctggtttgtcaaggttgagaagattaaagaccaattgctggaatgtaacaaggagacttactgggtgcctgactatgttaaggaaaaaagatttcacaactggcttgaaggtgcacgtgattgggccattagcagaagtagattctggggtactccacttccactgtggatgagtcaagatcgtaaagaaattgttgttatggattctatcgaaaagcttgaaaaattatctggagtcaaggtcactgatcttcaccgacactatgttgatgatattacaattccctctaagaggggacccaagtttgggacgctcaaacgtgttgatgatgtttttgactgctggtttgagagtggatcaatgccatatgcctacattcactatccatttgagaatcgagagctatttgaaaagaattttcctgggaattttgtggcagagggtttggatcaaacccgtggatggttttatactctgatggttctctcgacggcactgtttgggaagcctgcatttaagaatcttatatgcaatggccttgtcttggctgaggatggtaagaaaatgagtaagagtaaaaagaactatccttcaccaaaagatctcattgacgagtttggagcggattctctgcgtctatatttggtaaactctccagttgtacgtgcagagtctctacgattcaaacgtactggtgtctttgctgttgtgaaagatgtcttcctcccatggtataatgcgtacagattctttgtccaaaatgcaaagagactggaagtcgagggtcttgcctcattttctccgatggaacaagcggtacttctgaagtcatccaatgtgttggatcactggataaactcagcaactgaaagtctagttagctttgttcaccaggagatggatgcatatcgtctttacacggttgtgccatatttggtaaaatacattgactatcttactaacatatatgtgcgcttgaaccgcaaacggttcaaaggacgtactggagaagaagactgcagaatttctctctcaacactctaccatgttctcgtaacaacttgcgtggtgatggctccatttacaccattctttactgaagttctttatcaaaatttgcggaaggtatcaagtaaatctgaggagagcattcacttctgcaagttcccttccacaactggtgagagagatgagcgtgttgagcaaagtgtaaataggatggtgaccatcattgatcttgcacgtaatattcgtgagcggcataacaaagctctcaaaacaccactcaaggagatggtggttgtgcatccagacaatgactttcttgaagacataactggtaaactaaaagagtatgtcatggaggaaatcaatgttaagactgtcactccatgcaatgaccccttgatgtatgcttctctgcgagctgaacctaatttcagtgtgctgggaaaaagacttggaaaggacatgggcaaagtatcaaatgtggtgaagaagatgactcaggaacagatcttagacttcgaaaaaagtggagagatttcattcttcggtcattgcttgaagctagatgatattaaggttgtccgacaattcaagcgtcctgaaaacgtgtcggagaaggagattgatgctgcaggagatggcgacgttttagtcattttagatctacgagctgaccagtcattgtttgaagctggagtggctcgagaggttgtgaacaggatccaaaaattacggaagactgctcagcttgaacctgctgatccagttgatgtgtattacgaatctgtgggcagtgacaaaaacacactggaagagattttgaagtcacaggatcagtatattagggacgcacttggttcaccaattatgccaaaagaaatggcaccaacagatgatgtaatacttggcgaggagtctcacaatgtacatgacatgtcatttgtcatatgcattgcaaggtccacccctattcttgcaccagatcttctttctcatgcctcaggcaaaagcaatcatgtggaggcgttgagagtatatcttctgtcaaggtctctttccagattgaagaaccagttccaagctggaaagggcatgattacagttgactgcatcgaaggttatccaccggtcagtttactgctaggaaagcacgttttcctaagtgcaggggatttttatctggctagtcgatcctagtttcgtttgctgcatcccaattttgagctgcttcacccattgttttgccgcaatcagcttaaaacagcttggttccatttatgcatctcaccaaagtcatgtattcagtaaaggtgaaagtctcaatgtatgctaatatgctatagcatgacatgtaagctaagattttcaaatacctggctatgggttcccataggtgatagcatgtttgtttgcaatctcttggttttcgacgttttttttt

SEQ ID NO: 2907 - DNA, 4011 bp, Zea mays
gtggacaacaagtaacagcgccggctggccgtgtccgtcgctgctgctgctgctgtgaggaagacgagagcacagggcaaacggaggagaaggagaaggagaaggcggccgacctcttctccgtcttcaaccttgcgccgcgtccagcgcgtaggtgaggagccgagtttagtagagtactctactaaacaaacaagcaaagcaaggccgacgaatcgagggagagggaggaagcaggccagcacggggtacgccgaggcacagaacaaccgacagggtatttactccccccgcccttgtctcgcccccatttctcgccctttcacttccatcgctcccctcctcctctccgattctctccgcttcctccaaacttttccctttcctacacctctcgctaaatcctcttcctctcatcctgtactcgccctgccatgcttcgccgtggattttaaccgcttgcttctattcggaggaacacagtcatcaggcgagccagccagggacgggagtaagagagaaggggttcttccatttatttttttcctctcggttgatctgccgcgccggccggtcgaggaagggaggaagaagtatgtttggggactgccaggtcctatcctcgatggccgcggtggccggggcctcctcgtcggcggacacgctcttcatccccaacccaggcgccctcgccgggttcatgtcctcctcctccgccgccgccgccatgccattccaccatttctccaccaccgccgcctccctcgtaccaaaggaggagggcggcatcatgggtgcgctccaggtggccaaggacgaggacatggatcagctggagatggagatggagctcagcggcggctccgggagcggccacctggacggcctgctcagcttcgccgacgtggacgacgaccggccggagcagaagccgcagcacagcggcctcgagctccagacgacggcggatgccgccggacagcagcagcagctggccaccgccaacggcaagaagaaacggtaccaccgccacacggcacaccagatccagcagatggaagcgctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgacaactaccgtctgcaggccgccatccgcaacgtagtctgccccaactgcggccacgccgccgtcctcggcgagatgtcgtacgaggagcagcagctccgcatcgaaaacgctaggctcaaggacgagctcgaccgcttggcgtgcatcgcgacccggtacggcggcggccgacagccgagcatgtcgtcgtccgcgctggtctgcttatcggcgccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccgggggcgccgagcaccacgcctccacgccgtcgttcatgggcgccatggcgcctgtccaggagcaggacaggcagctggtgctcgacctcgccgccgcggccgcagacaccctcgccaagatgtgccgcgcgggcgagtcgctctggctgcggcgccgtggcgcgagctccgaggtcatggtagccgacgagcacgcccggatgttcagctggcctgtcaacggcggccagcaggatagcagtgcctcccctggcggcgccgcggccaggaccgagggatcaagggacggcaccgtggttatcatgaacagcatcacgctggtggatgccttcctggacgctaacaagtggatggagctgttcccttcgatcgtatccaaggcaagaaccattcagatcataaaccatggagctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccctcgtcgacttcccggccgaggggttccagctggaggcactgcaaaccccatctgttgtaaggtgctgtaggcgcccctccggttgcatcatccaggacatgcccaatggctactctagcgtggtgtgggtggagcacacggagattgttggagaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggagtgatccgcacaccagaggcgagaacaaatatgatgaagctgtcacagcggatgatcactagtttctctgccaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcagcttgagattatgtcaagcgggggctcacttcacgaagtggcacatattgcaaatggatcacacccaaagaattgcatttctcttcttagaatcaatgctgcaagcaactcatcccagaacgtggagctcatgctgcaggagagcagcacccaccccgacggcgggagcctcgtggtgtttgcgaccgtggacgtggacgccatccaagtgacaatgagcggcgaggacccttcctacatccctctcctcccgctgggcttcgccatcttcccggccgccaacccttcggctgcagcaaccagcgccgcaggctccggcgacggccaaagcagcccagcaggtaacgccgacgagcccgccagcggctgcctcctcaccgtgggcatgcaggtgctcgctagcgctgtgccctcggctaagctgaacctctcgagcgtgaccgcgatcaacagccacgtctgcaacgccgtccaccagatcacagccgcgctcaagggcgctggggcgagcggggccgctgaaccggcggctgctgcctccgagtagtagcaagagcgggagcagaggagagcagatccatacaccacaacaaaagccaaattgccttccaggtccggttgtttctgctgacagacatcccagtgcaagagagggtttgacaggagcccgaaaccaacacacggaaagttcaaaaaccccccttctctttcccgccatatgcctcttaaaatgacaaaaatacccctgaccgaacgaagagaatggtgggggcattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgatttttgtaataataataagacgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgtttttatcatgcgtgttttg

SEQ ID NO: 2908 - DNA, 4011 bp, Zea mays
gtggacaacaagtaacagcgccggctggccgtgtccgtcgctgctgctgctgctgtgaggaagacgagagcacagggcaaacggaggagaaggagaaggagaaggcggccgacctcttctccgtcttcaaccttgcgccgcgtccagcgcgtaggtgaggagccgagtttagtagagtactctactaaacaaacaagcaaagcaaggccgacgaatcgagggagagggaggaagcaggccagcacggggtacgccgaggcacagaacaaccgacagggtatttactccccccgcccttgtctcgcccccatttctcgccctttcacttccatcgctcccctcctcctctccgattctctccgcttcctccaaacttttccctttcctacacctctcgctaaatcctcttcctctcatcctgtactcgccctgccatgcttcgccgtggattttaaccgcttgcttctattcggaggaacacagtcatcaggcgagccagccagggacgggagtaagagagaaggggttcttccatttatttttttcctctcggttgatctgccgcgccggccggtcgaggaagggaggaagaagtatgtttggggactgccaggtcctatcctcgatggccgcggtggccggggcctcctcgtcggcggacacgctcttcatccccaacccaggcgccctcgccgggttcatgtcctcctcctccgccgccgccgccatgccattccaccatttctccaccaccgccgcctccctcgtaccaaaggaggagggcggcatcatgggtgcgctccaggtggccaaggacgaggacatggatcagctggagatggagatggagctcagcggcggctccgggagcggccacctggacggcctgctcagcttcgccgacgtggacgacgaccggccggagcagaagccgcagcacagcggcctcgagctccagacgacggcggatgccgccggacagcagcagcagctggccaccgccaacggcaagaagaaacggtaccaccgccacacggcacaccagatccagcagatggaagcgctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgacaactaccgtctgcaggccgccatccgcaacgtagtctgccccaactgcggccacgccgccgtcctcggcgagatgtcgtacgaggagcagcagctccgcatcgaaaacgctaggctcaaggacgagctcgaccgcttggcgtgcatcgcgacccggtacggcggcggccgacagccgagcatgtcgtcgtccgcgctggtctgcttatcggcgccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccgggggcgccgagcaccacgcctccacgccgtcgttcatgggcgccatggcgcctgtccaggagcaggacaggcagctggtgctcgacctcgccgccgcggccgcagacaccctcgccaagatgtgccgcgcgggcgagtcgctctggctgcggcgccgtggcgcgagctccgaggtcatggtagccgacgagcacgcccggatgttcagctggcctgtcaacggcggccagcaggatagcagtgcctcccctggcggcgccgcggccaggaccgagggatcaagggacggcaccgtggttatcatgaacagcatcacgctggtggatgccttcctggacgctaacaagtggatggagttgttcccttcgatcctatccaaggcaagaaccattcaggtcataaaccatggatctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccatcgtcgacttcccggccgaggggttccagctggaggcactgcaaaccccatctgttgtaaggtgctgtaggcgcccctccggttgcatcatccaggacatgcccaatggctactctagcgtggtgtgggtggagcacacggagattgttggagaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggagtgatccgcacaccagaggcgagaacaaatatgatgaagctgtcacagcggatgatcactagtttctctgccaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcagcttgagattatgtcaagcgggggctcacttcacgaagtggcacatattgcaaatggatcacacccaaagaattgcatttctcttcttagaatcaatgctgcaagcaactcatcccagaacgtggagctcatgctgcaggagagcagcacccaccccgacggcgggagcctcgtggtgtttgcgaccgtggacgtggacgccatccaagtgacaatgagcggcgaggacccttcctacatccctctcctcccgctgggcttcgccatcttcccggccgccaacccttcggctgcagcaaccagcgccgcaggctccggcgacggccaaagcagcccagcaggtaacgccgacgagcccgccagcggctgcctcctcaccgtgggcatgcaggtgctcgctagcgctgtgccctcggctaagctgaacctctcgagcgtgaccgcgatcaacagccacgtctgcaacgccgtccaccagatcacagccgcgctcaagggcgctggggcgagcggggccgctgaaccggcggctgctgcctccgagtagtagcaagagcgggagcagaggagagcagatccatacaccacaacaaaagccaaattgccttccaggtccggttgtttctgctgacagacatcgcagtgcaagagagggtttgacaggagcccgaaaccaacacacggaaagttcaaaaaccccccttctctttcccgccatatgcctcttaaaatgacaaaaatacccctgaccgaacgaagagaatggtgggggcattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgatttttgtaataataataagacgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgtttttatcatgcgtgttttg

SEQ ID NO: 2909 - DNA, 874 bp, Zea mays
atccattcccacagcaccaagcaagagcaaagagcaacacaagccaaggcagcaaacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgacgctgagcctcatgcccggcgcggacgtcggcgccgagcaggagcaggccgccgcgagggggcaggagacggccgggtccgcctccacggcggcgccgctcaccatcttctacggcggcagggtggtcgtgttcgacgacttcccggcggagaaggcggccgaggtcatgcgcctcgcagctggcgccgagcgcccggcggccccggccccggcgccggcgccgcgcgacgacctgcccatcgcccggaaggcgtcgctgcagcggttcctggccaagcgcaaggaccgcctcgtggagcgcgccccctacgcccgcccgtccccatccgaggaggcggagaaggcgaagccggcctcctcgtggctcgggctcggcggcacggacgccgagcgcctcaacatcgcgctgtgatttggatctcgcttgctacccacctggatcgaccgggggcgatttgattggctgggttcctggcttcctttgggtctgctggattggggttggtgtggagatcggagacggaggattgtagaaacgtattcttgttttttttctctctcccttacgagagagtttggctgttaattgattcgataatagaaagatggaggatgtacaattcgtgtc

SEQ ID NO: 2910 - DNA, 816 bp, Pennisetum glaucum
acaccaccaccaccaagcattcaaggttcaggcaagcaacgcaaccgccgcgtccagcaaagaggaagggaagaagcgcgtcagagattgacacggccatggcggcagcggagggcaagagccggaggttcgcgctggcctgcggcgtcctcagccagtacgtgaaggcggagcagaagatggcggccgtggccccgcgcgcgccggcgacgacgctgagcctcatgcccggcgcggacgtcggcgccgagcaggagccagccgcctctgcagccgctaggggcgcggaggatgcggccgggcccgcgtccaccgcggcggcgccgctcaccatcttctacggcgggagggtggtcgtgttcgaggacttcccggcggagaaggccgccgaggtgatgcgcctcgccgccggcgccggcggcggcgctggccccgagcgggttgcggcaccggcaccggcaccgcgcgacgacctgcccatcgccaggaaggcgtcgctgcagcggttcctcgccaagcgcaaggaccggctcgtggagcgcgcgccctacacccgcccgtcccccgcggcggaggaggccgagaagacgaagaagccggccgcctggctcgggctggggagcgcggacgccgagcgcctcaccaccatcgcgctgtgatgtggagctcgctggggttgcaggatcgatcagtagtagtgatttaattgggcgggttcttgccttcttggtgggggggggacggaatttgggtgtggtcgaacagagcaggagcatttgctcgtgctcttcgtacacagacagagaagaattgtag

SEQ ID NO: 2911 - DNA, 904 bp, Panicum virgatum
agcaccatcgagcaagcagcacaagcggcaggcgcatccgagagaagaggaagaggaagcgaagagaagccaggacaaggagaggaagaggagaagcaagttcgattaacatggccatggctgcagcggagggcaagagccggaggttcgcgctggcctgcggcgtgctcagccagtacgtgaaggcggagcagatgatggcggtcgcccctgccccgggcccgcgcgcaccggcgacgacgctgagcctcatgcccggcgcggacgtcggcgccgagcaggagccaaccgccgccgctaggggggaggaggcggccgggcccgcgtccgcgtccactgcggcgccgctcaccatcttctacggcgggcgggtggtcgtgttcgaggacttcccggcggagaaggcggccgaggtcatgcgcctggccgccggcaccgagcgggcggcggccccggccccggccccgcgcgacgacatgcccatcgccaggaaggcgtcgctgcagcggttcctcgccaagcgcaaggaccgcctcgtcgagcgcgcgccctacacccgcccgtccccggcggaggaggccgagaagaagaagccggctgcctggctcgggctcgggagcgcggacgccgaccgcctcgccatcgcgctgtgattcggagctcgccgggttgcacatgctgggggattggttagcactagtagtgatttaattgggcgggttcctggggttggaatcggactggatttgatcgaacggagccggagcatttgctcatgctcttacagagacggagaattgtagagatgtattctttttttacctcttctttaacaagagtgctttgctcttgtaacattcgatagaaagatggagattgaacaattcgtcaatttgtgccttcc

SEQ ID NO: 2912 - DNA, 3886 bp, Zea mays
cgtccctcccgatcctctcttggatctcgccgcgcgcccgaaggcgagcggggccgcgatgcctgcggcggccgttcccggaggcggtggcgccgccgacgccgaggagctgttccgcaccaagcgcatcccggagattcgtgcggctgagggcgccacccgacgcgagatctccgccaaggaggaggagctcagacagctcgtcgggcgcagctaccgcgacctgctcgactccgcggactccatcctcctcatcaagcagtcctccgatgccatatccgacaacctcgcccgcatctctggctccttgtcgtcgctctcgccgccccatgaaccctctcccgccgtaagcgccgcctcgccgtctccgtctgctggagggcgcgcgaggctgtacgcgctggccgcgcgcgccaagtaccttgttgacacgccggagcacatatggggtcggctcgatgagggcctgctccttgaggcggcggggcggtaccttcgggcgcaggtcgtacacgggcggctctcccgcgacgccacggccgccgcgcggttccctctcctcgcgcaccaggcgcagctcgtggaggcgttccggccgcagatctcccagcgcgcgcgcgagcgcctcgccgaccgccgcctccccgtagcggcccacgctgacgcgcttgcggccgtggccgctattgactccccctcgcttgccccggcccaggctctcctcctcttcctcacctcgcgccgcgcttggatctcccaagccctagctgggctcgcctcggatctgtcatcatacacctctgtgctgtgcgatatcgcgaggatcgtgcggatcacgcttggccacgttggacagttgtttgtgcctgcactcagtgatatgccgttgttcttcaagacggtgcttgagaagacgccgcctgagcagttgttcggtggcattccggaccctgatgatgaagcacggttgtggaaggagcacatgaaccagcttgaggctacaatggtgctgctcgaggcagatgccattgcaggggcctgtacggattggctcaaggaatgttgcactaaaatttttggtgtgattgctggtgagcagaagttggttgatgccattgggagtggggagctgcttggatcagtgcaaaggcttgtacgtgaagcactagatgggagggacggattggagggaagtttggagcagtggctgaagagcgtctttgggtcagatattgagtcgccatgggatcagatccatgggttgatcttgaaggacggcaaagatatttttgaggattggatggaggaagcatttgtgcgacggatgaaggacattgtgcattcagagcttgatagattgggtgctagtgttaacgtgaaggaattagttcatgctattggtgccaatgctgatccaaaggatgctggagattttcttgcctacctgcggaaatcttctaagggtggtggtttctggttctcagagtctaagataaagaaaggcggagttttggcacacttgaaaccaattgctgatgaaaatgatttccatagttgcctaacattgtattttgggccagaagttagtcggatcaggagtgcaattgacagtaaatgcaagaatatcctggatgatctgttaagctttgtggagtcacataattcagccccaaggctgaaggagttggtgccatacctccaggagaaatgctacaggaccatctcgggagtattgaaagaattagaagctgagctcagaaagctctctgctctgttgggaaccaaaaaggagggtaacgacatacctgcagcttctattatagcggagaggtctctcttcattggtcgaatcttgtttgccctgagatactattcaagtcatgtacccctgatactaggttccccaagggagtgggtagaggaggctggtggtgcagcatttgccaggctatcatcacctacaccaagacattcaagggcatctttcgattctttagtaccttttacatcgagaaggcgcacatttgacagtcccaagagtcctggaaggcaattctcggatagccccagaagacaaactattgctgctgcagtatctttgtttggagctgatgatagatccaatcctagacttgatgaactcaataagaccatgcagtcactttgcatcatggctcataatgtatggataacatgggtgtccaccgaattatctcacattctttcatatgatatcagcaaagatgattcactatcctcttcgactcctttgaggggctgggaagtcactgtaattaaacaagatgaaacaactgagggtcccttggagatgcaaatagctcttccatcgatgccttcattgtacatcatatcatttctttatcaagcatgtttggagattcataaggttggagggcacatcctgtacaggattattttgcacaattttgcatgggagctactgcagaaggttgtcaacatttatgaaaaatttctttcatgtgttgaatctgggaattctacggtttcagagaaaggaattctgcaaatactgctagacttgcgtttcgttggtgatgtcctatcaggaggtaaaagttcttccaccaacagtcctgaaatgcagacaaaacaggattttttgccaagcgccgtcaccaagacttccttcaggagaaaacagtcacaattacaggcagactcagctgtcatagagcctataaacaagttagtcaacaggctctcacagagattggatcctatagactgggccacgtatgaaccttacctgtgggagaatgagaagcaatcttacaagcgttatgttgttctttttggttttttggtccaattgaatcacaagtacactagtactgtacaaaaattaccaacaaaatcaaatacagattcaaatatcatgaggtgctctcaggttccaagattcaagtacctaccaatcagtgccccggttatatcatcaagatcacacaaatcgtcactacagtcgccgtctagtgactccacatcgaaaaatacttggaaatcctattcaaatggagatggatctagtacaccagattttgatgataatgcaagtcttgttggtgctgctccgttgcttaagtcatttgttacccaggtggggagcaaatttggggagaacacatcgagatgggggtccatgctctctgacgggcaggttggtaagctaagtgacatccttcctggaccagcagctgggtttttctcttctttcacatctggagctcgatatgattcatagtaattgcaccatgacccttgatctttagcccttactatgcgtcgtatggaaacccacatgtgtcatcaagagaacagaagcactgttggcaggtgtagtatgcctttggaaatctgttgctcacagaatgattccacaatgctggtcccgtgttgcttggcatatcctgccgcgcctcttcgcatcttattgtgactagacagtgtcatggagaagttcaggaaattatgatggaaaagatgagatttattctgtatcggctgcccacaggtgaatgagtggttagggaaatcaaaagtttggtttcaccgtatttcctgcttgcaatttaacttggtacataggacagagaagtgcaactcgccgcggatgcctgcctcacttttttggggggaatcatgttgtggatacacggcacttgaagttgtgaaaagaattttgaggttccattctttctttcttatctttggctcggcgagttgactgattttctcatcggaacattgccggaactgtgaggttgcggttttaccatgtagggaaatttgcagaatgtgtacactggaaatataggaataataaaagtctgtatcatgcattcag

SEQ ID NO: 2913 - DNA, 3933 bp, Zea mays
gctaacccaaacgaacgtgcctctcactagtcagtctctcccccacccgtccctcccgatcctctcttggatctcgccgcgcgcccgaaggcgagcggggccgcgatgcctgcggcggccgttcccggaggcggtggcgccgccgacgccgaggagctgttccgcaccaagcgcatcccggagattcgtgcggctgagggcgccacccgacgcgagatctccgccaaggaggaggagctcagacagctcgtcgggcgcagctaccgcgacctgctcgactccgcggactccatcctcctcatcaagcagtcctccgatgtcatatccgacaacctcgcccgcatctctggctccttgtcgtcgctctcgccgccccatgaaccctctcccgccgtaagcgccgcctcgccgtctccgtctgctggagggcgcgcgaggctgtactcgctggccgcgcgcgccaagtaccttgttgacacgccggagcacatatggggtcggctcgatgagggcctgctccttgaggcggcggggcggtaccttcgggcgcaggtcgtacacgggcggctctcccgcgacgccacggccgccgcgcggttccctctcctcgcgcaccaggcgcagctcgtggaggcgttccggccgcagatctcccagcgcgcgcgcgagcgcctcgccgaccgccgcctccccgtagcggcccacgctgacgcgcttgccgccgtggccgctattgactccccctcgcttgccccggcccaggctctcctcctcttcctcacctcgcgccgcgcttggatctcccaagccctagctgggctcgcctcggatctgtcatcatacacctctgtgctgtgcgatatcgcgaggatcgtgcggatcacgcttggccacgttggacagttgtttgtgcctgcactcagtgatatgccgttgttcttcaagacggtgcttgagaagacgccgcctgagcagttgttcggtggcattccggaccctgatgatgaagcacggttgtggaaggagcacatgaaccagcttgaggctacaatggtgctgctcgaggcagatgccattgcaggggcctgtacggattggctcaaggaatgttgcactaaaatttttggtgtgattgctggtgagcagaagttggttgatgccattgggagtggggagctgcttggatcagtgcaaaggcttgtacgtgaagcactagatgggagggacggattggagggaagtttggagcagtggctgaagagcgtctttgggtcagatattgagtcgccatgggatcagatccatgggttgatcttgaaggacggcaaagatatttttgaggattggatggaggaagcatttgtgcgacggatgaaggacattgtgcattcagagcttgatagattgggtgctagtgttaacgtgaaggaattagttcatgctattggtgccaatgctgatccaaaggatgctggagattttcttgcctacctgcggaaatcttctaagggtggtggtttctggttctcagagtctaagataaagaaaggcggagttttggcacacttgaaaccaattgctgatgaaaatgatttccatagttgcctaacattgtattttgggccagaagttagtcggatcaggagtgcaattgacagtaaatgcaagaatatcctggatgatctgttaagctttgtggagtcacataattcagccccaaggctgaaggagttggtgccatacctccaggagaaatgctacaggaccatctcgggagtattgaaagaattagaagctgagctcagaaagctttctgctctgttgggaaccaaaaaggagggtaacgacatacctgcagcttctattatagcggagaggtctctcttcattggtcgaatcttgtttgccctgagatactattcaagtcatgtacccctgatactaggttccccaagggagtgggtaaaggaggctggtggtgcagcatttgccaggctatcatcacctacaccaagacattcaagggcatctttcgattctttagtaccttttacatcgagaaggcgcacatttgacagtcccaagagtcctggaaggcaattctcggatagccccagaagacaaactattgctgctgcagtatctttgtttggagctgatgatagatccaatcctagacttgatgaactcaataagaccatgcagtcactttgcatcatggctcataatgtatggataacatgggtgtccaccgaattatctcacattctttcatatgatatcagcaaagatgattcactatcctcttcgactcctttgaggggctgggaagtcactgtaattaaacaagatgaaacaactgagggtcccttggagatgcaaatagctcttccatcgatgccttcattgtacatcatatcatttctttatcaagcatgtttggagattcataaggttggagggcacatcctgtacaggattattttgcacaattttgcatgggagctactgcagaaggttgtcaacatttatgaaaaatttctttcatgtgttgaatctgggaattctacggtttcagagaaaggaattctgcaaatactgctagacttgcgtttcgttggtgatgtcctatcaggaggtaaaagttcttccaccaacagtcctgaaatgcagacaaaacaggattttttgccaagcgccgtcaccaagacttccttcaggagaaaacagtcacaattacaggcagactcagctgtcatagagcctataaacaagttagtcaacaggctctcacagagattggatcctatagactgggccacgtatgaaccttacctgtgggagaatgagaagcaatcttacaagcgttatgttgttctttttggttttttggtccaattgaatcacaagtacactagtactgtacaaaaattaccaacaaaatcaaatacagattcaaatatcatgaggtgctctcaggttccaagattcaagtacctaccaatcagtgccccggttatatcatcaagatcacacaaatcgtcactacagtcgccgtctagtgactccacatcgaaaaatacttggaaatcctattcaaatggagatggatctagtacaccagattttgatgataatgcaagtcttgttggtgctgctccgttgcttaagtcatttgttacccaggtggggagcaaatttggggagaacacatcgagatgggggtccatgctctctgacgggcaggttggtaagctaagtgacatccttcctggaccagcagctgggtttttctcttctttcacatctggagctcgatatgattcatagtaattgcaccatgacccttgatctttaacccttactatgcgtcgtatggaaacccacatgtgtcatcaagagaacagaagaactgttggcaggtgtagtatgcctttggaaatctgttgctcacagaatgattccacaatgctggtcccgtgttgcttggcatatcctgccgcgcttcttcacatcttattgtgactagacagtgtcatggagaagttcaggaaattatgatggaaaagatgagatttattctgtatcggctgcccacaggtgaatgagtggttagggaaatcaaaagtttggtttcaccgtatttcctgcttgcaatttgacttggtacataggacagagaagtgcaactcgccgcggatgcctgcctcacttttttggggggaatcatgttgtggatacacggcacttgaagttgtgaaaagaattttgaggttccattctttctttcttatctttggctcggcgagttgactgattttctcatcggaacattgccggaactgtgaggttgcggttttaccatgtagggaaatttgcagaatgtgtacactggaaatataggaataataaaagtctgtatcatgcattcag

SEQ ID NO: 2914 - DNA, 4024 bp, Zea mays
ccccttcctcccgatcctctctcggatctcgccgcgcgctgccgcgctcgaaggtgagcggggccgcgatgcctgcggtgcccgttcccggaggcggtggctcctccgacgccgaggagctgttccgcaccaagcgcatcccggagattcgcgcggttgagggcgccacccgacgcgagatctccgccaaggaggaggagctccggcagctcgtcgggcgcagctaccgcgacctgctcgactcagcggactccatactcctcatcaagcagtcctccgatgcaatattctacaacctcgcccgcatctccgactccttgtcgtcgctctcgcctccccctgaaccctctctcgccgtaagcgccgtatcgccgtctccgtcagctggagggcgcgcgaggctctacgcgctggccgcgcgcgccaagtacctggttgacacaccggagcacatctggggccggctcgacgagggcctgctcctggaggcggcggggcggtacctgcgggctcaggtcgtgtacgggcgactctcccgcgacgccgctgccgccgcgcggttcccactcctcgcgcaccaggcgcagctcgtggaggcgttccggccgcagatcgcccagcgagcgcgcgagcgcctcgctgaccgccgcctccctgtagcggcccacgctgacgcgcttgcggccgtggccgcgatcgacgcgccatcgcttgcccctgctccggcgctccttctcttcctcacctcgcgccgcgcttggatctcccaagacctagctggtctcgcctcggatctgtcatcctacacctctgtgctgtgcgatatagcgaggatcgtgcggatcacgcttggccacgttggacagttgtttgtgcctgcactcagtgatatgccgttgttcttcaagacggtgactgagaagacgccgcctgagcagttgttcggtggcattccggaccctgatgatgaagcacggttgtggaaggagcacatgaaccagcttgaagctataatggtgctgcttaagccagatgttgttgcagcggcctgtacggattggctcaaggaatgttgcagtgaaatttttggtgtgattgctggtgagcaaaagttggttgatgccattgggagtggggagctgcttggatcagtgcaaagacttgtacgtgatgccctagatgggagagatggattggagagaagtttggagcagtggctgaaaagtgtctttgggtcagatactgagtcgccatgggatcagatccgtgggttgatcttgaaggacgacaaggatattttcgaggattggatggaggaagcatttgtgcgacggatgaaggacatcgtgcattcagagtttgatatattgggttctagtgttaacgtgaaggaatcaattcatgctatcggtgccaatgctgatccaaaggatgctggagatttccttgcatacctgcggaaatcttcaaagggtggtggtttctggttctcagagtctaagatcaagaaaggtggagttttggcacacttgaaaccaattgctgatgaaaatgatttccgtagctgcctaacatcgtattttgggccagaagttagtcggatcaggagtgcaattgacagtaaatgcaagaatatcctggaggatctgctaagctttgtggagtcacataattcaaccacaaggctgaaggaattggtgccataccttcaggagaaatgctacaagaccatctcgggagtactgaaagaattagaagctgagctcagaaagctctctgctttgttgggaaccaaaaaggagggtaacgacatacctgcagcttctattatagcggagaggtctctcttcattggtcgtctcttgtttgcgctgagataccattcaagtcatgtacccctgatactaggttccccaagggagtgggtaaaggaggttggtggtgcagcatttgccaggttatcatcacctacagcaagacatttaagggcatcttttacacccagaaggcacacatttgacagtcccaagagtcctggaaggcaattctccgatagccccagaagacaaactattgctgctgcagtatctttgtttggagctaatgatagatctaatcctagacttgatgaactcaataagaccctgcagtcactttgcatcatggctcataatgtatggatagcatgggtgtccactgaattatctcacattctttcatatgatctcaataaagacgattcactatcctctgcaactcctttgaggggctgggaagtcacagtaattaaacaagaggaaacaactgagggtcccttggaaatgcaaatagctcttccatcgatgccttcattgtacatcatatcctttctttatcaagcatgtttggagattcataaggttggagggcacatcctggacaggattattttgcataattttgcttgggagctactgcagaaggtcatcaatatttatgaaaattttctttcatctgttgaatctgggaattctccggtttcagagaaaggaattctgcaaatactgctagacttgcgttttattggtgatgtcctatcaggaggtacaagttcttccacaaacactactgaaatgcagacaaaacaggattctttgccaagcaccatctccaagacttccttcaggagaaaacagtcacaattacatgcagactcagctgtcatagagcctataaacaagttagtcaacaggctctcgcaaatactggatcctatagactgggccacgtatgaaccttacctgtgggagaatgagaagcaatcttacaagcgtcatgttgttctttttggttttttggtccaactgaatcacatgtacactggtactatgcaaaaattaccaacaaaatcaaatacagattcaaatatcatgagatgctctcaggttccaagattcaagtacctaccaatcagtgctccagctatatcatcaagatcacacaaaccatcactacagtctctgtctagcgagtccacatctaaaaatccttggaaatcctattcaaatggagatagatctactacaccagagtttgatgataatgcaagtcttgttggtgctgctccattgcttaagtcatttgttactcaggtggggaccaaatttggggagaacacatcgagatggggttccatgctctctgatggacaggttggtaagctaagtgacatccttcctggaccagcagctgggtttttctcttctttcacatctggagctcgatatgattcatagtaatgcaacggtgaccattgatctttagcccttactacacgtgacacggaaacccacatgtgtcatcaaaggaagaaaaagaactgttggtcctttggaaatctattgctcactgaatgatgccacatcgctggtcccgtgttgcttggcatatctgccgtgcctattcacatcttattgtgcctagactttcatggggaagctgaggaaattataatggaaaagatgagatttattctatatcggttgcccaaggttgaatgagtggttaggaaaaatcagatttgggttcagtatgtttcttgcttgcatttgacttggtacataggacagaacaagtgcaacgatgccgctgatactagctcactttggggactcctgttgtggatacgcggcacttgaagttgtgaaaagagttttggggggtccattctttcttccttgtctttggctcggttagttggctttttttttttcatcggatcagtggtggaactgcgaggttgtggttttatcatgtaggcaaatttgccaaatgtgtacatcggaaatatgggaataaaagcctctatcaatcagcattcagcatcatgcagcgctcaagggcctgtttggttggcatgctgattgccaatttgccatagtctttctgtatttgtctacatgtctgtctgggttgaagttgttacaataggtacagttgctgattttatacgtggctaagagcatctccaaccgtcttttctaaa

SEQ ID NO: 2915 - DNA, 4020 bp, Zea mays
ccccttcctcccgatcctctctcggatctcgccgcgcgctgccgcgctcgaaggtgagcggggccgcgatgcctgcggtgcccgttcccggaggcggtggctcctccgacgccgaggagctgttccgcaccaagcgcatcccggagattcgcgcggttgagggcgccacccgacgcgagatctccgccaaggaggaggagctccggcagctcgtcgggcgcagctaccgcgacctgctcgactcagcggactccatactcctcatcaagcagtcctccgatgcaatattctacaacctcgcccgcatctccgactccttgtcgtcgctctcgcctccccctgaaccctctctcgccgtaagcgccgtatcgccgtctccgtcagctggagggcgcgcgaggctctacgcgctggccgcgcgcgccaagtacctggttgacacaccggagcacatctggggccggctcgacgagggcctgctcctggaggcggcggggcggtacctgcgggctcaggtcgtgtacgggcgactctcccgcgacgccgctgccgccgcgcggttcccactcctcgcgcaccaggcgcagctcgtggaggcgttccggccgcagatcgcccagcgagcgcgcgagcgcctcgctgaccgccgcctccctgtagcggcccacgctgacgcgcttgcggccgtggccgcgatcgacgcgccatcgcttgcccctgctccggcgctccttctcttcctcacctcgcgccgcgcttggatctcccaagacctagctggtctcgcctcggatctgtcatcctacacctctgtgctgtgcgatatagcgaggatcgtgcggatcacgcttggccacgttggacagttgtttgtgcctgcactcagtgatatgccgttgttcttcaagacggtgactgagaagacgccgcctgagcagttgttcggtggcattccggaccctgatgatgaagcacggttgtggaaggagcacatgaaccagcttgaagctataatggtgctgcttaagccagatgttgttgcagcggcctgtacggattggctcaaggaatgttgcagtgaaatttttggtgtgattgctggtgagcaaaagttggttgatgccattgggagtggggagctgcttggatcagtgcaaagacttgtacgtgatgccctagatgggagagatggattggagagaagtttggagcagtggctgaaaagtgtctttgggtcagatactgagtcgccatgggatcagatccgtgggttgatcttgaaggacgacaaggatattttcgaggattggatggaggaagcatttgtgcgacggatgaaggacatcgtgcattcagagtttgatatattgggttctagtgttaacgtgaaggaatcaattcatgctatcggtgccaatgctgatccaaaggatgctggagatttccttgcatacctgcggaaatcttcaaagggtggtggtttctggttctcagagtctaagatcaagaaaggtggagttttggcacacttgaaaccaattgctgatgaaaatgatttccgtagctgcctaacatcgtattttgggccagaagttagtcggatcaggagtgcaattgacagtaaatgcaagaatatcctggaggatctgctaagctttgtggagtcacataattcaaccacaaggctgaaggaattggtgccataccttcaggagaaatgctacaagaccatctcgggagtactgaaagaattagaagctgagctcagaaagctctctgctttgttgggaaccaaaaaggagggtaacgacatacctgcagcttctattatagcggagaggtctctcttcattggtcgtctcttgtttgcgctgagataccattcaagtcatgtacccctgatactaggttccccaagggagtgggtaaaggaggttggtggtgcagcatttgccaggttatcatcacctacagcaagacatttaagggcatcttttacacccagaaggcacacatttgacagtcccaagagtcctggaaggcaattctccgatagccccagaagacaaactattgctgctgcagtatctttgtttggagctaatgatagatctaatcctagacttgatgaactcaataagaccctgcagtcactttgcatcatggctcataatgtatggatagcatgggtgtccactgaattatctcacattctttcatatgatctcaataaagacgattcactatcctctgcaactcctttgaggggctgggaagtcacagtaattaaacaagaggaaacaactgagggtcccttggaaatgcaaatagctcttccatcgatgccttcattgtacatcatatcctttctttatcaagcatgtttggagattcataaggttggagggcacatcctggacaggattattttgcataattttgcttgggagctactgcagaaggtcatcaatatttatgaaaattttctttcatctgttgaatctgggaattctccggtttcagagaaaggaattctgcaaatactgctagacttgcgttttattggtgatgtcctatcaggaggtacaagttcttccacaaacactactgaaatgcagacaaaacaggattctttgccaagcaccatctccaagacttccttcaggagaaaacagtcacaattacatgcagactcagctgtcatagagcctataaacaagttagtcaacaggctctcgcaaatactggatcctatagactgggccacgtatgaaccttacctgtgggagaatgagaagcaatcttacaagcgtcatgttgttctttttggttttttggtccaactgaatcacatgtacactggtactatgcaaaaattaccaacaaaatcaaatacagattcaaatatcatgagatgctctcaggttccaagattcaagtacctaccaatcagtgctccagctatatcatcaagatcacacaaaccatcactacagtctctgtctagcgagtccacatctaaaaatccttggaaatcctattcaaatggagatagatctactacaccagagtttgatgataatgcaagtcttgttggtgctgctccattgcttaagtcatttgttactcaggtggggaccaaatttggggagaacacatcgagatggggttccatgctctctgatggacaggttggtaagctaagtgacatccttcctggaccagcagctgggtttttctcttctttcacatctggagctcgatatgattcatagtaatgcaacggtgaccattgatctttagcccttactacacgtgacacggaaacccacatgtgtcatcaaaggaagaaaaagaactgttggtcctttggaaatctattgctcactgaatgatgccacatcgctggtcccgtgttgcttggcatatctgccgtgcctcttcacatcttattgtgcctagacagtttcatggggaagctgaggaaattataatggaaaagatgagatttattctatatcggttgcccaaggttgaatgagtggttaggaaaaatcagatttgggttcagtatgtttcttgcttgcatttgacttggtacataggacagaacaagtgcaacgatgccgctgatactagctcactttggggactcctgttgtggatacgcggcacttgaagttgtgaaaagagttttgggggtccattctttcttccttgtctttggctcggctagttggctttttttttttcatcgggtcagtggtggaactgcgaggttgtggttttatcatgtaggcaaatttgccaaatgtgtacatcggaaatatgggaataaaagcctctatcaatcagcattcagcatcatgcagcgctcaagggcctgtttggttggcatgctgattgccaatttgccatagtctttctgtatttgtctacatgtctggggttgaagttgttacaacaggtacagttgctgattttatacgtgcctaagagcatctccaaccgtcttttcta

SEQ ID NO: 2916 - DNA, 3141 bp, Setaria italica
cgcggccgcgatgcctgcggcggccgtccccggcggcggcggcgcggccgacgccgaggagttgttccgcaccaagcgcatccccgagatccgcgcagcggagggcgccacccgccgcgagatctccgccaaggaggaggagctccggcagctcgtcggccgcagctaccgcgacctgctcgactccgcggactccatcctcctcatcaagcagtcctccgactccatctccgacaacctctcccgcatctccggctccctctcgtcgctctcgccgccgccggagacgtcccccgccgcaagcgccgcctcgccgtccccgtccgctggagggcgcgcgaggctctacgcgcttgccgcgcgcgccaagtacctggtcgacacgcccgagcacatctggggccggctcgacgagggcctcctcctggaggcggcgggccggtacctgcgggctcaggtcgtgcatgggcggctctcccgcgacgccgcggccgccgcgcggttcccgctcctcacgcaccaggcgcagctcgtggaggcgttccggccgcagatcgcccaacgcgcgcgcgagcgcctcgccgaccgccgccttcccgtagccgcccacgcggacgcgctcgcggccgtggctgcgatcgacgccccgttgctcgccccgccccaggcgctcctgctcttccttaactcgcgccgcgcttggatcacccatgccctaacctcgcctcggatctgtcatcctacaccttgtgcgatgtagcgaggatcgtgcgtatcacgcttggccacgttggccagttgtttttgcctgcactcagtgatatgccgctgttcttcaagacggtgcttgagaagacaccgcctgagcagctgtttggcggcctcccagaccctgacgaggaatcacaattttggaaggagcacatgaaccagcttgaggctacaatggtgctgcttgaaccagatgtcatagcatgtgcctgtacagattggctcaaggaatgttgtgctgaaatttttggtgtaattgctgcggggcaaaagttggttgatgctattgggagtggggagctacttggatcagtgcaaaggcttgtacgtgatgcgctagatgggagggatggattggaggggagtttggaacagtggcttaagagcgtctttgggtcggagattgaatcgccatgggatcagatccgtgggttgattttgaagggcggcaaggatatttttgaggactggatggaggaagcatttgtgcggcggatgaaggacattttgcattcagaccttgatagtttgtgtgctagtgttaatgtgaaggaatcgattgatgctattggtgccaacgctgatccaaaggatgctggagattcatacctgcgaaaatcttcaaatggtggtggtttctggttctcagagtccaagatcaagaaaggaggagttttggcacacttgaaaccaattgctgatgagaatgatttccacagctgcttaacctcatattttggaccagaagttagtcggatcaggaatgcaattgacagcaaatgcaagagtattctggatgatctgttatgctttgtggagtcacataattcagccccaagactaaaggaattagtgccatacctccaagagaaatgctacaggaccatctccggagtgctgaaagaattagaaactgagctcagaaaactctcggctttgttggggaccaaaaaggaggataatgacatacctgcagcatctattatagcggagagggctctattcattggtcgtctcttgtttgcattgagataccactcaagtcatgtacctctaatactaggttccccaagggagtgggtgaaggaggctggtggtgcagcatttgccaggttatcatcacctacaccaagacattcaagggcatcttttgattcttcatcttttacccccagaaggcgcacatttgatagtcccaggagccctggaatgcaattctcggatagccccaggagacaaactattgctgctgccatatctttgtttggagctgaggatagatccaacccaagactcgatgaactcaacaagaccctgcagtcactttgcatcatggctcatagtgtatggatagcatgggtgtccactgaattatctcatattctttcatatgatctcaataaagatgactcactatcctcttcaactcccttgaggggttgggaggtcacagtcatcaaacaagaggaaacaactgagggtcccttggagatgaaaatagctcttccatcaatgccttcattttacatcatatcatttctttatcaagcatgtttggagattcataaagttggagggcacatcctggaccgaattattttgcataattttgcatgggagctactgcagaaggtcatcaatatttatgaaaatttccttgtgtctattgaatctgggaattctcaggtttcagagaaaggagttctgcaaatactgctagacctccgtttcgtcggtgatgtcctatctggaggcaaaaattcttccaccatcactactgaaacacagacaaaacaggattctttaccaagcaccatctccaagtcttccttcaggagaaaacagtcacaatcacaggcagattcagctgccatagagcctataaacaagttaattaataagctctcacagagactggatccgatagactgggccacgtatgaaccttacctgtgggagaacgagaagcaatcttacaagcgctatgttgttctttttggttttttggtccaattgaatcacatgtacactggtactgtacaaaaattaccaacaaagtcaaatacagattcgaatatcatgaggtgctctcaggttccaagattcaagtacctaccgatcagtgccccagctatatcatcaagaccacacaaaacatcactacagtcaccctctggtgacaacgcatctaaaggtccttggaaatcatattcaaatggtgatagatctactgcaccagaatttgacgataatgcaagtcttgttggtgctgctccattgtttaagtcatttgttacccaggtcgggagcaaatttggggagaacacatcgagatgggggtccatgctttctgatggtcaggtcggtaag

SEQ ID NO: 2917 - DNA, 3836 bp, Oryza sativa
atgcctgccgcggcagtctccggcggcggcgcggccgacgccgaggagctgttccgcacgagacgcatcccggagatccgcgcggcggagggcgccacgcgccgcgagatctccgccaaggaggaggagctccgccagctcgtcggccgcagctaccgcgacctcctcgactccgcggactcgatactcctcatcaagcagtcctccgacgccgtctccggcaacctctcccgcatctccgactccctcgcgtcgctcgcgccgccccccgaggctccccccgccgcatcgccctccccgtccggcgggcgggtccggctctacgcgtcggcggcgcgcgccaagtacctcgtcgacacccccgagcacatctgggggcggctcgacgagggcctgctcctggaggccgcggggcggtacgtgcgggcgcaggtggtgcacggcgtgctctcccgcgacgccgcggcggccgcgcggttcccgctgctcgcgcaccaggcgcagctggtggaggcgttccggccccagatcgcgcagcgcgctcgcgagcgcctcgccgaccgccgcctctccgtcgccgcccacgccgacgcgctcgcggccgctgcctcaatcgacgcaccgtcgctcaccccgacccaggcactccaactcttcctctcctcccgccgcgcctggatctcccaagccctaaccacccttgcctccgatctgacctcctactcctccgtgctgtgcgatgtcgccaagatcgtgcgtgtcacgctgggccatgtcgggcagttgtttgtgcttgcgctcaatgatttgccactgtttttcaagacggtgctcgatttgccgcccccttcacagctgttcggtggcattccagaccctgtggaagagacacggttgtggaaagaacactgggatcaacttgaggccaccatggtgctacttgagccagatgctgttgcaaggacttgtacagattggctgaagggatgctgtgatgagatttttggtgtgattgctggagggcaaagactagttgatgccattgagagtggggaagggcttggatcagtgcaaagacttgtgcgggaggcattagatgggagggaaggactggaagggactctggagcaatggctgaagagtgtgtttggatcagagattgaatcaccatgggatcagatccgtggcctcatcttgaaggaagggaaggacatttttgaggattggatggaagaagcctttgtgcaacggatgaaagacattgtgcacttggaattcggcagcttggatgatagtgtaaatattaagaaatcaattgatggtattggtgccaatgctgatccaaaggatgccggtgatttcatggtgtatttgcggaaagtttcaactggaggtggtgtctggttctctgagtctaagatcaagaaaggtggaattttggcacatttgaaaccgattgctgatgaaaatgatttccacagctgccttacctcatattttgggccagaagttagtcgcatcaggaatgcaattgacagcaaatgcaagactatccttgaggatctgttaagttttgtggactcgcacaattctgctcccagattgaaggagctggtgccatacctccaagagaaatgctataagaccatctctgggatactgaatggattggaagctgagcttggaaaattgtctgcttccttgagaaccaaaaaaggggagagcaatatgcttgcagcatctgttatcgtggagagatctctcttcattggccgcctcatgtttgcattgagataccactcgagtcatgtacccttgatcctaggatccccaaggcagtgggtaaaggaggctggtggtgcagcatttatgagattatcgtcgccctcaccaagacattcaagagcatcgtttgatacagcgatgccttttacccccaggaggcacacacagtcaagcccaaggagtcctggaaggcaattttctgacaaccccagaagacaaactattgctgctgctgcttccctatttggtgctgatgatagctccaatcccagacttgatgaactaaacaagaccttacaggcactctgcattgcagcccatggattgtggatagcatggttgtccactgaattatcacagcttctctcatatgacctcaacaaagatgattcattgtccttatcaacccctttacggggatgggaagtcacagtcatcaaacaagaggaatccactgagggccccttggagatgcaaatagcacttccatcaatgccttcactgtacattatatcctttctttatcaagcatgtttggagattcataaaattggagggcacatcctggacaaatctatattgcaaaactttgcatgggacttgttacagaaggttattgatatctatgaaagctttttggtatcaatcgagtctggtaaatctctggtttcagaaaagggggttctgcaaatactgctcgatttgcgcttcattggcgatgttctgtcaggaggcaaaagttcttccaccaaaactactgaaacacagagaacacatgactcttcgccaagcgccattgctaagacttccttcaggagaaaacagtcacaattgcaggcagattcagctaccatagagcctataaacaagctgatcaataagttctcacagagattggatccgatagactgggctacgtacgaaccttatctgtgggagaatgagaagcaatcttacaagcgctatgttgttcttttcggcttcttggttcaactgaatcacatgtatactggaactgtgcaaaagttaccgactaaatcaaatacagattcaaacattatgaggtgctcccaagtcccaagattcaaatacctaccgatcagtgccccagctctatcatcaagagcacacaaatcatcattacagtcaacatccgatgattccacatctagaagcccttggaaatcatattcaaatggagaaagatctacggcatcagaatttgatgataatgttagccttggaggtgctgctccattgctcaagtcatttgttacccaggttgggagcaaatttggggagaacacttcaagatgggggtccataatctctgatgggcaggttggcaaactcagcgacattcttcctggaccagcagctgggttcttctcatctttcacatctggggctcgatatgatccatagtcactgtttaatccttgatcttcaccccatcctatatgttaatacaaattgacatgcgtgaatggctaaactgtcgagggacaacatgatctgcgccattggatatctgttgcttacagaagtatgccacagctgggaacctgggactgcataacttggctcgacctacagcgccccttaacattttacgtgattgatcttcaatggtgaagctcaattggcgactcgctagttctgcctatgtacactacagatatggaagttgtcgcgatttggagattaaggtgcagttttggtgtgcttcatgattgcagttttacagggtatataggggaagcaagtgcaacttactactgatgttagtacgctctttgtgggggctcgatcaagttgtggataggccacatgtattcgtgcaaaagaattttggagtccattcattctttttcttaatttctcttttttttttttggctcggaggtttggaagatgttttagatttgaacagtcctgaaccgcagcgatcatggctttcaaagcttgagggtaaattcacacatctgtacacttgaaaatatcaataaagcgtgtatcttttcccttaaaccacagatgtttagcgttcc

SEQ ID NO: 2918 - DNA, 3857 bp, Brachypodium distachyon
cgcggccacgatgcccgccgcggccgcttccggcggcggcgtggccgacgccgaggatctgttccgcaccaagcgcatcgcggagatccgcgcggcggagagcgccacccgccgcgagatctccgccaaggaggaggagctccggcagctcgtcggccgaagctaccgcgacctcctcgactccgccgactccatcctcctcatcaagcagtcctccgactccatatccgacaacctctcccgcgtctccgagtccctctcgtcgctctcgccgccccccgaggccccaagtgccagcgccaacgccgcctcgccctccccgtccggcgggcgcgcgcggctatacgccgccgcggcacgggccaagtacctggtcgacacgcccgagcacatctgggggcggctcgacgagggtatgctcttggaggccgcggggcggtacatgcgagcgcaggtcgtgcaccgcttgctctctcgcgacgccgcggcggcagcgcggttcccgctgctcgcgcaccaggcgcagctagtggaggcgttccggccccagatcgcgcagcgcgcgcgcgaacgcctcgccgaccgccgcctttcctccgcgctagcctcggatccctcctcctacacctccgtgctctgcgatgtcgcgcggatcgttcgggtcaccctgggccatgtcgggcaattatttgtgcctgcactcaccgacttgccgctgttctacaagacagtgcttgagtcgcctcctcctgctcaactgttcggtggcattccagaccctgacgaggagacacgattgtggagagaacactgggatcggcttgaggctaccatggtgctacttgagacagaggccgtggcgcggacctgtacagattggcttaaggaatgttgtgatgaaatctttggtgtgattgctggtgctcaaagactagttgatgccattgagagtggggagggtcttggctcggtgcaaaagctcatgcgtgaggcactagatgagaggaaaggactggaagggagtttggagcagtggcttaagagtgtatttggatcagagattgagtcaccatgggatcaaatccgtgggttaatcttaaaggaagggaaggatatttttgaggactgggtggaggaagcatttgtgcgacggatgaaagacattgtgcattctgaatttgatagcttgggtggcagtgttaatgtgatggaatcgatggaggctattggtgccaatgctgatccaaaggatgctggtgatttcctgttgtatatgcggaaagcgtcgactggtggcagcgtatggttctcagaatctaagatcaagaaaggtggaattttggcacacctgaaaccgattgctgatgagaatgacttccatagctgcctaacatcatattttggcccagaagttagtcgtatcaagaatgcaattgacaacaaatgcaagagtattctggaggacctgttaagctttgttgagtcacacaattcagtgcccagattgaaggaattagtgccatacctccaggagaaatgctataggaccatctcagaaatactgaacaaattagaagcagagctcggaaagctctctgcttcattgggaacccaaaggaaggataacagcatacctgccgcacccattattgtggagaggtccctcttcattggccgcctcttgtttgcgttgcgatatcattcaagtcatgtacccctgatactaagctccccaaggcagtggctaaaggattctggtggtgcagcatttgccaggttatcatcacccacgccaagacattcaagaacatcttttgattcttcaatgccttttgcccccaggaggcacacattagacagccctagcagtcctggaaggcaattttctgacagccccagaagacctatcgcttctgctgctgcttccttgtttggtgctgatgatagctccaatcccagacttgatgaactcaataagactttaaaggcactatgcattacagctcacactttgtggataacatgggtgtctactgaattatcagaccttctttcatacgctcttaatagtgatgattcattatcctcatcaactgctttaaggggatgggaagttacagtcatcaagcaagagcaacccaccgacggccccttggagatgcaaatagctctcccatcaatgccttcgctatacattatatcatttctttaccaagcatgtctggagattcataaaattggagggcacgtcctggacaaaattatattgcataactttgcgtgggacttactacagaaggttatcaaaatctacaaaaactttttggtctctatcgagttaggcaactcacaggtttcagaaaaaggagttctgcaaatactgctagatttgcgtttcattggtgatgtactatcaggaggcaaaaattcttcctccaacccttctgaaacacagataaaacaggactcttcaccaagcaccatggctaagacttccttcaggagaaaacaatcacaattccaggcagattcagctaccatagagcaaacaaataagttgatcgatcaattttcacagagactggatccaatagactgggctacgtacgaatcttacttgtgggagaatgagaagcagtcttacaagcgttgcgttgttcttttcggtttccttgttcaactgaatcacatgtatactgggacagtacaaaagttaccaacaaaatcaaatacagattcaaatattatgaggtgctctcagattccaagattcaagtacctaccaatcagtgccccagctctatcatcaagaacacccaaatcatcactacagtcaccatctgatgattcaacatctcgaagcccttggaaatcatattcaaatggagaaagatctacttcatcagaatatgataacgatgcaagtcttggaagtgctgctccattgctcaaatcgtttgttactcaggttgggagcaaatttggggagaacacatcgagatgggggtccatgctctctgatggccaagttggtaagctcagtgacattcttcctggaccagcagctgggttcttctcatctttcacatctggggtccgatatgattcatagtcaaagtaccgttaaggctttaaccttaagccttcaatcgataacctctatacatcaaacggaaatgcatgtgtcaccaaggtaacagcagcactccagatcggtgagattggtcactggtaatctcttgcttacagagtgatgccaggtagttggcgctgcaatgctcagcacttcctaccatgcctcttgcatttttatttgaacggtgggcacttgaggataagctcaagcagatctgatggtgctcgagatatgctcatctatagtcaattgaaatcgaagaagtggcgatactaggaaatcagatgtttttgaacgtgtttacaaggtatttaggagaaagcaagtgcaacttgatgctgatattagttcactttttgggggtgatctggatcacactggcctcttgaattcctgaaaagaattttggagtccactctttcttttttctttctttggttcggtggttctgcagggtgttacgttcgaacagtgctgaagctgcagcggttgtggtatccaaagcgtggtaagttttgatgtgtagttgtgtacactgcaaatagcaataaagcgtgtatttattttccccttgaaactacagcatggccgttctttctatgtactgtacaattttatgcctttgtacaatcttttccttgcctcgtgtggcctttctttctctctacaattttatgcctttgtacaattttttattgcctcacgtttttgttctctgcac

SEQ ID NO: 2919 - DNA, 2105 bp, Zea mays
cacggctcgagctgggagacagtgagacacacaagacacaacgctctcggatctgccgcgcccccgctctcctctggctcgctcgcgttctcgcgtacaccactccagacagtgacacagggacacacgccggcgtggctgctcacgtgttctcagttctcaccctgcgctctcgccggccggggctataagtggtcagcgaatatctctgcggcaagcccacgcttcggagtggacgtcaggcgcgctcgccagccccccacaccaccaccaccaccacaaccccaccaagctcacgtttccgaattcaccaactcctgcacgccgcgtcgagatcgttcacgccttagcttcgggaactccaccaataagcccaccggctggagcaatggggagcacggggcgcgagccggaggtgacccgcgccaacttccccgacggcttcgtcttcggcgtcgccacctccgcgtaccagatcgagggagcgagaagagagggaggcaaaggagacaacatatgggatgtatttacagatgacaaagaacgtgtcttagacagaagcaatgcagaaattgcagttgaccactaccatcgatacaaggaagacattgagctcatggcaagtctaggttttagcgcatacagattttctatatcttgggcacgtatatttcctgatggcttgggggaaaaggtcaatgagcaaggagtcgccttctataatgacctcatcaactttatgatttcgaaaggtattgagccttacgcaacactgtatcattgggatcttccaaacaatcttcaaaaaactctggggggctggatttctgacaagattgtggagtactttgcattgtatgcagaagcttgctttgcaaatttcggagatagagtaaagcgttggataacaatcaatgaacctctccaaaccgcaatcaacggttatgggattggaatttttgcgcctggaggatgccaaggtgaaactgcaagatgttacttggccgcccatcaccaaatcttggctcatgctgctgctgttgatgtttatagaagaaaattcaaggctgcacaaagtggtgaagtaggcttggttgttgactgtgaatgggcagagccattttctgaaaaactcgaagaccaaattgctgcgcaacggaggattgactttcaacttggatggtacctagatccaatatattttggtgattacccagaaagcatgcgtcagcgactgggcagtgatcttccaaccttctcagagaaagataaaaaattcatcaagaacaaaattgattttattggactaaatcattatacttcgaggctcattgctcatcaccaaaatcctgatgatgtttatttctacaaagtgcaacaaatggagagagtagaaaaatggagtagtggtgaaagcattggtgaaagggctgcatctgaatggcttgtcatagttccttggggccttcacaaattgcttaactatatagtgaagaaatacaacaacccagtaatttatgttactgagaatggcatggatgatgaagacgatcagtccgcgacgattgaccaggtcctaaacgacacgaagagagtcggctacttcaaaggatacctcaattcggttgcacaggcgatcaaggacggggctgatgtccgtgggtacttcgcgtggtcattcctggacaacttcgagtgggctatgggctacaccaagaggttcggcatagtctacgtcgattacaaggacgggctctccaggcaccccaaggcatcggccctctggttctcgcgcctcctcaagggcgaggctgccgaaaacagctatagctagagctgccacagactgagggaacagtccgcggcaagtacagaaacattacacacatttctcctgttgttgtgtcttgttgttgtgtcttaaaggtgagtgcacctatgtatgtatgtatgtatgtatgtatgtatgtatgtatgtatgtatgtatatatgtattcatcctaataatctcaggatgtgctagtctgtcgttgatgcgacgctggctgagatgtgttctccaagaacaagaacaaccagaacctcagcaccaaataagctttga

SEQ ID NO: 2920 - DNA, 1888 bp, Zea mays
gcccacgcttcggagtggacgtcaggcgcgctcgccagccccccacaccaccaccaccaccacaacaccaccaagctcacgtttccgaattcaccaactcctgcacgccgcgtcgagatcgttcacgccttagcttcgggaactccaccaataagcccaccggctggagcaatggggagcacggggcgcgagccggaggtgacccgcgccaacttccccgacggcttcgtcttcggcgtcgccacctccgcgtaccagatcgagggagcgagaagagagggaggcaaaggagacaacatatgggatgtatttacagatgacaaagaacgtgtcttagacagaagcaatgcagaaattgcagttgaccactaccatcgatacaaggaagacattgagctcatggcaagtctaggttttagcgcatacagattttctatatcttgggcacgtatatttcctgatggcttgggggaaaaggtcaatgagcaaggagtcgccttctataatgacctcatcaactttatgatttcgaaaggtattgagccttacgcaacactgtatcattgggatcttccaaacaatcttcaaaaaactctggggggctggatttctgacaagattgtggagtactttgcattgtatgcagaagcttgctttgcaaatttcggagatagagtaaagcgttggataacaatcaatgaacctctccaaaccgcaatcaacggttatgggattggaatttttgcgcctggaggatgccaaggtgaaactgcaagatgttacttggccgcccatcaccaaatcttggctcatgctgctgctgttgatgtttatagaagaaaattcaaggctgcacaaagtggtgaagtaggcttggttgttgactgtgaatgggcagagccattttctgaaaaactcgaagaccaaattgctgcgcaacggaggattgactttcaacttggatggtacctagatccaatatattttggtgattacccagaaagcatgcgtcagcgactgggcagtgatcttccaaccttctcagagaaagataaaaaattcatcaagaacaaaattgattttattggactaaatcattatacttcgaggctcattgctcatcaccaaaatcctgatgatgtttatttctacaaagtgcaacaaatggagagagtagaaaaatggagtagtggtgaaagcattggtgaaagggctgcatctgaatggcttgtcatagttccttggggccttcataaattacttaactatatagtgaagaaatacaacagtccagtaatttatgttactgagaatggcatggatgatgaagacgatcagtccgcgacgattgaccaggtcctaaacgacacgaagagagtcggctacttcaaaggatacctcaattcggttgcacaggcgatcaaggacggggctgatgtccgtgggtacttcgcgtggtcattcctggacaacttcgagtgggctatgggctacaccaagaggttcggcatagtctacgtcgattacaaggacgggctctccaggcaccccaaggcatcggccctctggttctcgcgcctcctcaagggcgaggctgccgaaaacagctatagctagagctgccacagactgagggaacagtccgcggcaagtacagaaacattacacacatttctcctgttgttgtgtcttgttgttgtgtcttaaaggtgagtgcacctatgtatgtatgtatgtatgtatgtatgtatgtatgtatgtatgtatgtatatatgtattcatcctaataatctcaggatgtgctagtctgtcgttgatgcgacgctggctgagatgtgttctccaagaacaagaacaaccagaacctcagcaccaaataagctttga

SEQ ID NO: 2921 - DNA, 2000 bp, Zea mays
gccacagtagactgaacactggcacacagcgccctcggatctgccgctctcgtctcgctcgctcgcgtgcattggccgacaagggacgccacgccggcgtggctgctcacgtgttctcagttcttaccctgcgctctcgccgcccggggcaactggcgagcgagtgtggctgccgcttcctctccgagtcaggcgccatttaataattcaattcgacccccaagcccacgcttccgaattcaccgactcctccacgccgcgtcgagatcgctcaggccttcgcttccagcaactccaccactcagcccacccgccggagcaatggggagcacggggcgcgagccggaggtgacccgcgccgacttccccgacggcttcgtcttcggcgtcgctacctccgcgtaccagattgagggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaatgtcaatgatcaaggagtcgccttctataatgacctcatcaattttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagggtaaagcattggataacgatcaatgaacctctccaaactgcaatcaatggttatgggattggaatttttgcacctggaggatgccaaggtgaaactgctagatgttacttggctgcccatcaccaaatcttggctcatgctgctgctgttgatgtttatagaagaaaattcaaggctgcacaaggtggtgaagtagggttggttgttgattgtgaatgggcagagccattttctgaaaatgtggaagaccaaattgctgcacagcggaggcttgactttcaacttggatggtacctagatccaatatattttggtgattacccagaaagcatgcgtcagcgactgggcagtgatcttccaaccttttcagagaaagataaagagttcatgaggaacaaaattgattttgttggagtaaatcattatacttcaagactcattgctcatctccaaaatccaaatgatgtttatttctaccaagtgcaacaaatggagcgaatagaaaaatggaatagtggtgaaaaaattggtgaaagggctgcatctgaatggcttttcatagttccttggggccttcataagtcacttaattatatagcgaagaagtacaataatccagcaatttatgttactgagaatggcatggatgaagaggacgatcaatccgcaacgcttgaccaggtcctaaacgacacgacgagggtcggttacttcaaagggtacctcaattcagttgcgcaagcgatcaaggacggagctgatgtccgcgggtactttgcgtggtcgttcctggacaacttcgagtgggcaatgggctacaccaagaggttcggcatagtctacgtggactacaagaacgggctgtccaggcacccgaaagcatcggcgctgtggttctcgcgcttgctcaagggcgaggctggcactggcacaagctgagcgaactgcacgcagcatgcaagcacagaacgtcgttattacaatataaatattccacacaactagacgttttctcctgttgttgtatcgtactactgtacagtaagcgccaataagctagcctcagatgtgtgctgcctgcctatacctctagtgactgccattgatccagcactagctgaaatgtacccggcctccaagaatcagcaccagaatatatgctttgaattgaactc

SEQ ID NO: 2922 - DNA, 2004 bp, Zea mays
gccacagtagactgaacactggcacacagcgccctcggatctgccgctctcgtctcgctcgctcgcgtgcattggccgacaagggacgccacgccggcgtggctgctcacgtgttctcagttcttaccctgcgctctcgccgcccggggcaactggcgagcgagtgtggctgccgcttcctctccgagtcaggcgccatttaataattcaattctacccccaagcccacgcttccgaattcaccgactcctcctccacgccgcgtcgagatcgctcaggccttcgcttccagcaactccaccactcagcccacccgccggagcaatggggagcacggggcgcgagccggaggtgacccgcgccgacttccccgacggcttcgtcttcggcgtcgctacctccgcgtaccagattgaaggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaatgtcaatgatcaaggagtcgccttctataatgacctcatcaattttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagggtaaagcattggataacgatcaatgaacctctccaaactgcaatcaatggttatgggattggaatttttgcacctggaggatgccaaggtgaaactgctagatgttacttggctgcccatcaccaaatcttggctcatgctgctgctgttgatgtttatagaagaaaattcaaggttgcacaaggtggtgaagtagggttggttgttgattgtgaatgggcagagccattttctgaaaatgtggaagaccaaattgctgcacagcggaggcttgactttcaacttggatggtacctagatccaatatattttggtgattacccagaaagcatgcgtcagcgactgggcagtgatcttccaaccttttcagagaaagataaagagttcatgaggaacaaaattgattttgttggagtaaatcattatacttcaagactcattgctcatctccaaaatccaaatgatgtttatttctaccaagtgcaacaaatggagcgaatagaaaaatggaatagtggtgaaaaaattggtgaaagggctgcatctgaatggcttttcatagttccttggggccttcataagtcacttaattatatagcgaagaagtacaataatccagcaatttatgttactgagaatggcatggatgaagaggacgatcaatccgcaacgcttgaccaggtcctaaacgacacgacgagggtcggttacttcaaagggtacctcaattcagttgcgcaagcgatcaaggacggagctgatgtccgcgggtactttgcgtggtcgttcctggacaacttcgagtgggcaatgggctacaccaagaggttcggcatagtctacgtggactacaagaacgggctgtccaggcacccgaaagcatcggcgctgtggttctcgcgcttgctcaggggcgaggctggcactggcacaagctgagcgaactgcacgcaggaagcaagcacagaacgtcgttattacaatataaatattccacacaactagacgtttttctcctgttgttgtatcgtactactgtacagtaagcgccaataagctagcctcagatgtgtgctgcctgcctatacctctagtgactgccattgatccagcactagctgaaatgtacccggcctccaagaatcagcaccagaatatatgctttgaattgaactc

SEQ ID NO: 2923 - DNA, 1845 bp, Panicum virgatum
gacgcttccgaactcacccacctcccccgcgctccgccgagatcgctcgcgcctttcggttcaagcaactccaccgcctggagcaatggggagcacggggcgcgaggcggaggtggcccgcgccgacttccccgacggcttcgtcttcggcgtcgctacctccgcgtaccagattgagggagcaagaagggagggaggcaaaggagacaacatatgggatgtattcacagaagacaaagaacgtgtcttagatagaagcaatggagatattgcagtagatcattatcatcgatacagggaagacatcgagctcatggcaagtttaggttttcgcgcttacagattttctatatcttgggctcgtatatttcctgatggcatgggggggaaggtcaatgagcaaggagttgccttctataacaaccttatcaactttatgattgcaaaaggagttgagccttatgcaactctgtatcactgggatcttccaaacaatcttcaaaagactctggggggctggatttctgaaaagattgtggattactttgcattgtatgcagaagcttgctttgcaaatttcggagacagagtaaagcgttggatgacaatcaatgagcctctccaaactgcatttaatggttatgggattggagtttttgcacccggaggatgcgagggtgaaactgctagatgctacttggccgcccatcaccaaatcttggctcatgctgctgctgttgatgtttatagaagaaaattcaaggcagcacaaggtggtgaagtagggctggtcgtcgattgtgaatgggcagaaccgttttcggagaaagcggaagaccaaattgctgcacaacggaggattgactttcaatttggatggttcctggacccaatatatttcggtgattacccagaaagcatgcgtgagcggctgggcagtgatcttccaacattctcagagaaagagaaagaattcattaggaacaaaattgattttattggactaaaccattatacttcgagactcattgcccatcgtcagaatccagaagatgtttatttctatcaagtacaacaagtggagagaatagaaaaatggaatagtggtgaaaagattggtgaaagggctgcatctgaatggcttttcatagttccttggggccttcataaattacttaattatatagcgaagaaatatgataatccagcaatttatattactgagaatggcatggatgaggaagatgatcagtccgcaacactagagcaggttttaaatgacacgacgagagtcggttacttcaaaggatacctggcttcagttgcacaagcaatcaaggatggagttgatgtccgaggatacttcgcgtggtcattcttggacaactttgagtgggctatgggctacaccaagaggtttggcattgtttatgtggactacaagaatgggctctccaggcaccccaaagcatcagccctgtggttctcacgcttcctgaagggtgaggctgccgaaaacaaagctgatacaaactgagcaaacagcccgtggcaagtaaaggaacattacacatacagtcagtacaggttctcctgttgttgtaccgtatagtgtcgccactatatgtatcagtcataataatcacagatgcgctctgtagcctgtcattggtcgaacactagtacaaatgtagtctcgaaggttcagaacttcacaccgataaagtttcaaattcgtgcggggcagcacgctgttgcagataactcacgcttgttgtgctgtaattgttgtatcattgatctgcaaggttgcgttggcagttccaaaatccaactatatttcat

SEQ ID NO: 2924 - DNA, 1794 bp, Pennisetum glaucum
caagttcgcccactcccccacgcttcgccgagatcgctctcgccttccacctcaagcaaccccaccaccaagccccagcccccgacccgccggagcaatggggagcacggggagcgaggcggaggtgtcccgcgccgacttccccgaccgcttcatcttcggcgtcgccacctccgcataccagattgagggagcgagaagggagggaggcaaaggagacagcatatgggatgtcttcacagaggacaaagaacgtatcttagatggaagcaatggggatgttgcggtagatcattaccatcgatacaaggaagacattgagctcatggcaagtttaggttttggtgcatacagattttctatatcttgggcacgtatatttcctgatggcttgggggagaaggtcaatgagcaaggggttgccttctacaacgaccttatcaactttatgattgcaaaaggaattgagccttatgcaactctgtatcactgggatcttccaaacaatcttcaaaagactatagggggctggatttctgacaagattgtggattactttgcattgtatgcagaagcttgctttgcaaattttggagacagagtaaagcgttggataacaatcaatgagcctctccaaactgcagttaatgcttatgggattggagtttttgctcctggaggatgccaaggtgaaactgctagatgttacttggcagcccatcaccaaatcttggctcatgctgctgctgttgatgtttacagaagaaaattcaaggctgcacaaggtggtgaagtagggctggttgtcgattgtgaatgggcagagccattttctgacaaagtcgaagaccaaattgctgcacaacggaggattgactttcaacttggatggtacctagacccaatatactttggtgattacccagaaagcatgcgtcagcgactgggcagtgatcttccgaccttctcagagacagacaaagaattcatcaggaacaaaattgattttgttgggctgaaccattatacttcaagattcattgctcatcatcagaatccaaaagatatttatttctatcaagtacagcaagtggagagactagaaaaatggaatagtggtgaaaaaattggtgaaagggctgcatctgaatggcttttcatcgttccttggggccttcataaattacttaattatatagcgaagaaatataataatccagcaatttatgttactgagaatggcatggatgaggaagatgatcagtctgtaacactagagcaggctttaaatgacacgacgagagtcggttacttcaaaggatacctcgcttcagttgcacaagcaatcaaggacggagttgatgtccgtgcgtactttgcatggtcattcttggacaactttgagtgggctatgggctacactaagaggttcggcattgtttatgtggattacaagaatgggctgtcgaggcaccctaaagcatcggccctgtggttctcgcgcttcctgaagggtgagtctgccgaaaacaaagctgatacaaactgagcaaacacaatccgtatcaagtaaaggaacaatttacacatacagtcagtatacgtttctccagttgttgtatcttacagtgaccaccaatgttaccaatgtatgtactcatcgtaataatctcacatgtgttgtgtagcttgtcatttggttggacacgacactagttcagatgtagcctctaaggttcagaactcttcaccaataagtttcaaaatcgtgccaggctgcactggagttgcata

SEQ ID NO: 2925 - DNA, 1867 bp, Panicum virgatum
ggacgcttccgtactcacccacctccccggcgcttcgtcgagatcgctcacgcctttcggttcaagcaactccaccgcccaccccacccaccggagcaatggggagcacggggcgcgaggcggaggtggcccgcgccgacttcccggacggcttcgtcttcggcgtcgctacctccgcgtaccagattgagggagcaagaagggagggaggcaaaggagacaacatatgggatgtcttcacagaagacaaagaacgtgtcttagacagaagcaatggagatattgcagttgatcattatcatcgatacagggaagacattgagctcatggcaagtttaggttttcgcgcttacagattttctatatcttgggctcgtatatttcctgatggcttgggggggaaggtcaatgagcaaggagttgccttctataacaaccttatcaactttatgattgcaaaaggaattgagccttatgcaactctgtatcactgggatcttccaaacaatcttcaaaagactctggggggctggatttctgaaaagattgtggattactttgcattgtatgcagaagcttgctttgcaaattttggagacagagtaaagcgttggataacaatcaatgagcctctccaaacttcagttaatgcttatgggattggagtttttgcacctggaggatgcgagggtgaaactgctagatgctacttggccgcccatcaccaaatcttggctcatgctgctgctgttgatgtttatagaagaaaattcaaggctgcacaaggtggtgaagtaggactggtcgttgattgtgaatgggcagaaccgttttcagagaaagcagaagaccaaattgctgcacaaaggaggattgactttcaacttggatggtacctggacccaatatatctcggtgattacccagaaagcatgcgtgagcgggtgggcaatgatcttccaacattctcagagaaggataaagaattcatcaggaacaaaattgattttgttggactaaaccattatacttcgagactcattgctcatcatcagaatccaggagatatttatttctatcaagtacaacaagtggagagaatagaaaaatggaatactggccaaaagattggtgaaagggctgcatctgaatggcttttcatagttccttggggccttcataaattacttaattatatagcaaagaaatatgataatccacctatttatattactgagaatggcatggatgaggaagatgatcagtccgcaacactagagcaggctttaaatgacacgacgagagtcggttacttcaaaggatacctcgcttcagttgcacaagcaatcaaggacggagttgatgttcgtggatacttcgcgtggtcattcttggacaactttgagtgggctatgggctataccaagaggtttggcattgtttatgtggactacaaaaatgggctcgccaggcaccccaaagcatcagccctgtggttctcacacttcctaaagggtgaggctgccgaaaacaaagctgatacaaactgagcaaacagcccgtggcaagtaaaggaacattacacatatactcactacatgttctcctgttgttgtaccttacagtgatcgccactgtatgtatccatcataataatcacagatgcgctgtgtagcctgtcattggtcgaacactagtacaaatgcagtcttgaaggttcagaacttcacaccgtaaagtttcaattcgtgcggggcagcacgctgttgcagataactcagacttgtcatctgagcaacccatgcattcggtattgctgtgctgtaattgttgtatcattgatctgcaaggttgtattgccagttcc

SEQ ID NO: 2926 - DNA, 1646 bp, Pennisetum glaucum
aggagacagcatatgggatgtcttcacagaggacaaagaacgtatcttagatggaagcaatggggatgttgcggtagatcattaccatcgatacaaggaagacattgagctcatggcaagtttaggttttggtgcatacagattttctatatcttgggcacgtatatttcctgatggcttgggggagaaggtcaatgagcaaggggttgccttctacaacgaccttatcaactttatgattgcaaaaggaattgagccttatgcaactctgtatcactgggatcttccaaacaatcttcaaaagactatagggggctggatttctgacaagattgtggattactttgcattgtatgcagaagcttgctttgcaaattttggagacagagtaaagcgttggataacaatcaatgagcctctccaaactgcagttaatgcttatgggattggagtttttgctcctggaggatgccaaggtgaaactgctagatgttacttggcagcccatcaccaaatcttggctcatgctgctgctgttgatgtttacagaagaaaattcaaggctgcacaaggtggtgaagtagggctggttgtcgattgtgaatgggcagagccattttctgacaaagtcgaagaccaaattgctgcacaacggaggattgactttcaacttggatggtacctagacccaatatactttggtgattacccagaaagcatgcgtcagcgactgggcagtgatcttccgaccttctcagagacagacaaagaattcatcaggaacaaaattgattttgttgggctgaaccattatacttcaagattcattgctcatcatcagaatccaaaagatatttatttctatcaagtacagcaagtggagagactagaaaaatggaatagtggtgaaaaaattggtgaaagggctgcatctgaatggcttttcatcgttccttggggccttcataaattacttaattatatagcgaagaaatataataatccagcaatttatgttactgagaatggcatggatgaggaagatgatcagtctgtaacactagagcaggctttaaatgacacgacgagagtcggttacttcaaaggatacctcgcttcagttgcacaagcaatcaaggacggagttgatgtccgtgcgtactttgcatggtcattcttggacaactttgagtgggctatgggctacactaagaggttcggcattgtttatgtggattacaagaatgggctgtcgaggcaccctaaagcatcggccctgtggttctcgcgcttcctgaagggtgagtctgccgaaaacaaagctgatacaaactgagcaaacacaatccgtatcaagtaaaggaacaatttacacatacagtcagtatacgtttctccagttgttgtatcttacagtgaccaccaatgttaccaatgtatgtactcatcgtaataatctcacatgtgttgtgtagcttgtcatttggttggacacgacactagttcagatgtagcctctaaggttcagaactcttcaccaataagtttcaaaatcgtgccaggctgcactggagttgcatattactgccacttgtcatctgaacacccccatgcattcggcattgctgtgcagtaattgttgcgtc

SEQ ID NO: 2927 - DNA, 2200 bp, Hordeum vulgare
gagggacatcagagcgacagcggctgctccttcgctcgccgggcgcacccaccctccccctatatctacgcgactcgactcggctggactcgagcctccatcagccgactccccccaaattctcgcccgcccacgacccacgctcgcggcgcgccggatcgagatcacctcaagctcagcaccaggcctgctccgctctccccctcgccgggaatggggagcacggcgggcgaggtgacccgcgccgacttccccgagggcttcgtcttcggcgtcgccacctccgcctaccagatcgagggggggagaaatgaaggtggcaaaggcgatagcatatgggatgtatttacagataacaaagaacgtgtcctagacggatcctctggagaagttgcagttgatcattaccatcgatacaaggaagacattgagctcatggccaagttgggttttggtgcttatagattttccatatcttggtcacggatatttcctgatggcttagggacagagatcaatgagcaaggagttgctttctataacaaccttatagatttcatgattgagaaaggtattcagccttatgcaactttgtatcactgggatcttccacataatcttcagcggactatggggggttggctttcagacaagattgtagagtacttcgcattatatgcagaagcttgctttgcaaactttggagacagagttaagcattggataacaatcaatgaacctattcaaacatgcattaatgcttatgggattggaatattcgctcctggattatgtaaaggtgtatctgctgaacctttcttggctggccatcaccagatcttagctcatgctgctgctgttgatgtctacagaagaaaattcaaggctaaacaaggtggtcaagtagggtttgttattgattgtgaatgggcagagccaatgtctgacaaaatggaagaccaggctgctgcagcacggcgcattgactttcaacttggatggttcctggacccaatatactttggtgattacccagaaagcatgcgccagagagtgggtgaacatcttccaaaattctcagagaaagaccgtgaattgatgaggaacaaaattgattttattggattaaatcactatacatcaagaatcattggtcatcagccgaacccacaaccagaagagatccatttttatcaggttcaacaaatagatagaacagacaaatggagcagcggtgaagcagttggtgaaagagccgcgtctgagtggcttttaatagtaccttggggcattcggaaaacaattaactatatagtaaagaaatatgaaaatccaataatatatataacagagaatggcatggatgacgaagatgatccatcagcaccagttgatcagttcttaaatgacacaaggagggttaatttcttcaaaggatatgttggtggagtcgcacaagcaataaaggatggtgccgatgttcgtggatactttgcatggtcattcctggataactttgagtgggcgatgggattcaccaagaggtttgggattgtctatgttgattacaagaatgggctctcccgacaccctaaagcatcagccatgtggttctcccgcttcctgaatggcgaggctcctgacagcaaacctgacacaaactaagcctgcattcaccaagggatggcactgacgttggtggatagtctggatggtcattccctgggcaactttgagtggtatacaggatacaccaagagaggtttggtacggggatgcgatttgggggcattccgaagcatcagccctgtacgtggttctcacacctgtcgaaaaccaagacggcgtgagccgagccatctcacagcaagtaaatgaacattacagagtagtcgtttcccttattgttgttgtcgccgtcgtatctgctctgaataaaaattgtacccatctcacatgcccttctatacgggccgtgattaatccattgattgctcaaacggatgtttaacgagccagagtgctctgctaataagttgtgagttcatgtcagccaacacacctatgtatgtgtggtacttcgctgctgctgctgctgctgtgttagtcatgtagccaacacacctatgtatgtgtggtacttcgctgctgctgctgctgtgttagtcatgtagtttgtggccttcataggccctcctag

SEQ ID NO: 2928 - DNA, 2349 bp, Triticum aestivum
gaccagatccaaaccggcagagagcgactgcagtctgcggccgctctcccgcggactcgccggccccggccgcaccctcgcctatatctacgcgacgcgaccccctcagtctcgctcgcagcgcctcccaaaccttcgcccacccacgcgcctcacggtcgcgccgcgccggatcgggatcaagtcacgcttagcaccacgcggccgctctcgctttcgccgtcgccgggaatggggagcacggcgggcgaggtcacccgcgccgacttccccgagggcttcgtcttcggcgtcgccacctccgcctaccagattgagggggcaagaaatgaaggtggcaaaggcgatagcatatgggatgtatttacagataacaaagaacgtgtcctagacggatcctctggagaagttgcagttgatcattaccatcgatacaaggaagacattgagctcatggccaagttgggttttggtgcttatagattttccatatcttggtcacggatatttcctgatggcttagggacagaaatcaatgagcaaggagttgctttctataacaaccttatagatttcatgattgagaaaggtattcagccttatgcaactctgtatcactgggatcttccgcataatcttcagaagactatggggggttggctttctgacaagattgtagagtacttcgcattatatgcagaagcttgctttgcaaattttggagatagagttaagcattggataacaatcaatgaacctattcaaacatgcattaatgcttatggggttggaatatttgctcctggattatgtaaaggtgtagctgctgaacctttcttggctggccatcaccagatcttagctcatgctgctgctgttgatgtctacagaagaaaattcaaggctaaacaaggtggtcaagtaggatttgttattgattgtgaatgggcggagccaaagtcggacaaaatggaagaccaggctgctgcagcacggcgcattgactttcaacttggatggttcctggacccaatatactttggtgattacccagaaagcatgcgccagagagtgggcgaatatcttccaaaattctctgagaaagaccgtgaattgatgaggaacaaaattgattttattggattaaatcactatacatcaagaatcattggcaatcagccgaacccacaaccacaagagatccatttttatcaggttcaacaaatagagagaacagacaaatggagtagcggtgaagcaattggtgaaagagctgcgtctgagtggcttttaatagttccctggggtattcggaaaacaatcaattatatagtaaagaaatatgaaaatccaataatatatgtaacagagaatggcatggatgacgaagacgatccatcagcaccagttgatcagttcttaaatgacacaaagagggttaatttcttcaaaggatatgttggtgcagtcgcacaagcaataaaggatggcgccgacgttcgtggatactttgcatggtcattcctggataactttgagtgggcgatgggattcaccaagaggtttgggattgtctatgttgattacaagaacgggctcacccgacaccctaaagcatcagccatgtggttctcacgcttcttgaacggcgagaccgctgacagcaaacctgacacaaactaagcccctcattcaccaagggatggcactgatgttcgcgggtagttcggatggccattcctgggcaactttgagtgggctacatacagtatacaccacgagaggtttggtacaaggatgagcattggggacattccgaagcaccagcccagtacgtggctctcacacccgtcgaagaccaacacggcgcgagctgagccatctcacagcaagtaaatgaaacattatacgagttgttgttgttgctgctgttgttgtatcgtaccacgactgccatctactcaaaataataatcgtagcccatctcagatacacttctatacgggccacgattagtccattgattgttcaaatggatgtttaaggggccagagttccctgctaataaattatacgagttcatgtcagccaaccctgttagacaacgctgcctatgtatgtttgctactctgctgctgctgtattagtcctgtaatgtctggccttcatagcccctcctaggaagcaattgctagccaccagaaatttgtttctgttctgctggagttcttcattagaggaacttgcttctgacaggttagacccaccgagaaccactttgaactttggatgattggtgaagagcaaagtgacatgtcacatacagtaaaataaagaggtggttaaagc

SEQ ID NO: 2929 - DNA, 2074 bp, Triticum aestivum
  misc_feature (531)..(531): n is a, c, g, or t
  misc_feature (666)..(666): n is a, c, g, or t
gaccagatccaaaccggcagagagcgactgcagtctgcggccgctctcccgcggactcgccggccccggccgcaccctcgcctatatctacgcgacgcgaccccctcagtctcgctcgcagcgcctcccaaaccttcgcccacccacgcgcctcacggtcgcgccgcgccggatcgggatcaagtcacgcttagcaccacgcggccgctctcgctttcgccgtcgccgggaatggggagcacggcgggcgaggtcacccgcgccgacttccccgagggcttcgtcttcggcgtcgccacctccgcctaccagattgagggggcaagaaatgaaggtggcaaaggcgatagcatatgggatgtatttacagataacaaagaacgtgtcctagacggatcctctggagaagttgcagttgatcattaccatcgatacaaggaagacattgagctcatggccaagttgggttttggtgcttatagattttccatatcttggtcacggatatttcctgatggcttagggacaganatcaatgagcaaggagttgctttctataacaaccttatagatttcatgattgagaaaggtattcagccttatgcaactctgtatcactgggatcttccgcataatcttcagaagactatggggggttggctttcngacaagattgtggagtacttcgcattatatgcagaagcttgctttgcaaattttggagatagagttaagcattggataacaatcaatgaacctattcaaacatgcattaatgcttatggggttggaatatttgctcctggattatgtaaaggtgtagctgctgaacctttcttggctggccatcaccagatcttagctcatgctgctgctgttgatgtctacagaagaaaattcaaggctaaacaaggtggtcaagtaggatttgttattgattgtgaatgggcggagccaaagtcggacaaaatggaagaccaggctgctgcagcacggcgcattgactttcaacttggatggttcctggacccaatatactttggtgattacccagaaagcatgcgccagagagtgggcgaatatcttccaaaattctctgagaaagaccgtgaattgatgaggaacaaaattgattttattggattaaatcactatacatcaagaatcattggcaatcagccgaacccacaaccacaagagatccatttttatcaggttcaacaaatagagagaacagacaaatggagtagcggtgaagcaattggtgaaagagctgcgtctgagtggcttttaatagttccctggggtattcggaaaacaatcaattatatagtaaagaaatatgaaaatccaataatatatgtaacagagaatggcatggatgacgaagacgatccatcagcaccagttgatcagttcttaaatgacacaaagagggttaatttcttcaaaggatatgttggtgcagtcgcacaagcaataaaggatggcgccgacgttcgtggatactttgcatggtcattcctggataactttgagtgggcgatgggattcaccaagaggtttgggattgtctatgttgattacaagaacgggctcacccgacaccctaaagcatcagccatgtggttctcacgcttcttgaacggcgagaccgctgacagcaaacctgacacaaactaagcccctcattcaccaagggatggcactgatgttcgcgggtagttcggatggccattcctgggcaactttgagtgggctacatacagtatacaccacgagaggtttggtacaaggatgagcattggggacattccgaagcaccagcccagtacgtggctctcacacccgtcgaagaccaacacggcgcgagctgagccatctcacagcaagtaaatgaaacattatacgagttgttgttgttgctgctgttgttgtatcgtaccacgactgccatctactcaaaataataatcgtagcccatctcagatacacttctatacgggccacgattagtccattgattgttcaaatggatgtttaaggggccagagttccctgctaataaattata

SEQ ID NO: 2930 - DNA, 1429 bp, Saccharum officinarum
ggggaacacgcacgcacagagagaccaggttccaagcaaaaggcagtgcaggcagggcgagtggagctagcgtgaccttgcgttgcctttgcttgtgtccagaggagaagcagagcagcgggtggtgcacctgcacgtagcaactctgaccatggcggatcaccagcggatccaccctgtggacctggaggccggcagcaatcggccgacggcgccgctggtgccaggaggctcgttccggtcggacaagggcgacccggcgcggagcgcgaaccagcagcagcagcagcaacaacaacgggcctacgtccccggcggccccctgcctccgccgccgcgccgcgtcgcgccagaggcaccgcttcctccgccgcggaagcggcgcggcggccggggctgctgctgccggttcctctgctgcgtggtgatcacggccgtcgtgctggcggtgctcgccgcggcggcggcgggcgcgctgtacctggcgctcgaccccaaggcgccgcgctactcggtggaccgcctctccgtgtcggcgttccaggtggacccgtcgacgctgacggcgcgggccgggttcgacgtgacggtgacggcggcgaacccgaactcgcgcatcggcatccagtacgagcccgggtccagcctgggcgtgtggtaccagtcgtaccgcctggcgcggggcgcgctgccggccttctaccagggccaccgcaacaccacggtgctggcgctggccatggccggggaggtgcagctgggcaccgccgtcgtgtccggattgcaggacgcgcagcggacgggcgccgtgccgctcgtgttccgcgccgacgtgcccgtgcgcgtcgagatcggcagcttcaagctgtggaaggtcacgtccagggtgcgctgcgacctcgtcgtcgacaggctcatggacgtcagtagtcccatcaagatcaaggccagcaactgcaagttcagcttgaagctgtgattcataaattcgttgccgcggttttatttctttgggtcgtctgttctctctttgcattgggagagagttgagagtcgttgcgttggattcttttggcagagtgctggccgtgtggtagtatttgcacaggtgcagggcactcccgccaacctcgtcggtgttcatcccggccatgtacagatggtaccagtagtacattattgctgttattagagaggaataatatgcatgactagatttttataaaaaaaaaaaaaaatagggtggtctgttttaaagatctctacttatcgtcgctttcattgtgacttcatttgttcttctattttttcctactcataattatttttatttgtttttacgttttacagtcgatgtcgctttgtataaaccatcttgctgtgactaactttatattgaactttttcttatcgttactttttttggttc

SEQ ID NO: 2931 - DNA, 1428 bp, Saccharum officinarum
aacacgcacgcacagagagaccaggttccaagcaaaaggcagtgcaggcagggcgagtggagctagcgtgaccttgcgttgcctttgcttgtgtcgagaggagaagcagagcagcgggtggtgcacctgcacgtagcaactctgaccatggcggatcaccagcggatccaccctgtggacctggaggccggcagcaatcggccgacggcgccgctggtgccaggaggctcgttccggtcggacaagggcgacccggcgcggagcgcgaaccaccagcagcagcagcagcagcaacaacgggcctacgtccccggcggccccctgcctccgccgccgcgccgcgtcgcgccagcggcaccgcttcctccgccgcggaagcggcgcggcggccggggctgctgctgccggttcctctgctgcgtggtgatcacggccgtcgtgctggcggtgctcgccgcggcggcggcgggcgcgctgtacctggcgctcgaccccaaggcgccgcgctactcggtggaccgcctctccgtgtcggcgttccaggtggacccgtcgacgctgacggcgcgggccgggttcgacgtgacggtgacggcggcgaacccgaactcgcgcatcggcatccagtacgagcccgggtccagcctgggcgtgtggtaccagtcgtaccgcctggcgcggggcgcgctgccggccttctaccagggccaccgcaacaccacggtgctggcgctggccatggccggggaggtgcagctgggcaccgccgtcgtgtccggattgcaggacgcgcagcggacgggcgccgtgccgctcgtgttccgcgccgacgtgcccgtgcgcgtcgagatcggcagcttcaagctgtggaaggtcacgtccagggtgcgctgcgacctcgtcgtcgacaggctcatggacgtcagtagtcccatcaagatcaaggccagcaactgcaagttcggcttgaagctgtgattcataaattcgttgccgcggttttatttctttgggttgtctgttctctctttgcattgggagagagttgagagtcgttgcgttggattcttttggcagagtgctggccgtgtggtagtatttgcacaggtgcagggcactcccgccaacctcgtcggtgttcatcccggccatgtacagatggtaccagtagtacattattgctgttattagagaggaataatatgcatgactagatttttataaaaaaaaaaaaaaatagggtggtctgttttaaagatctctacttatcgtcgctttcattgtgacttcatttgttcttctattttttcctactcataattatttttatttgtttttacgttttacagtcgatgtcgctttgtataaaccatcttgctgtgactaactttatattgaactttttcttatcgttactttttttggttc

SEQ ID NO: 2932 - DNA, 1270 bp, Saccharum officinarum
  misc_feature (594)..(594): n is a, c, g, or t
  misc_feature (616)..(616): n is a, c, g, or t
  misc_feature (622)..(622): n is a, c, g, or t
  misc_feature (624)..(624): n is a, c, g, or t
  misc_feature (637)..(637): n is a, c, g, or t
  misc_feature (686)..(686): n is a, c, g, or t
  misc_feature (694)..(694): n is a, c, g, or t
  misc_feature (703)..(704): n is a, c, g, or t
  misc_feature (707)..(707): n is a, c, g, or t
  misc_feature (716)..(716): n is a, c, g, or t
  misc_feature (725)..(726): n is a, c, g, or t
  misc_feature (747)..(747): n is a, c, g, or t
  misc_feature (752)..(752): n is a, c, g, or t
aaggtcgcatggaatatgcttgcttagtggttttaaaaaaaaaaaaaaagggcggccctcgcgatctagaactaggggaacacgcacgcacagagagaccaggttccaagcaaaaggcagtgcaggcagggcgagtggagctcttgcgttgcctttgcttgtgtcgagaggagaagcagagcagcgggtggtgcacctgcacgtagcaactctgaccatggcggatcaccagcggatccaccctgtggacctggaggccggcagcaatcggccgacggcgccgctggtgccaggaggctcgttccggtcggacaagggcgacccggcgcggagcgcgaaccaccaccagcagcaacgggcctacgtccccggcggccccctgcctccgccgccgcgccgcgtcgcgccagcggcaccgcttcctccgccgcggaagcggcgcggcggccggggctgctgctgccggttcctctgctgcgtggtgatcacggccgtcgtgctggcggtgctcgccgcggcggcggcgggcgcgctgtacctggcgctcgaccccaaggcgccgcgctactcggtggaccgcctctccgtgtcggngttccaggtggacccgtcgacnctgacngngcgggccgggttngacgtgacggtgacggcggcgaacccgaactcgcgcatcggcatccagnacgagccngggtccagnntgngcgtgtggnaccagtcgnnccgctggcgcggggcgcgctnccggnctttaccagggccaccgcaacaccacggtgctggcgctggccatggccggggaggtgcagctgggcaccgccgtcgtgtccggattgcaggacgcgcagcggacgggcgccgtgccgctcgtgttccgcgccgacgtgcccgtgcgcgtcgagatcggcagcttcaagctgtggaaggtcacgtccagggtgcgctgcgacctcgtcgtcgacaggctcatggacgtcagtagtcccatcaagatcaaggccagcaactgcaagttcggcttgaagctgtgattcataaattcgttgccgcggtttttatttctttgggttgtctgttctgtctttgcattgggagagagttgagggtcgttgcgttggattcttttggcagagtgctggccgtgtggtagtatttgcacaggtgcagggcactcccgccaacctcgtcggtgttcatcccggccgtgtacagatggtagtatataattgctgttagagaggaataatatgcatggcgagatttttat

SEQ ID NO: 2933 - DNA, 1525 bp, Zea mays
agcgtgccgttgggggcaggtggagacttcacgtccccgcctcctatgtcctatcgcagtcgcaccacgcataaacccctatcgcagtcgcacctgcgcagctgcactgcccctcacagacgagtcaaccgcctttccacctcctcgccgtcgttccgtagtggcgccgcctatatagagagcgaaccgcgcgaggtcccagcacagcagccaggattccacaaacagagaggccaggttccaagcaaaggcagtgcaggcagggcgtgtggagaagcagagcagcgggtggcgcacctgcacgtgccaggctgccagctctggccatggcggatcaccagaggatccaccctgtcgacctggaggccggcaatcggccaacgacgccgctggtgccgggaggctcgttccggtcggacaagggcgacccagcgcagcgcgcgaacaaccaccaccaacaacagcaacaacgaggctacgtctacgtcccggggcctctgcctccgccgccgcgccgcgccgcgccaccggcgccgccgctgccgccgccgaagcggcgcgggcggggctgctgctgccggttcctctgctgcgccgtgataaccgcggtcgtgctggcggtgctcgccgcggcggcggcgggcgcgctgtacctgttgctggaccccaaggcgccgcggtactcggtggaccggctctctgtctccacgttccaggtggacccgtcgacgctgacggcgcgggccgggttcgacgtggcggtgacggcggcgaaccccaactcgcgcatcgccatccagtacgagcccgggtccagcctgggcgtgtggtaccagtcgtaccgcctggcgcggggcgcgctgccgcccttctaccagggccaccgcaacaccacggtgctggcgctggccatggccggggaggtgcagctgggcggcgccgccgtggccgggatgcgggacgcgcagcggacgggcgccgtgccgctcgtgttccgcgccgacgtgcccgtgcgcgtcgagctcggcacctttaagctctggaaggtcacgtccagggtgcgctgcgacctcgtcgtcgacaggctcatggacgtcagcagccccatcaagatcaaggccagcaactgcaagttcggtctgaagctgtgattcgttcgtcgccgcgttggattcttttggctggctgagtgctggacctgcttgctggtagtatttgcgcaggtgcagacgtgcagtgcactcccgccaacctcgtcggtgttcatcccggctgtgtacagatggtagtgtatcattgctgttatagaggaataattttgcatcgattgttttttataattctagagctactacttctatcgccgcgcacacagttgaatggggaagacaaaacaaccaaatggaaaatggctctagtaccattctccgttactcgacatgagagagcgatggagcagaaatgccatgttttactaacaaagtagcttgatattttgataatggtaaggccaggaaggatccat

SEQ ID NO: 2934 - DNA, 1843 bp, Zea mays
gtctcggcagccaccagcccgctctccgctcctgtccacgcgaccacgcgccaccccaccaaccggcgcagcgctctgccggctgccgctctccaactccgaaccccacggcgaaaacgcagtaaaataagcgaaaagcgctgccacccctgggccacggcacacaccggacgacgcgcagtggctgcgtgccgttgggggctggtggagacttcacgtctccgcctcccgccgggcttactcgccggcgcccaccctcgagtcgacacgcgcgcacataaacaagtcaaaacagaagtcaacccgcccctccgccacctcgccgtcgtgccgtactgtcgtgtatcctagccccgcgcctccttcctatatagagagagcgagccgcgcgaggtctctgcagccagaaacagagctgggcgcacggagagaccaggttccaagcgaaggcagtgcaggcaggacgagtggagctagcgtgaccttgcgttgccttcgccgctttgcttgtgtcgagaggagaagcagagcagcgggacacgagcagcgggttggaggttgacaatggctgatcaccagaggatccacccagcggacctggaggccggcaaccggccgctgatgccgggaggctcgttccggtcggacaagggcgacccggcgcagcgcgcgaagcagcagcaacaacaaggctacgttcccggggccctgcctccgccgccgcgccgcgtcgcgccaccggcgccgctgccgccgccgaagcggcggggccggggctgctgctgccggctcctctgctgcgccgtgatcagcgcggcagtgctggcggtgctcgccgcggcggcggcgggcgcgctgtacctggcgctggaccccaaggcgccgcggtactcggtggaccgcctctccgtgtcggcgttccaggtcgacccggcgacgctggcggcgcgggcccggttcgacgtggcggtggcggcgacgaaccccaactcgcgcatcggcatccactacgagcgcgggtccagcctgggcgtgtggtaccagtcgtaccgcctggcgcggggcgcgctgccggccttctaccagggccaccggaacacgacggtgctggcgctggccatggccggcgaggcgcagctgggcagcgccgccgtcgtgtcggggatgcaggacgcgcagcggacgggcgccgtgccgctcgtgttccgcgccgacgtgcccgtgcgcgtccagctcggcaccttcaagctctggaaggtcacggccagggtgcgctgcgacctcgtcgtggacaggctcatggacgtcaccagtctcatcaagatcaaggccggcaactgcaagttcagcttgaagctctgattcattgggttttcagttttctgttctctcttttggagcgagttcagagtcgttgcgttggattctcttggcagagtgctggccgtgcacaggtgcatacgtgcagtgcagtgcactcccgccaacctcgttggcgttcatctgggccgacgtgtacaggtggtagtatataattgttgttagagagggacaatacgcatggctagaattttataattctagagttacttctatcaccacacaactgaatgcacaagacgcaacaaccaaatggaaaatgtgtgcctgccaatggaaagcacatcacaactacttctgcagcagcaaaatggaaaatcgaatcacccactccagagaagcttggatttacaagcaaaagggttgttgtgagttcgctctagcaggaatttacttgcagacacaggtacaaagacagatttgcatatcaattcgtggaagatggaggtcgatacagtcacac

SEQ ID NO: 2935 - DNA, 2240 bp, Zea mays
gaagaaatgttagaagaaatttgaggtaatatataaacatatttgaatttgttttgatatatttgagttttttatcatataaaaaatttgtcgatgtacttagaagaaagtaaaaaaaattatagatgaagctttaaaggccccaattttttgtttcgccctgggtccctgaaattttaggaccggccctgctcggcggtgagcaactcctgccgtgtcttgctaccgttccgctgcacggccagccatcgccgctcgacggcctacgtgatcgacgcggagcggcagcgtgaagccacccaccgcggcgcgccacgcgtgagcagctgcagctctgccgcgtgctggagcggtggctgcagcgtcccgatcgaattcacgtgcccgcgcacggcacggaaaaggccccgcctccgacacacatcctccgacccccatttccgtccgtgtggcccatgtgcagcttcagacatcgagccgtctttccgtccaccgtccattttggccaattccctgtatgccactggaaaatatactcattccttgtatgccactggccccacatatcatagacatcaaaaaatatacctatatgtcacttaatggcacacaagggatgagtataaaatctgatggcataccaggaattttctcaaaagggaacgccgcgccgcgccgcgccgcgccgcgccgcaccgcggtgacgcgtctcggcagccaccagcccgctctccgctcctgtccacgcgaccacgcgccaccccaccaaccggcgcagcgctctgccggctgccgctctccaactccgaaccccacggcgaaaacgcagtaaaataagcgaaaagcgctgccacccctgggccacggcacacaccggacgacgcgcagtggctgcgtgccgttgggggctggtggagacttcacgtctccgcctcccgccgggcttactcgccggcgcccaccctcgagtcgacacgcgcgcacataaacaagtcaaaacagaagtcaacccgcccctccgccacctcgccgtcgtgccgtactgtcgtgtatcctagccccgcgcctccttcctatatagagagagcgagccgcgcgaggtctctgcagccagaaacagagctgggcgcacggagagaccaggttccaagcgaaggcagtgcaggcaggacgagtggagctagcgtgaccttgcgttgccttcgccgctttgcttgtgtcgagaggagaagcagagcagcgggacacgagcagcgggtggtgcacgtagcagctgctgcggttggaggttgacaatggctgatcaccagaggatccacccagcggacctggaggccggcaaccggccgctgatgccgggaggctcgttccggtcggacaagggcgacccggcgcagcgcgcgaagcagcagcaacaacaaggctacgttcccggggccctgcctccgccgccgcgccgcgtcgcgccaccggcgccgctgccgccgccgaagcggcggggccggggctgctgctgccggctcctctgctgcgccgtgatcagcgcggcagtgctggcggtgctcgccgcggcggcggcgggcgcgctgtacctggcgctggaccccaaggcgccgcggtactcggtggaccgcctctccgtgtcggcgttccaggtcgacccggcgacgctggcggcgcgggcccggttcgacgtggcggtggcggcgacgaaccccaactcgcgcatcggcatccactacgagcgcgggtccagcctgggcgtgtggtaccagtcgtaccgcctggcgcggggcgcgctgccggccttctaccagggccaccggaacacgacggtgctggcgctggccatggccggcgaggcgcagctgggcagcgccgccgtcgtgtcggggatgcaggacgcgcagcggacgggcgccgtgccgctcgtgttccgcgccgacgtgcccgtgcgcgtccagctcggcaccttcaagctctggaaggtcacggccagggtgcgctgcgacctcgtcgtggacaggctcatggacgtcaccagtctcatcaagatcaaggccggcaactgcaagttcagcttgaagctctgattcattgggttttcagttttctgttctctcttttggagcgagttcagagtcgttgcgttggattctcttggcagagtgctggccgtgcacaggtgcatacgtgcagtgcagtgcactcccgccaacctcgttggcgttcatctgggc

SEQ ID NO: 2936 - DNA, 1425 bp, Pennisetum glaucum
ggtggcggcgctggcggcggcggaggcggcgtcggcggcggcggtgagctgcggcgaggtgacgtcggcggtggcgccgtgcctggggtacgcgatgggcggctcctccttctccctcgcaagtcaaccgcctttcacctcctcgccatcgccctctagtggcgtgacgcctagtcccgcgatctatatagaaagagagccgcgcgggtctctgcggcaaggatcggaggggtggaacacgcgcacgcacgctcgtgcagaccaggcagcaagcaaaggcaggggggagtggaggaggtggagccagcgcgatcgcttcccctttgcttgcttctgccgcggacaagacgcgggtggtgcacgtagcagccgtacgtcgcggttctgagctctcggccatggcggatcaccagaggatccacccggtggacctggagtccggcaacaacaaccggccgacggcgccgctggtgcccggcggctccttccggtccgacaagggcgacccggcggcgcagcgcgccgtcaacccccaccaccaataccaacagcaccaccagcagcagcagcggggccacggcccgctgcctccgccgccgcgccgcgtcgggccaccggcgcctctgccaccaccaaagcgccggggccgccggggctgctgctgccggctcctctgctgcgccgtggtcacgcttgtcctgctggccgtgctcgccgcggcggcggcgggggcgctgtacctcatcctcaagcccaaggcgccgcggtactcggtggaccgcctgtccgtgtccgcgttccaggtggacccgtcgacgctcacggctcgggcggcgttcgacgcgaccgtgacggcggcgaacccaaactcccgcatcggcatccactacgagcgcgggtccagcctcagcgtgtggtacgagtcgtaccgcctggcgcggggcgcgctgccgaccttctaccagggccaccgcaacaccacggtgctggcgctcgccatggccggggaggtgcagctggggagcgcggtggtgtcgggcctgcgggacgcgcagcaggccggggccgtcccgctcgtgttccgcgccgacgtgcccgtgcgcgtccagctcggcgccgtcaagctgtggaaggtcacgtccagggtgcgctgcgacctcgtcgtcgacaggctcatggacctcagcacccccatcaagatcaaggccagcaactgcaagttcagcttgaagctgtgatttgttcactgctgctgctgctgctgcgctctagatttcttaatttggttttccagttgggagagaggagttgcgatttgattcttttggcgcggcggagtgctggccgtgtggtttttgcacaggtgcactctcccgccggcgcccacagcgtcgtgttcatcttgtgtacagattgtagcatatt

SEQ ID NO: 2937 - DNA, 1982 bp, Zea mays
catgtggcggatgcgtactaccgtctccgcacgccagaaccccaaaaccccagcggccagcaaaagcagcggcggcgcggccagggaccgacgtacccgccgcgagaagctccggttggcaccccaacggcatggatgctagcagcgtcagcccgtgcgatctagacagggagtttgcgctccaaatcgctcagctcctcgccacgcctcctctccaatcagcccaggaatactatggtgaactcatacggtccaagaagcttgatggcattagagtgagctacagtggcaagcatgggaaaggtgtttatgcaaatagggactttggtgaagacgaccttgttctgaaggaccaaatgttggtcggtgctcaggacagccttaacaagattgactgtgttgtgtgtagttactgcttccacttcattggttctatagagtaccaaattgggcgtagattgtatttgcaaagccttggtggtagtggtgatggcactaccgagagacactgccatgggagtgatgttgggtcaagtactggctgttccggtgcatcaaatggaaatagcaatgctgtgccacaagaggtcctgttgtcacttatggatggtaatacgctgttgcctttaaccgatcagttctgtttgccaccagttgttgcttgccctggtggatgtgagggagaactctactgcagccaatcatgtgcggattccgattgggattcttatcactctttgctgtgtgctggatccaagactgaaccattgcggaaatctgcccttcagaaatttgtggggcatgctaatgaaaccaatgatatttttttggttgctgccaaggctatcactttcaccttgttgagatataggaaactcaaaagacagcatgtgtctcatgaatcaagctcttcgctcctcttggaagcatggaaaccactttcaatgggcttcaaaaagagatggtgggagtgtgttgctttgcctgaagatgttgattccagtgaagaagaattgtttagacagcagataagggatctggcgtttacgtcactgcagcttctcaaggatgcaatctttgatcctgagtgtgcgcctttgttttcgcttgacatctatggccatataattggcatgtttgagctgaacaatcttgatttagttgtcgcatcaccagttgaagactatttcatatacattgacggtcttccagagagcgacaaggaggaagcagagaaggtgacagggccattcctagatgctttaggagaagactacttagttccgtgcgagggaacggcattctttcctctgcagagctgcatgaaccattcatgccgtccaaatgctaaagcatttaagagagacgaggacaaggatggccatgcagtgataattgcccttaggcccatcagcaaggacgaagagattaccatcgcctacatcgatgaagaccttccttacgaggagaggcaggcgcagcttgcagattacgggttcacgtgtacatgcttgaaatgccaagaagagcgaccggtctgaaaggacaaatatgtttgaattttgcggcattcagcctatgtcactgggtagttttgaaagctcgcgagaagtgagtgcacaaaatgatgtttgttttcggctgtaacttgcaaaagttttgttgttgtccaatgaatatgaatagtgacgaacagacgatcagtcgtcgtaaccagcagcctcatgggactaacacaaccacaagagcgaatggcaatagcagcaggttgacacttgcaactattttggttatacttgtacattaacacaactggctgattcgccaagtatgctagtattacatttgtcatctccctgcatagattatgggggcactgcatatcgcacaacaacgtgtacatagcacaggcttttacacatggtacaggaaaaatgagttccatcactcgagccgagctgacgaaagaaggaaaaaaaaaa

SEQ ID NO: 2938 - DNA, 1861 bp, Zea mays
accgtctccgcacgccagaaccccaaaaccccagcggccagcaaaagcagcggcggcgcggccagggaccgacgtacccgccgcgagaagctccggttggcaccccaacggcatggatgctagcagcgtcagcccgtgcgatctagacagggagtttgcgctccaaatcgctcagctcctcgccacgcctcctctccaatcagcccaggaatactatggtgaactcatacggtccaagaagcttgatggcattagagtgagctacagtggcaagcatgggaaaggtgtttatgcaaatagggactttggtgaagacgaccttgttctgaaggaccaaatgttggtcggtgctcaggacagccttaacaagattgactgtgttgtgtgtagttactgcttccacttcattggttctatagagtaccaaattgggcgtagattgtatttgcaaagccttggtggtagtggtgatggcactaccgagagacactgccatgggagtgatgttgggtcaagtactggctgttccggtgcatcaaatggaaatagcaatgctgtgccacaagaggtcctgttgtcacttatggatggtaatacgctgttgcctttaaccgatcagttctgtttgccaccagttgttgcttgccctggtggatgtgagggagaactctactgcagccaatcatgtgcggattccgattgggattcttatcactctttgctgtgtgctggatccaagactgaaccattgcggaaatctgcccttcagaaatttgtggggcatgctaatgaaaccaatgatatttttttggttgctgccaaggctatcactttcaccttgttgagatataggaaactcaaaagacagcatgtgtctcatgaatcaagctcttcgctcctcttggaagcatggaaaccactttcaatgggcttcaaaaagagatggtgggagtgtgttgctttgcctgaagatgttgattccagtgaagaagaattgtttagacagcagataagggatctggcgtttacgtcactgcagcttctcaaggatgcaatctttgatcctgagtgtgcgcctttgttttcgcttgacatctatggccatataattggcatgtttgagctgaacaatcttgatttagttgtcgcatcaccagttgaagactatttcatatacattgacggtcttccagagagcgacaaggaggaagcagagaaggtgacagggccattcctagatgctttaggagaagactacttagttccgtgcgagggaacggcattctttcctctgcagagctgcatgaaccattcatgccgtccaaatgctaaagcatttaagagagacgaggacaaggatggccatgcagtgataattgcccttaggcccatcagcaaggacgaagagattaccatcgcctacatcgatgaagaccttccttacgaggagaggcaggcgcagcttgcagattacgggttcacgtgtacatgcttgaaatgccaagaagagcgaccggtctgaaaggacaaatatgtttgaattttgcggcattcagcctatgtcactgggtagttttgaaagctcgcgagaagtgagtgcacaaaatgatgtttgttttcggctgtaacttgcaaaagttttgttgttgtccaatgaatatgaatagtgacgaacagacgatcagtcgtcgtaaccagcagcctcatgggactaacacaaccacaagagcgaatggcaatagcagcaggttgacacttgcaactattttggttatacttgtacattaacacaactggctgattcgccaagtatgctagtattacatttgtcatctccctgcatagattatgggggcactgc

SEQ ID NO: 2939 - DNA, 2548 bp, Saccharum officinarum
cacgacccgcgggcagacccagccaaggcaaggcagccgcgaaccggagcacgccggccggtgtcgctcccgcgccggcggcctgctgctcgctcgccctcgcttccgcattggatcacgcagcggttggcgacttgttggtgtctgcttctggtgattgcgcctagccggccgacgcggagacggcatcaagtttctaacaatttgaagtacctaaaatgggcgccagagataatggggagggaagggatgagaagaaggggactggatcagattatgtacctactagagaccccttttcgtcacaaggtgagtctcgggttccaaagaagctcggcaaaaaggagacaaaagataatagcccccgaatgaccaaaagcagcgctggccgtctagctcaaaacaagctgcaacataaaggattaaacaatgtacagaacaagtctcagaaacaaaagaaaacaattagtgctgctaaagctgttgaagttagaaaaccagatattgcaagaattccttcccgggctccgtcagaattgtctgaggaaacagatgatataatcagtgatgctggaactgttgatgataaagggactgaggaggccaaggagatagatgttttagatgaagctccacactgtgatcagagtaccggtactgatgatgaaactcctgatatcgaagacaaggtagttgatcatgaaaaatcagttgtaggtcaaggcaatggggaattagtgtcgaaaattggcaagttggaacaggaacttcgtgaagttgctgctcttgaagtttctctgtactctgtagtgcccgagcatggaagttcagcacataagttgcacaccccagctcggcgtctttctaggctatatatccatgcatccaagttttggtctgaagataagagagcttcggtagcaaaaagcattgcttctggccttgttcttgttgcaaagtccagtagcaatgatgcttcgaggctgacattctggctgtccaacacagttgtcctcagggagataattgtacaaacttttggcatctcacatcaatttactccatccattacgactatgaacatgaatggtgctaccaaaaagcttgatgggaaatctatgaaaatgctgtggagaaacaactcctcacatgcaaaaacgggcggaatgccagatgattggcaggaaacaagtacacttttggctgcattagagaagatcgaatcttggatattttctcgcattgttgagacagtatggtggcaggcactaactcctcacatgcaaaaacgggcggaaggctcatcaactccaaaggctggtagagtgttaggtcctgctttgggtgatcagcagcagggcaccttttctgttaacctgtggaaggctgcgtttaacgatgcattcaacagaatgtgcccccttcgtgctggtggacatgagtgtggctgtttaccagtattagcaaaactggtgatggagcaatgtgtagcccgtttggatgttgccatgtttaatgccatccttcgtgaatcagcaagtgagataccaacagaccctatatctgacccgattgttgacccaaaagtcctaccaattccagctggtgatctaagctttgggtcaggcgcgcagctgaagaactctattggaaactggtccagatggctgacagataagcttggcatagatgacgatgattctgaggacataggagatgttgaagatgaaagaagaggtgcagctgaaacaaaatcgtttcaactgcttaatgaactaagtgatctcctgatgctcccaaaggacatgcttcttgaaaaatctatcaggaaagaggtctgcccttcaatcggccttcaattagtgacaagaatcctgtgcaacttcactccagatgagttttgccctgatgcggttccgagcacggtcttagaagagctgaattctgagagcttgctggagcgtcacaccaacaaagacatgatcaatgtgtttccatgcatcgctgctcctacagtgtaccgggcaccttcaacgttggatgcggcagagaaagtggcagacataggaggtggtgcgaagctggacaggaaggcctcaatggtgcagaggagagggtataccagtgatgatgacctggatgacctggattctccccttgcatccctaatcgacaggagcgctccaccttcgccatcaaacggttttgcacatttcagtgctcagagaggagtttccatggagaatacaagatacacgctccttagagaagtatggttggagcaacggtgatggatgaacctgtaaagcctaaaatctcttctacagctgccccattgtgagagcaaaagaaggcctatttgcgtaggcccttcagcagtccttacagtaaagtgcaacactttcttgtacagtacattcccacaatcgcaacatatgtagctcttttgtagtatagcagcaagtcaacaattcagatacatacgaataacactatcgacggtgcaagtttgtgaaatgaaagtatgtttaccaggccactgttgtgt

SEQ ID NO: 2940 - DNA, 2710 bp, Zea mays
cgcacactcgccttcctgacgtcggttggatttaagcagagcgcagaggagagcaaccactcgcccgctcgcccaccacgatctccctcccctccgcacgccgcacggggcgttgcagacccccagccaaaggcaggccgcgacccggagcacgccggccggtcgcgggcgtcgtcgtcgcctcccgcgccgccgccctgctgctcgctcccgcattggatcgcgctgcggttggcgactcggtgtggtctgctgctggtgactgaagccggcccacgcggagacggcatcaagtttctaacaatttgaagtatcccgaaatgggcgcaagagataacggggaggggagagatgagaagagggggactggatcagattatgtacctgctagagactccttttcatcacaaggtgagtctcgggttccaaagaggctcggtaaaaaggagtcaaaagataatagcccccgaacgaccaaaagcagcgccagccgtcaagctcaaaacaagctgcaacataaaggattaaacaatgtacagaacaagcctcagaaacaaaagaaaacagttagtgctgctaaggctgttgacgttagaaaaccagatattacaagaattccttcccgccctccatcagaattgtctgaggaaacagacgatataatcagtgatgctggaactgttgatgatagaggcactgaggaggccaaggagatcaatgtgttagatgaagctccacgctgtgatcagagtactggtactgatgatgaaattcctgatattgaagacaaggtagttgatcatggaaaatcagttgtagatcaaggcaatgaggaattagtgctgaaaatcgacaagttggaacaagaacttcgtgaagttgctgctcttgaagtttccctgtactctgtagtgcccgagcatggaagttcagcacataagttgcacaccccagctcggcgtctgtctaggttatatatccatgcatccaagtcttggtctgaagataagagagcttcggtagcaaaaagcattgcttctggtcttgttcttgttgcaaagtccagtagcaatgatgcttcgaggctgacattctggctgtccaacacagttgtcctcagggagataattgtacaaacttttggcatctcacatcaatttactccatccatgacgaatatgagcatgaatggtggtgccaaaaaacttggtgggaaatctatgacaatgctgtggagaaacaactacaatggcacgcaagccaactttgctgcgaggctgatgccagatgattggcaggaaacaagtacacttttggctgcattagagaagattgagtcttggatattttctcgcattgttgagacagtatggtggcaggcactaactcctcacatgcaaaaacgggcagaaggatcatcaactccaaaggctggtagagtgctaggtcctgctttgggtgatcagcagcagggcaccttttctgttaacctgtggaaggctgcgtttcaggacgcattcagcagaatgtgccccctcagtgctggcagacatgagtgtggctgtttaccagtattagcaaaactggtgatggagcagtgtgtagcccgtttggatgttgccatgttcaatgccatcctacgtgaatcagcaagtgagataccaacagaccctatatctgacccaattgttgacccaaaagtcctaccaattccagctggtgatctaagctttgggtcaggcgcgcagctgaagaactctattggaaactggtccagatggctgacagataagcttggcatagatcatgatgattctgaggacataggagatgttgaagacgaaagaagagccgcagctgaaacgaaatcgtttcaacttctcaatgagctaagtgatctcctgatgctcccaaaggacatgctccttgaaaaatctatcaggaaagaggtttgtccctcaattggccttcagttagtgactaggatcctgtgcaacttcaccccagatgagttttgccctgatccggttccaagcacggtcttagaagagctgaattccgagagcttgctggagcgtcacgccaacaaagacgtgaccagtgtgtttccgtgcaccgctgcccctatagtgtaccgcacaccttcaacgttggacgcggcagagagagcggcagacataggaggtggcgcgaagctggacaggaaagcctcaatggtgcagaggagagggtacaccagtgacgacgaccttgacgacctggattctcccctcgcatccctaatcgacaggagcgccccaccttctccgtcgaacggtttggcacacttcagtgctgggagaggagtttccatggagaatacaagatacacgctcctaagagaagtatgggggctggagcaacggtgatggatgatgacgagcctgtaaaacctaaaatctcttctactgccacccaaatgagagcacaagaaggcctatttgtgtggggtcttcagcaatctctacagtaaaaatgcaacacttccttgtactgtacattcccacgatcctatgtatcttagctcttttgtagtatatagcagcaaaagagggtgtcggcaaagatacagatacagtattgagttaaaattctataatgatatgacattctcttcacctaccaatctgatgggcacttgagacgcttacctttgagctgtcgccactat

SEQ ID NO: 2941 - DNA, 2664 bp, Zea mays
cgcacactcgccttcctgacgtcggttggatttaagcagagcgcagaggagagcaaccactcgcccgctcgcccaccacgatctccctcccctccgcacgccgcacggggcgttgcagacccccagccaaaggcaggccgcgacccggagcacgccggccggtcgcgggcgtcgtcgtcgcctcccgcgccgccgccctgctgctcgctcccgcattggatcgcgctgcggttggcgactcggtgtggtctgctgctggtgactgaagccggcccacgcggagacggcatcaagtttctaacaatttgaagtatcccgaaatgggcgcaagagataacggggaggggagagatgagaagagggggactggatcagattatgtacctgctagagactccttttcatcacaaggtgagtctcgggttccaaagaggctcggtaaaaaggagtcaaaagataatagcccccgaacgaccaaaagcagcgccagccgtcaagctcaaaacaagctgcaacataaaggattaaacaatgtacagaacaagcctcagaaacaaaagaaaacagttagtgctgctaaggctgttgacgttagaaaaccagatattacaagaattccttcccgccctccatcagaattgtctgaggaaacagacgatataatcagtgatgctggaactgttgatgatagaggcactgaggaggccaaggagatcaatgtgttagatgaagctccacgctgtgatcagagtactggtactgatgatgaaattcctgatattgaagacaaggtagttgatcatggaaaatcagttgtagatcaaggcaatgaggaattagtgctgaaaatcgacaagttggaacaagaacttcgtgaagttgctgctcttgaagtttccctgtactctgtagtgcccgagcatggaagttcagcacataagttgcacaccccagctcggcgtctgtctaggttatatatccatgcatccaagtcttggtctgaagataagagagcttcggtagcaaaaagcattgcttctggtcttgttcttgttgcaaagtccagtagcaatgatgcttcgaggctgacattctggctgtccaacacagttgtcctcagggagataattgtacaaacttttggcatctcacatcaatttactccatccatgacgaatatgagcatgaatggtggtgccaaaaaacttggtgggaaatctatgacaatgctgtggagaaacaactacaatggcacgcaagccaactttgctgcgaggctgatgccagatgattggcaggaaacaagtacacttttggctgcattagagaagattgagtcttggatattttctcgcattgttgagacagtatggtggcaggcactaactcctcacatgcaaaaacgggcagaaggatcatcaactccaaaggctggtagagtgctaggtcctgctttgggtgatcagcagcagggcaccttttctgttaacctgtggaaggctgcgtttcaggacgcattcagcagaatgtgccccctcagtgctggcagacatgagtgtggctgtttaccagtattagcaaaactggtgatggagcagtgtgtagcccgtttggatgttgccatgttcaatgccatcctacgtgaatcagcaagtgagataccaacagaccctatatctgacccaattgttgacccaaaagtcctaccaattccagctggtgatctaagctttgggtcaggcgcgcagctgaagaactctattggaaactggtccagatggctgacagataagcttggcatagatcatgatgattctgaggacataggagatgttgaagacgaaagaagagccgcagctgaaacgaaatcgtttcaacttctcaatgagctaagtgatctcctgatgctcccaaaggacatgctccttgaaaaatctatcaggaaagaggtttgtccctcaattggccttcagttagtgactaggatcctgtgcaacttcaccccagatgagttttgccctgatccggttccaagcacggtcttagaagagctgaattccgagagcttgctggagcgtcacgccaacaaagacgtgaccagtgtgtttccgtgcaccgctgcccctatagtgtaccgcacaccttcaacgttggacgcggcagagagagcggcagacataggaggtggcgcgaagctggacaggaaagcctcaatggtgcagaggagagggtacaccagtgacgacgaccttgacgacctggattctcccctcgcatccctaatcgacaggagcgccccaccttctccgtcgaacggtttggcacacttcagtgctgggagaggagtttccatggagaatacaagatacacgctcctaagagaagtatgggggctggagcaacggtgatggatgatgacgagcctgtaaaacctaaaatctcttctactgccacccaaatgagagcacaagaaggcctatttgtgtggggtcttcagcaatctctacagtaaaaatgcaacacttccttgtactgtacattcccacgatcctatgtatcttagctcttttgtagtatatagcagcaaaagagggtgtcggcaaagatacagatacagtattgagttaaaattctataatgatatgacattctcttcacctacca

SEQ ID NO: 2942 - DNA, 2797 bp, Panicum virgatum
gcagacccagccgcgatcccaccgcgcctggccgcgggcgtcgcctcccctcccctcccgcgccgacggcccgcgcgcacgcgggaaccgcgccccgcgagcggcaccacaggcacaccaagtgggggttgcctcgcccttgcgcgttcgcgacgggagcctcacctccccgccgcatttattgcgcggcggcgcgcgccaccgcagcctgctgctgctgactgcgcccgcggtggccgacgctggagccttgccggacggaatcaaagtttcagacagattagaagtactccaaaatgggtgctagagataatttggaagggagagaagagaagaggggggttggatcagattatgtgcatgctagggactccttttcatcacaaggagaatctcgggttccaaggaagctcagtaaaaaggagactaaagaaaatagcccccgcacaaccaaaagcagcgttagccgtctagctcaaaataagctgcaacataaaggattaaacaatgttcagaacaaatctcagaagcaaaagaaaacagttagcgctgctaaagctgttgaagttagaaagccagacattgccagagttccttctcgccctccatcagaattgtctgaggaaacggatgatataatcagcgatgctggaaccatcgacgataaaggcaatgaagaggccaaggagatcgatgtgttagatgaagctccacactgtgatcagagtactggcactgatgatgatattcctgatattgaagagaagatagtccatcatgacaaatcagttgtaggtcaagggaatgaggaatcagcatcaagaattgacaagttggaacaagaacttcgtgaagttgctgctctcgaagtttctctatactctgttgtgcccgagcatggaagttcagcacataagttgcataccccagctcggcgtctctctaggctatatattcatgcatccaagttttggtccgctgacaagagagcttcagtagcaaaaaacattgcttctggcctcgtgcttgttgcaaagtccagtagcaatgatgcttcaagattgacattctggctgtccaacacagttgtcgtcagggagatcattgcacaaacatttggtgtctcacgtgtgaatccaatgatgatgaccatgaccatgaacatgaatggtggtgccaaaaatcttgatgggaaacctatgacaatgctatggagaaacagctccaatggcaagcaagccaaacttgctgcgatgcagatgccagatgattggcaggaaacaagtacatttttggcttcattagagaagattgaatcttggatattttctcggattgttgatacagtgtggtggcaggcacttactcctcacatgcaaacgccggctgaaggttcatctactccaaaggctggcagagtgtcaggtcctgctttgggtgaccagcagcagggcaccttttctgttaacctgtggaaggctgcatttcatgatgcattcagtagaatgtgccctctccgtgctggaggacatgagtgtggctgtttaccagtattggcaaaattggtgatggagcaatgtgtagcccgtttggatgttgcaatgtttaatgccatccttcgtgaatcagcaaatgagataccaactgatcctatatctgacccgattgttgacccaaaagttctaccaatcccagctggtgatctaagctttggttcaggcgcacagctgaagaactctattggaaactggtcaagatggttgacggataaatttggcattgatgatgatgattcggacataggaaacgacgacgatgataaaagaagaggtgcagctgaatcaaaatcatttcaactgcttaatgaattgagtgatctcctgatgctaccaaaggacatgcttcttgaaaaatctatcaggaaagaggtctgcccctcagttggccttcagttagtgacaagaatcctgtgcaacttcacacctgatgagttctgtcctgatcctgttccaagcacagtcttagaggagctgaattcagagagcttgctggagcgatgcaccaacaaagatgtgctcggcgcatttccatgcattgccgctcctgttgtgtaccgagcaccttcgacatcagatgcggcagagaaagtggcagacataggaggtgtcccaaagctcgataggaaagcctcaatggtgcagaggagagggtacaccagcgacgacgacctggatgacctggactctccccttggatccctaattgacaggagtgctccaccttcaccatcaaatggtattgcgcatttcagtgctcagagaggagcttccatggagaacgtaagatacacgctcctaagagaagtatggtcggagcggcggtgatcaatgcatctgtaaaacctaaaatctcttctacagctgccgtataagatcacaagaaggcgccgatgtgtatgcccttcaacagtcttttcacagttacaaaatatgaaacacttcttgtacagcacattcccacaatcctatatatgtagcccttttgtagtatagcacaactctagatacggatagtaagactattgcaccttgaagttgaataacactatctacggtgcaaatttgtggagtgaagctatgaaagttcgtttgccgacctagctaccattgtgtagggtgttggcatggatgctgatgcagtatttcaactgcatttctttattgatatggtattctcctcatggaacaattggatagggactcgagacgcttacatttgagctgtctccactattctt

SEQ ID NO: 2943 - DNA, 2781 bp, Saccharum officinarum
cagagcagggagcagaggagcaaccgcccaccacgatcccccctcccgcacgacccgcgggcagacccagccaaggcaaggcagccgcgaaccggagcacgccggccggtgtcgctcccgcgccggcggcctgctgctcgctcgccctcgcttccgcattggatcacgcagcggttggcgacttgttggtgtctgcttctggtgattgcgcctagccggccgacgcggagacggcatcaagtttctaacaatttgaagtacctaaaatgggcgccagagataatggggagggaagggatgagaagaaggggactggatcagattatgtacctactagagaccccttttcgtcacaaggtgagtctcgggttccaaagaagctcggcaaaaaggagacaaaagataatagcccccgaatgaccaaaagcagcgctggccgtctagctcaaaacaagctgcaacataaaggattaaacaatgtacagaacaagtctcagaaacaaaagaaaacaattagtgctgctaaagctgttgaagttagaaaaccagatattgcaagaattccttcccgggctccgtcagaattgtctgaggaaacagatgatataatcagtgatgctggaactgttgatgataaagggactgaggaggccaaggagatagatgttttagatgaagctccacactgtgatcagagtaccggtactgatgatgaaactcctgatatcgaagacaaggtagttgatcatgaaaaatcagttgtaggtcaaggcaatggggaattagtgtcgaaaattggcaagttggaacaggaacttcgtgaagttgctgctcttgaagtttctctgtactctgtagtgcccgagcatggaagttcagcacataagttgcacaccccagctcggcgtctttctaggctatatatccatgcatccaagttttggtctgaagataagagagcttcggtagcaaaaagcattgcttctggccttgttcttgttgcaaagtccagtagcaatgatgcttcgaggctgacattctggctgtccaacacagttgtcctcagggagataattgtacaaacttttggcatctcacatcaatttactccatccattacgactatgaacatgaatggtgctaccaaaaagcttgatgggaaatctatgacaatgctgtggagaaacaactcctcacatgcaaaaacgggcggaatgccagatgattggcaggaaacaagtacacttttggctgcattagagaagatcgaatcttggatattttctcgcattgttgagacagtatggtggcaggcactaactcctcacatgcaaaaacgggcggaaggctcatcaactccaaaggctggtagagtgttaggtcctgctttgggtgatcagcagcagggcaccttttctgttaacctgtggaaggctgcgtttaacgatgcattcaacagaatgtgcccccttcgtgctggtggacatgagtgtggctgtttaccagtattagcaaaactggtgatggagcaatgtgtagcccgtttggatgttgccatgtttaatgccatccttcgtgaatcagcaagtgagataccaacagaccctatatctgacccgattgttgacccaaaagtcctaccaattccagctggtgatctaagctttgggtcaggcgcgcagctgaagaactctgtgcgtgcctgattcgctcgcttttttgcattactaccacttcctttttttttgttgtaaagttgtttgtcaggatgtggcttgctaaggaacaaaactagatacaaatgtggttggatcttgctattacacctcacctgaaacaacgaatttatatgaaataaaatgactatgcagattggaaactggtccagatggctgacagataagcttggcatagatgacgatgattctgaggacataggagatgttgaagatgaaagaagaggtgcagctgaaacaaaatcgtttcaactgcttaatgaactaagtgatctcctgatgctcccaaaggacatgcttcttgaaaaatctatcaggaaagaggtctgcccttcaatcggccttcaattagtgacaagaatcctgtgcaacttcactccagatgagttttgccctgatgcggttccgagcacggtcttagaagagctgaattctgagagcttgctggagcgtcacaccaacaaagacatgatcaatgtgtttccatgcatcgctgctcctacagtgtaccgggcaccttcaacgttggatgcggcagagaaagtggcagacataggaggtggtgcgaagctggacaggaaggcctcaatggtgcagaggagagggtataccagtgatgatgacctggatgacctggattctccccttgcatccctaatcgacaggagcgctccaccttcgccatcaaacggttttgcacatttcagtgctcagagaggagtttccatggagaatacaagatacacgctccttagagaagtatggttggagcaacggtgatggatgaacctgtaaagcctaaaatctcttctacagctgccccattgtgagagcaaaagaaggcctatttgcgtaggcccttcagcagtccttacagtaaagtgcaacactttcttgtacagtacattcccacaatcgcaacatatgtagctcttttgtagtatagcagcaagtcaacaattcagatacatacgaataacactatcgacggtgcaagtttgtgaaatgaaagtatgtttaccaggccactgttgtgtaggcctgt

SEQ ID NO: 2944 - DNA, 2345 bp, Pennisetum glaucum
ggagccgctccagacggaatcaaaacttctaacaaattagaagtactccgaaatgggtgctagagataacatggaagggagagaagagaagaagggggttggatcagattatgtacctgctagggactcctttccatcccaaggagagtctcgggttccaaggaagctcagtaaaaaggaggctaaagaatatagcccccgtgcgaccaaaagcagtgctagccgccaagctcaaaacaagctgcaacataaaggaataaacaatgttcagaacaaatctcagaagcagaaaataacagttaccactactaaaactgttgaagttagaaaaccagacattgccagagttccttctcgccctccatcagaattgtctgaggaaacagatgacataatcagtgacgctggaaccgtcgacgataaaggcaatgaggaggctaaggagattgatgtgctagatgaagctccacattgtgatcagagtaccggcactgacgatgacattcctgatattgaagagaagatagttcatcatgagaaatcagttgtaggtcaagggaatgaggaatcagagtcaagaattgacaagttggaacaggaacttcgtgaagttgcggctcttgaagtttctctgtactctgtagtgcctgagcatggaagttcagcacataagttgcataccccggctcggcgtctctctaggctatatattcatgcatccaagttttggtcagcagacaagagagcttcggtagcaaaaaacattgtttctggccttgtgcttgttgcaaagtccagtagtaatgatgcttcaaggttgacattctggctgtccaacactgttgtcttcagggagataatcgcacaaacttttggcatctcttgtgtgactccaacaacgaaggccatgaacgtgaatggtgctgccaaaaagcttgatgggaaacccgtgacaatgctatggagaaacagctccagtggcaagcaagccaaattcgatgcaatgcagatgccagatgattggcaggaaacaagtacacttttggcttcactagagaagattgaatcttggatgttttctcggattgttgatacggtgtggtggcaggcactgactcctcacatgcaaacccgcgcggaaggttcatccactccaagggctggaagagtgttaggtcctgctttgggcgatcagcggcaaggcgccttttctgttgacctgtggaagactgcatttcatgacgcattcagcagaatgtgcccccttcgtgctggtagacatgagtgcggttgtttaccagtgttagcaaaattggtgatggagcaatgtgtagcccgtttggatgttgcaatgtttaatgccatccttcgagaatcagcatttgagataccaactgatcctatatccgacccaatcgttgacccaaaagtcctgccaattccagctggagatctaagctttggatcaggcgcgcagctgaagaactctattggaaactggtcaagatggctgacagataaatttggcattgacgatgatgattcgaacataggaaacaatgatgatgaaagaagaggtgcagatgaatcgaaatcttttcgactgcttaatgaattgagtgatctcctgatgctcccaaaggacatgcttcttgaaaaatctatcaggaaagaggtctgcccttcaattggtcttcaattggtgacaagaatcctgtgcaacttcacacctgatgagttctgccctgatcctgttccaagcacagtcttagaggagctgaattcagagagcttgatggagcgctgcaccggcaaagatgtgatcagcacttttccatgcatcgctgctcctgttgtctaccatgcaccttcgacatcggatgcggcagagaaagtggcagacattggaagtggtgcaaagctagacaggaaagcctcgttggtgcagaggagaggatacacgagcgacgatgacctggatgacctggattctccccttgcatccctaattgacaggagcgctccaccttcaccatcaaacggtatcgcacatttcagtgctcagagaggagcttccatggagaatacaagatacacactcctaagagaagtatggtctgagcggcggtgattgatgaatctgtaaaacctacactcttctacagctgccgtataaaatcaaaagaacggtgtcgttctgtatgccgtccaagaatccttttgcagtagcaaaaaaatgcaacacttgtacagcacattcccacaatcatatatatgtagcccttttgtagtatagcgacaactcagatacaaatagtgagactgttgccccctttgaagttgaa

SEQ ID NO: 2945 - DNA, 2211 bp, Setaria italica
cctgctgctgattgcttgcgcggggaccggcggctggagccgctccagacggaatcaaaacttctaacaaattagaagtactccgaaatgggtgctagagataacatggaagggagagaagagaagaagggggttggatcagattatgtacctgctagggactccttttcatcacaaggagagtctcgggttccaaggaagcttagtaaaaaggagactaaagaatatagcccccgcacgaccaaaagcagtgctagccgtcaagctcaaaacaagctgcaacataaaggattaaacaatgttcagaacaaatctcagaagcaaaagaaaacagttagcgctactaaagctgttgaagttagaaaaccagacattgccagagttccttctcgccctccatcagaattttctgaggaaacagatgatgtaatcagtgacgctggaaccatcgatgataaaggcaatgaggaggccaaggagatcgatgtgttagatgaagctccacactgtgatcagagtactggcactgatgatgatattcctgatattgaagagaagatagttcatcatgacaaatcagttgtaggtcaagggaatgaggaatcggagtcaagaattgacaagttggaacaggaacttcgtgaagttgcagctctcgaagtttctctttactctgtagtgcctgagcatggaagttcagcacataagttgcataccccagctcggcgtctctctaggctatatattcatgcatccaagttttggtcagcagacaagagagcttcagtagcaaaaaacattgcttctggccttgtgcttgttgcaaagtccagtagtaatgatgatgactatgcttaatcagaattttggctccagcatatgacccagaaaattcctccaattgataaactactcttgatataggttgacattctggacagtcgtcctcagggagataattgcacaaacttttggcatctcatgtgtgactccaacaacggcgaccatgagcatggatggtggtgccaaaaagcttgatgggaaacctatgacaatgctatggagaaacagctccaatggcaagcaagccaaacttgctgcaatgcagatgccagatgattggcaggaaacaagtacacttttggcttcactagagaagattgaatcttggatattttctcggattgttgacacagtgtggtggcaggcacttactcctcacatgcaaacccctgcggaaggttcatctactccaagggctggtagagtgttaggtcctgctttgggtgatcagcggcagggcaccttttctgttaacctgtggaaggctgcatttcatgatgcattcagcagaatgtgcccccttcgttctggtggacatgagtgcggctgtttaccagtattagcaaaattggtgatggagcaatgtgtagcccgtttggatgttgcaatgtttaatgccatccttcgtgaatcagcaagtgagataccaacggatcctatatctgacccaatcgttgacccaaaagtcctgccaattccagctggtgatctaagctttggttcaggcgcgcagctgaagaactctattggaaactggtcaagatggctgacagataaatttggcattgacgatgatgattcggacataggaaacgatgatgatgaaagaagaggtgcagctgaatcaaaatcttttcaactgcttaatgaattgagtgatctcctgatgctcccaaaggacatgcttcttgaaaaatctatcaggaaagaggtctgcccttcaattggtcttcaattagtgacaagctttacgcctgatgagttctgtcctgatcctgttccaagcacagtcttagaggagctgaattcagagagcttgctggagcgctgcactgacaaagatgtgatcagcgcttttccatgcatcgccgctcctgttgtgtactgcgcgccttcaacattggatgcggcagagaaagtggcagacataggaggtggtgcaaagctcgacaggaaagcctcattggtgcagaggagaggatacacgagcgacgacgacctggatgacctggattctccccttgcatccctaattgacaggagcgctccaccttcaccatcaaacggtattgcacatttcagtgcccagagaggagcttccatggagaacgcaagatacacgctcctaagagaagggtgatcgatgaa

SEQ ID NO: 2946 - DNA, 5518 bp, Zea mays
gaccgccctccgcatctcgtcgacgacgaaaggaaaacctcacaaatcctctggatgcggggtctagccgcctccgccctgtagcaccagtcggatcgaagaagcacaagcgcttcgggtcggcgcgcacctctccctcatggtggcggcgcgaggggcccgatctgggggctcggttgcggcggcggcgctggtctcggttcttctcgtgggttgcctcgtcgcgggcggccagggggcggagatccgtcgccagaaaaacgtgcaggctgcgctccgggccaagtgggctggcacgccgctgctgctcgaagccagtgaattgctttcgacagaatggaaggatctattttgggattttattgacctctggaaggatctagagaaaggctctgaatgtttaacagcaaaatgctgtgcccagaagattgttgaggatgcccacatactactcaatgaaccgctctcttcaatttttgagttttctcttacccttcgatcagcatcaccaaaattagtgctttaccggcaacttgcaaaggagtcattatcttcgtttcctattgatgattcaccagagaacatttctggtcatggcactggaaaaacttttgatggggctgtggatcctggctcttctggaggaacttgctgctgggtagacactgggaatgttctattgttcaattcagccgatctgcatgaatggcttgggggattgggcaagctagctatggattctactgaacagcctgaactctttgaatttgaccatatatatcgtcgcacaaatattactgctccagttgctatattttatggggctgttgggacaaaatgcttcaaagagctgcatgttcaactagtagaagcatcaaagcagggaaaaatcaggtatgctctgcgtcctgtcctaccatctggatgtgagactacgtccaccttttgtggttcagttggtgctgtagatgcagtcaccttgagtggttatggggtggagcttgccctaaaaaacatggaatacaaagctatggatgacactgctataaagaagggtgttcctctagaagatcctaaaacagaggacctcagtcaagaagtcagagggtttatattttccaagattttggaacgcaagccagagctaaatgctgagataatggccttcagagattatctgttgtcatcggcagtgtctgatacacttgaagtctgggaactcaaagatctgggtcatcagacagcacagcgaatcgttcaagcatcagaccctttacagtcaatgcaggaaatcaatcaaaatttcccaagtatagtttcttcactatcacgaatgaagcttgacgattccatcaaagacgaaattattgcaaatcagcggatggttccacctggcaagtcattgatggctttgaatggtgctttgatcaatatcgaggatcttgatctttacctgttaatggatatggtccatggagaattatccctggctgatcagttcgtccggttaaagttgcctcaaagtgctgtcctcaagatcctgtcagctcctccaccagcagaatctaattctttccgtgtggacttccggtcttctcatgtgcattaccttaataacttggaggaagatgccatgtatagaagatggagaagcaacatccaggagctcttgatgccggtcttccctggtcagatgcggtacatccgtaaaaaatctgtttccactctgtttatgtgcttgatcctgcttcagcctgtggtgcagaggctaaccattgacatgatggtatctctatatcaagatagtgtccctataaggtttggtatcataatgtattcttcaagattcatcaatgttgttgaaggaagtgatggcactcttacaaataatgatggagaagacacttccattttgataacaaggctttttcttgtacatcaaagaaacatactcaacacagttggcattccaatttctcggcaatatacataaatcaaggaatggtgaagatgactacaatgaagagcttgttgaggctcatcatgttgaaggggcatttgttgattcactattatcaactgctaaatctcatccacaagatgtgctgctaaagttgcaaaaagagaacatgtacaagcaggaagctgaagaaagctctcattttgttcacaagcttgggttgtatagactccagtgttgtctgttgatgaacggacttgtccatgaagcaagtgaggaagcgaccatgaatgctatgaatgatgaacttcctaggattcaagaacaagtttattatgggcatatccagtcccatacagatattttagagaagtttttgtcagaaaatagctacaagcggtacaacccatcaattactggcaagaatgcagagaagaaatttgtttcgctctttgcatcgtaccatcaggacagctttatatttaatgacatgaagtacttacagtctcctggaactacagatgatgcaaaacctgttactcatctacttgccattgatctttcatcaaaagttggaacaaaattgctttatgaggccatactttacctgatggacggatctgatagagctcgtgttggtctgctactttatgtccacactggtggttcatcacctattttacttctgaaagatattttcgatagaactatttcttctttcagctataaagaaaaggtattagtcttcctgcatgggctcttgaaattttatgatgcccaacctttgcccgcctcatctgttgctgatgattggactagaactatgatggaaaaggtctataccttagctgctgaaactgctttgcctgttgatgactataaagcgtggtttaaaagtttctctgctgatacagttctcaaagggatggataagttatctgacttcttatttgggcaattggggcttgtgtttggtagtaatgctgtgatcaccaatggacgggtttttattatgaatgaagggaaatcatttctagccaatgatttaggtctccttgagtctatggagtatgatttgagaacgaaatacatatttgaaataattgaagaggttgagtttgccagtgttgaccctgatgacctaacaaaccaattctacagcgacattgccatgttgatctcatcgtcgatgtctgttcgtgaaaggacatctgaaagagcccattttgagattttacatgcggaacatagtgctatcaaattgaataatgcaaattcaagtattcacattgatgctgtcattgatccgctaagtcccactgggcaaaaacttgccccacttctacgcatactctggaaacaaattcagccgagcatgaggattgtacttaatcctattagttccctcgcagatcttcctttaaaaaacttctacagatttgttcttccatccatggatgattttagcagtacagatcattctgtacacggacctaaagctttctttgcaaatatgccactgtcaaaaacacttacaatgaacatagatgttccagaaccatggcttgttgaatcagttattgccatccatgatttagacaacattcttttagagaatcttggcgatgtcagaactttgcaggcagtatttgaacttgaagctctcctcttgacaggtcattgcatggaaaaggaccgggaccctccccgtgatgaaagtctcccctggtgtatggtacctacaattggctcctggtcgtagtgccgatctgtatgagctacctccgaaactcattgccattgatagcttgagaggcaaactaatgcatattgaagtgcaaaagaagaaaggcaaggagcatgaggacttgctaaatgctgccgatgactaccacttccaggaaaagacggataacaaaggctggaataagaaccttttgaaatgggcttctagtcttatcactggtgatgcttcatcaaaaagtaaagctgataaaaccactgaccgtaaggatgcaagacaaggggagaccataaatatattctctgttgcttctgggcatctgtatgagcgtttcctcaaaataatgattttgagtgttctaaaaaagacacagaggccagtgaagttttggttcattaagaattatctatctccacagttcaaggatgtcataccgcacatggctcgggaatatgaattcgagtatgagctcgtcacatataaatggccaacatggttacacaagcagaaagagaagcaaaggattatatgggcatataagatcttatttctggatgtcatttttccactttcactgaggaaggtgatttttgttgatgctgatcaaattgtgagagcagacatgggagaattgtatgacatgaacctgaagggtcgcccgcttgcatatactccattctgtgataacaacaaggatatggatggttttcgattttggaagcaaggtttttggaaagatcatctgcgaggaagaccgtaccatatcagtgcgctttatgttgttgatttggccaaatttcggcaaactgcttctggggatactcttcgtgtcttctatgaacaactcagcaaggaccccaatagtctctccaatcttgatcaggatctcccgaattatgcccaacatacggtgcctatattctctcttcctcaagaatggctgtggtgtgaatcttggtgtggaaatgccacaaaagcaagagcaaagaccattgatctatgcaacaatccaatgacaaaggagccaaagcttcagggtgctagaagaatagttccggagtggactggtcttgacagtgaagcacggcagttcactgcacgaatcttgggtgatgatgtcgagcctgcagatgccacacctccgccatcggaggcaccgaagcctgaagatgatcaggatgtgaaagatgagctatgatcgcaagatgtttccaggcttggtcttactgaatgaaagtttggtgactcgacagtcatcagttcagaacacaggcacacagctagtggagcgcagagggatagtttaacgcaggtgcaaatttgtcaaaacactacacctggaatcctggactacgttgattcaggtattttgtttacagttaatagtttcaagacctttaaccaaatcatatggcggggaagctgcgtccagtaataggttaacaaggcagccagctggggtgtagaactctgtctgctctcagctgcatacacatagactgtaatggtcaacaatttaagatctccttgagacgctgtaaaatttatcggctgccagtcgaaaggcaacagcgaagctggcagctgaaatgcccgagaattttgtagcactcagcaaacggattttttaaacactcagtaagtcaataatgcctgtcgcatgtaacagcaggctattgtgggcatggcagctaaccgttatactaaaaaaaaaatgccaagtgctttatcagttgggtttaacacacgccgttgtctgtccagtgaagttcgaatttcgccatgacagcaggtgttgttgatcttgctgacat

SEQ ID NO: 2947 - protein, 445 aa, Arabidopsis lyrata
MFSLKSSISSPFTQSTTHGLFTNPITRPVNPLPRTVTASMIPKKSSANMIPRNPPARQQLYQPFRPPSSPIPTKFRSLDSAGKIEILAGRMALWFEYAPLISSLYTNGFTPPTIEELTGISSIEQNRLIVGAQVRDSILQSIHEPELIAAFDTGGAELLYEIRLLSTTQRVAAATFIIDRNIDSKGAQDLARAIKDYPNRRGDVGWLDFDYNLPGDCLSFLYYRQSRENKNPSEQRTSMLLQALGVVESEKAKNKLNKELYGEKEEEKEKEKKKKEEEVKAIRIPVVRLKFGEVAGASSVVVLPVCKAEEGEKKILEAPMEIIAGGDFKVVEAEKGWKRWVVLPGWNPVAAIGKGGVAVSFRDDRKVLPCDGKEEPLLVVTDRVRNFVEADDGYFLVVAENGLKLEKGSELKAREVKESLGMVVLVVRPPREDDEDWQTSHQNWD

SEQ ID NO: 2948 - protein, 317 aa, Arabidopsis lyrata
MSVSDEEDECFARFLESEVSSVEDKEETKEPEAKRQRIEKAETKALEKDDEDQKEDGNKDRTGEKRIESGVFSNVPTELFRHILKFLSSEDLVSCSLVCKFLNFAAADESLWRRLYCIRWGLTPPTRKLRESAWKKLYIDRDEQDMIELVRTCPSDFKEYYMQMQAAKRSQAPLPSQMVDDRIILDKTVLEQVSLWKKSKGLTDKAVTGHICLGTKCSYHQIDDVFICKETGNVHVCDDNCKEVILSPEEDLMVCTISGLCSDTLLVQTDPDADGCYEEEAELEAEVFMDKSRLARAFELGYNCDDEQELERTLRFC

SEQ ID NO: 2949 - protein, 91 aa, Triticum aestivum
MRKEVLLVAMMLALVVAAPGGARAACEVGQLTVCMPAITTGAKPSGACCGNLRAQQACFCQYAKDPSLARYITSPHARETLVSCGLAVPHC

SEQ ID NO: 2950 - protein, 91 aa, Triticum aestivum
MRKEVLLVAMMLALVVAAPGGALAACEVGQLTVCMPAITTGAKPSDACCGNLRAQQACFCQYAKDPSLARYITSPHARETLVSCGLAVPHC

SEQ ID NO: 2951 - protein, 91 aa, Triticum aestivum
MRKEVLLAAMMLALVVAAPGGARAACEVGQLTVCMPAITTGAKPSGACCANLRAQQACFCQYAKDPSLGAYIRSPHASETLVSCGLAVPHC

SEQ ID NO: 2952 - protein, 109 aa, Triticum aestivum
MSKWEPVTFEESLSFVKRVKARDYLLYLSLLNVLTRSDQIPLEAYNELLLLFRDHGDLLEELGKFRPLPSFPSTVYSHNTIWMFIFLMPFLLLSLLLAFEKPLDSFLLR

SEQ ID NO: 2953 - protein, 109 aa, Triticum aestivum
MSKWEPVTFEESLSFVKRVKARDYLLYLSLLNVLTRSDQIPLEAYNELLLLFRDHGDLLEELGKFRPLPSFPSTVYSYNTIWMFIFLMPFLLLSLLLAFEKPLDSFLLR

SEQ ID NO: 2954 - protein, 114 aa, Avena sativa
MSKWESVTFEESLRFVKRVKARDYMLYLSLLNVLTRNDQIPLEAYDELSTLFRHHEDLLEELGKFRPLPAPSITVYSQSSIWMLIFLMPFLFLSLLLAFEKPLDSFLLRPPFAA

SEQ ID NO: 2955 - protein, 438 aa, Triticum aestivum
MRRLSHFPLLAAVLLAVVPHPAHPLTELETSQIRRFQDYLRICTAHPAPDYAGAAAFLLPYAASLGLSTKTLHFSPCKSKPLLLLTWPGTDPSLPSILLNSHLDSVPAEPEHWIHPPYAAHHDPATGRVYARGAQDDKCLPIQYLEAIRGLQAAGFAPARTVHVSLVPDEEIGGEDGHEKFVQSEEFRALNVGFMLDEGQASLTDVYRVFYADRLVWKLIVKATGAPGHGSKLFDGAAVENLMDCIETVAGYRDAQFEKVKSGKYGPGEVVSVNPVYMNAGTPSPTGFVMNMQPSEAEVGFDLRLPPTEDIEQIERRIKEEWAPAHKNLTYQLMKKGPVRDVTGRPLLTPANESNPWWSVFEQAIISSGGKLAKPEILSSTTDARFVRQMGVPALGFSPMINTPILLHDHNEFLEDKVFLRGIEVYQHLIRALSSFKG

SEQ ID NO: 2956 - protein, 450 aa, Triticum aestivum
  misc_feature (4)..(4): Xaa can be any naturally occurring amino acid
  misc_feature (6)..(8): Xaa can be any naturally occurring amino acid
  misc_feature (24)..(25): Xaa can be any naturally occurring amino acid
  misc_feature (29)..(29): Xaa can be any naturally occurring amino acid
  misc_feature (31)..(32): Xaa can be any naturally occurring amino acid
  misc_feature (38)..(38): Xaa can be any naturally occurring amino acid
RSVXPXXXQPRTMRRLSHFPLLAXXLLAXVXXPAHPLXELETSQIRRFQDYLRICTAHPAPDYAGAAAFLLPYAASLGLRTATLHFSPCKSKPLLLLTWPGTDPSLPSILLNSHLDSVPAEPEHWIHPPYAAHHDPATGRVYARGAQDDKCLPVQYLEAIRGLQAAGFAPARTVHVSLVPDEEIGGEDGHEKFVQSEEFRALNVGFMLDEGQASLTDVYRVFYADRLVWKLIVKATGAPGHGSKLFDGAAVENLMDCIETVAGYRDAQFEKVKSGKYGPGEVVSVNPVYMNAGTPSPTGFVMNMQPSEAEVGFDLRLPPTEDIEQIERRIKEEWAPAHKNLTYQLMKKGPVRDVTGRPLLTPANESNPWWSVFEQAIISSGGKLAKPEILSSTTDARFVRQMGVPALGFSPMINTPILLHDHNEFLEDKVFLRGIEVYEHLIRALSSFKG

SEQ ID NO: 2957 - protein, 371 aa, Triticum aestivum
HRHAPLQPLQVKAPPPAHLCRARTPRSPSFFFNSHLDSVPAEPEHWIHPPYAAHRDPATGRVYARGAQDDKCLPVQYLEAIRGLQAAGFAPARTVHVSLVPDEEIGGEDGHEKFVQSEEFRALNVGFMLDEGQASLTDVYRVFYADRLVWKLIVKATGAPGHGSKLFDGAAVENLMDCIETVAGYREAQFEKVKSGKYGPGEVVSVNPVYMNAGTPSPTGFVMNMQPSEAEVGFDLRLPPTEDIEQIERRIKEEWAPAHKNLTYQLLKKGPVSDVTGRPLLTPANESNPWWAVFEQAIISSGGKLAKPEILSSTTDARFVRQMGVPALGFSPMINTPILLHDHNEFLEDKVFLRGIEVYQHLIRALSSFKG

SEQ ID NO: 2958 - protein, 295 aa, Triticum aestivum
YLEAIRGLQAAGFAPARTVHVSLVPDEEIGGEDGHEKFVQSEEFRALNVGFMLDEGQASLTDVYRVFYADRLVWKLIVKATGAPGHGSKLFDGAAVENLMDCIETVAGYREAQFEKVKSGKYGPGEVVSVNPVYMNAGTPSPTGFVMNMQPSEAEVGFDLRLPPTEDIEQIERRIKEEWAPAHKNLTYQLLKKGPVSDVTGRPLLTPANESNPWWAVFEQAIISSGGKLAKPEILSSTTDARFVRQMGVPALGFSPMINTPILLHDHNEFLEDKVFLRGIEVYQHLIRALSSFKG

SEQ ID NO: 2959 - protein, 445 aa, Avena sativa
PVTTATFSMRRLHHFLLVAVLLAAVPRPAHPLTELESSQIRRFQDYLRICTAHPTPDYAGAAAFLLPYAASLGLGTATLHFSACKSKPLLLLTWPGTDPSLPSILLNSHIDSVPAEPEYWIHPPYAAHHDPATGRVYARGAQDDKCLPIQYLEAIRGLQAAGFAPTRTVHISLVPDEEIGAEDGHEKFVQSEEFRALNVGFMLDEGQASLTDEYRVFYADRLVWKLIVKATGAPGHGSKMFDGAAVENLMDIIETVAGFREAQFAKVKAGKSGPGEVVSVNPVYMNAGTPSPTGFVMNMQPSEAEVGFDLRLPPTEDIEQIIRRIKEEWAPAHKNLTYQLMMKGPVRDVAGRPLVTLTNESNPWWSVFEHAIVSSGGKLAKPEILSSTTDARFVRQMGVPALGFSPMINTPILLHDHNEYLEDKVFLRGIEVYQHLIKALSSFKG

SEQ ID NO: 2960 - protein, 161 aa, Triticum aestivum
MNAGTPSPTGFVMNMQPSEAEVGFDLRLPPTEDIEQIERRIREEWAPAHKNLTYQLMKKGPVSDVTGRPLLTPANESNPWWSVFEQAIISSGGKLAKPEILSSTTDARFVRQMGVPALGFSPMINTPILLHDHNEFLEDKVFLRGIEVYQHLIRALSSFKG

SEQ ID NO: 2961 - protein, 206 aa, Festuca arundinacea
GTRHGSKMFDGAAVENLMDIIETVAGFREAQFGKVKAGKSGPGEVVSVNPVYMNAGTPSPTGFVMNMQPSEAEVGFDLRLPPTEDIEQIIRRIKEEWAPAHKNLTYQLMMKGPVRDVAGRPLVTLTNESNPWWSVFEHAIISSGGKLAKPEILSSTTDARFVRQMGVPALGFSPMINTPILLHDHNEFLEDKVFLRGIDVYQHLIK

SEQ ID NO: 2962 - protein, 446 aa, Oryza sativa
MPHLRRRHRRRLLAAVVFLLLSAVVARPAAGAFTELESAQIGRFQDYLRIRTAHPSPDYAGAAAFLLPYAASLGLRAATLHFTPCKSKPLLLLTWPGTDPSLPSLLLNSHLDSVPAEPEQWLHPPFAAHRDAATGRVYARGAQDDKCLPIQYLEAIRGLRDAGFAPTRTLHISLVPDEEIGGADGFEKFAQSEEFRDLNVGFMLDEGQASLTDEFRVFYGDRLVWRLIVKATGAPGHGSKLFDGAAVENLMDCVETIAGFREAQFGMVKSGKRGPGEVVSVNPVYMKAGTPSPTGFVMNMQPSEAEVGFDFRLPPTEDVEHIIRRIKEEWAPAHKNLTYKLMQKGPTRDLAGRPMVTPTNASNPWWSVFEQAIISAGGKLAKPEILSSTTDSRFIRQLGIPALGFSPMTNTPILLHDNNEFLEDKVFLRGIKVYEHIIRALSSFKG

SEQ ID NO: 2963 - protein, 439 aa, Sorghum bicolor
MPPPLRCLLLAFVVLLSGFPRLAHPFTALESDQIARFQDYLRIRTAHPSPDYAGAAAFLLPYAASLGLDTTTLHFTPCKTKPLLLLTWRGSDPSLPSVLLNSHIDSVPAEPEHWAHPPFAAHRDAATGRVYARGAQDDKCLPVQYLEAIRGLQAAGFAPARTVHISLVPDEEIGGADGFDKFAQSEEFRALNIGFMLDEGQASPTDVFRVFYADRLVWRLIVKAAGVPGHGSRMFDGAAVDNLMDCVETIAGFRDAQFRMVKSGERGPGEVVSVNPVYMKAGIPSPTGFVMNMQPSEAEVGFDLRLPPTEDIEQIKRRVKEEWAPAHKNLTYQLMQKGPVTDVAGRPIFTATNESNPWWSIFEKAITSAGGKLSKPEILSSTTDSRFVRQLGIPALGFSPMTNTPILLHDHNEFLEDKVFLRGIKVYEHVIRALSSFQG

SEQ ID NO: 2964 - protein, 214 aa, Setaria italica
GAPGHGSRMFDGAAVGNLMDCVETVAGFREAQFGKVKAGEKGPGEVVSVNPVYMKAGIPSPTGFVMNIQPSEAEVGFDLRLPPTEDIEQIKRRVKEEWAPAHKNLTYELMQKGPVMDVAGRPIFTATNESNPWWSVFEQAITSAGGKLSKPEILSSTTDSRFVRQLGIPALGFSPMTNTPILLHDNNEFLEDKVFLRGIKVYEHVIRALSSFQG

SEQ ID NO: 2965 - protein, 440 aa, Pennisetum glaucum
MAAPLRHRRFLLAVVLLSGLLRPAHPFTELESDQIARFQEYLRIRTAHPSPDYAGAAAFLLPYAASLGLRTATLHFTPCKTKPLLLLTWPGTDPSLPSVLLNSHMDSVPAEPERWSHPPFAAHRDPATGRIYARGAQDDKCLPVQYLEAIRGLRAAGFAPARTVHISIVPDEETGGVDGFEKFARSEEFRALNIGFMLDEGQASPTDVFRVFYADRLVWRLIVKAAGPPGHGSRMFDGAAVDNLMDCVETVAGFREAQFGKVKTGERGPGEVVSVNPVYMKAGIPSPTGFVMNMQPSEAEVGFDLRLPPTEDIEQIKRRVKEEWAPAHKNLTYELMQKGPVTDVAGRSIFTATNDSNPWWSVFEKAITSAGGKLSKPEILSSTTDSRFVRQLGIPALGFSPMTNTPILLHDNNEFLEDKVFLRGIKVYEHVIRALSSFQG

SEQ ID NO: 2966 - protein, 228 aa, Saccharum officinarum
HEDRLVWRLIVKAAGAPGHGSRMFDGAAVDNLMDSVETIAGFRDAQFRMVKSGERGPGEVVSVNPVYMKAGIPSPTGFVMNMQPSEAEVGFDLRLPPTEDIEQIKRRVKEEWAPAHKNLTYQLTQKGPVTDVAGRPIFTATDESNPWWPIFEKAITSAGGKLSKPEILSSTTDSRFVRQLGIPALGFSPMTNTPILLHDHNEFLEDKVFLRGIKVYEHVIRALSSFQG

SEQ ID NO: 2967 - protein, 220 aa, Saccharum officinarum
LIVKAAGAPGHGSRMFDGAAVDNLMDSVETIAGFRDAQFRMVKSGERGPGEVVSVNPVYMKAGIPSPTGFVMNMQPSEAEVGFDLRLPPTEDIEQIKRRVKEEWAPAHKNLTYQLTQKGPVTDVAGRPIFTATDESNPWWPIFEKAITSAGGKLSKPEILSSTTDSRFVRQLGIPALGFSPMTNTPILLHDHNEFLEDKVFLRGIKVYEHVIRALSSFQG

SEQ ID NO: 2968 - protein, 171 aa, Pennisetum glaucum
REVVSVNPVYMKAGIPSPTGFVMNMQPSEAEVGFDLRLPPTEDIEQIKRRVKEEWAPAHKNLTYELMQKGPVTDVAGRSIFTATNDSNPWWSVFEKAITSAGGKLSKPEILSSTTDSRFVRQLGIPALGFSPMTNTPILLHDNNEFLEDKVFLRGIKVYEHVIRALSSFQG

SEQ ID NO: 2969 - protein, 170 aa, Triticum aestivum
PRVSVNPVYMKAGIPSPTGFVMNMQPSEAEVGFDLRLPPTEDIEQIKRRVKEEWAPAHKNLTYQLMQKGPVTDVAGRPIFTATNESNPWWSIFEKAITSAGGKLSKPEILSSTTDSRFVRQLGIPALGFSPMTNTPILLHDHNEFLEDKVFLRGIKVYEHVIRALSSFQG

SEQ ID NO: 2970 - protein, 287 aa, Panicum virgatum
RAAGFAPARTVHISLVPDEEIGGADGFEKFAESEEFRALNVGFMLDEGQASPTDVFRVFYADRLVWRLIVKAAGAPGHGSRMFDGAAVDNLMDCLETVAGFREAQFGMVKAGERGPGEVVSVNPVYMKAGIPSPTGFVMNMQPSGAEVGFDLRLPPTADIEQIKRRVKEEWAPAHKNLTYELIRKGPVTDVAGRPIFTATDESNPWWSVFEQAITSAGGKLSKPEILSSTTDSRFVRQLGIPALGFSPMSNTPILLHDNNEFLEDKVFLRGIKVYEHVIRALSSFQG

SEQ ID NO: 2971 - protein, 170 aa, Triticum aestivum
  misc_feature (34)..(34): Xaa can be any naturally occurring amino acid
PRVSVNPVYMKAGIPSPTGFVMNMQPSEAEVGFXLRLPPTEDIEQIKRRVKEEWAPAHKNLTYQLMQKGPVTDVAGRPIFTATNESNPWWSIFEKAITSAGGKLSKPEILSSTTDSRFVRQLGIPALGFSPMTNTPILLHDHNEFLEDKVFLRGIKVYEHVIRALSSFQG

SEQ ID NO: 2972 - protein, 296 aa, Hordeum vulgare
MVYGGEEALMRQYSIGDEIGRSRFGTVRRCHSNATGEALALKTTPKAPLRDPLDLALAEQEPKLHLLASSPPCSPHLVALHAAFDDANAVHLVVDLCAGGDLLSLVSARGGRLPEREAVGLAAQLASALAACHRRGVAHRDVKPDNLLFDAATSVLKLADFGSAEWFGDGRPMSGLVGTPYYVAPEVVAWREYGEKVDVWSAGVVLYMMLSGAVPFYGATAPEIFEAVLRGNLRFPPRAFAGVSPEAKDLMRRMLCKDVSRRFSTEQVLKASRGIASLLPGNAVLRGLKQNRLEPN

SEQ ID NO: 2973 - protein, 384 aa, Triticum aestivum
MADGKDLGAAAAAEPDPDEGQPDLEEEGELEAAAGGGGEEEEDVDVDGLASFLEFEILSGSSEEDPLDQLEEGEEEKETRVNDEAKNGKRKQDSLSDGDGSGSEDEHQKRARKEKGKGKVLAEGPPQIDTGMFTNVPPELFLQIFKFLSSEDLISCALVCRFMNAAASDETLWRRLYCMRWGLSSNATSNAKLRECAWKSLYIQQDREDMVEFVRYTPTEFKEYYIQMQAAKRSQAPLPSEVNDDKIVLDKTVADQVSSWKSRRGLTDDAVKGHSCSGSTCYYKQIGDAYICEKTGRVHVCDDACREFVLDQASGLLVCTISGHCFERFLCPDDEWDTCDADQQQGGVTDEAEPFMGSGRFARAYQLGYSCADEKELEHALRFC

SEQ ID NO: 2974 - protein, 399 aa, Triticum aestivum
RRSVGGEVDGERRTSMADGKDLGAAAAAEPDHDEGQPDLEEEGELEAAAAGGGEEEEDVDVDGLASFLEFEILSGSSEEDPLDQLEEGEEEKETRVNDEAKNGKRKQDSLSDGDGSGSEDEHQKRARKEKGKGKVLAEGPPQIDTGMFTNVPPELFLQIFKFLSSEDLISCALVCRFMNAAASDETLWRRLYCMRWGLSSNATSNAKLRECAWKSLYIQQDREDMVEFVRYTPTEFKEYYIQMQAAKRSQAPLPSEVNDDKIVLDKTVADQVSSWKSRRGLTDDAVKGHSCSGSTCYYKQIGDAYICEKTGRVHVCDDACREFVLDQASGLLVCTISGHCFERFLCPDDEWDTCDADQQQGGVTDEAEPFMGSGRFARAYQLGYSCADEKELEHALRFC

SEQ ID NO: 2975 - protein, 385 aa, Brachypodium distachyon
MADGQDLGDAAAVEPDPLPNPEEGRTDLEEGGEGEAAAGGGGEEEEDVDVDGLASFLEFEILSGSGAEDPPDQDEEEKEEPVKDDVRKGKRKQDSQSDGDGSGSEEEHQKRARREKGKGKALTPVQPRIDTGTFSNVPPELFLQIFKFLSSEDLISCALVCRFMNAAASDETLWRRLYCMRWGLSSNAISHAKLRECAWKNLYIQQDREDMVEFVRYTPTEFKEYYIQMQAAKRSQAPLPSEVNDDKVILDKTIADQVSSWKSSRGLTEDAVKGHSCSGSTCLYTQIGDAYICEKTGRVHVCDDACREFVLDQSSGLLVCTISGHCFERFLCPDDEWDTCDTDQQQGGVTDEAEPFLGSGRFARAYLLGYNCADEKELEYALRFC

SEQ ID NO: 2976 - protein, 389 aa, Avena sativa
MTDGQDPGDAAAAEPDPLPDPEEIHTDLEEAGEPEAGAGAGDSEEEEDVDVDGLASFLEFEILCGSSNEDPLDQQEEGGEEKEKPVIDALNKGKRKQSPQSDGDGSSSEDEHQKRARREKGKGKVLTAEHPQIDTGMFTNIPVELFLQIFKFLSSEDLISCALVCRFMNAAASDETLWRRLYCMRWGLSSNATSNAKLRDCAWKNLYIQQDREDMVEFVRYTPTEFKEYYIQMQAAKRSQAPIPSEVNDDKVILDKTVADQVSSWKSRRGLTDDSVKGHSCSGSTCLYTQIGDAYICEKTGCVHVCDDACREFVLDQSSGLLVCTISGHCFERFLCPDDEWDTCDTDQQQGGVTDEAEPFMGSGRFARAYQLGYDCADEKELEHALRFC

SEQ ID NO: 2977 - protein, 325 aa, Triticum aestivum
PRVRQELATDLDFTRQGRENAMLVRRLELLGEVAKLARSLHLPEDVSYTCENAAYFWLLHVYARWEQFLAACVPNKENPSFVKDRFPFSEFFLDTPQPVFTGESFEKDMHAAKGCFKHLSTIFQELEECRAFELLKSTAERANYLMTKQAKIVAMTCTHAALKRRDFLQLGFKYDNLLMEESAQILEIETFIPTLLQRQEDGYARLKRCILIGDHHQLPPVVKNMAFQKYSHMDQSLFTRFVRLGVPYIELNAQGRARPSIAQLYNWRYRELGDLPYVHEEAIFHKANSGFSYEYQLVDVPDYRGSPESAPSPWFYQNEGEAEYI

SEQ ID NO: 2978 - protein, 298 aa, Triticum aestivum
PRVRQELATDLDFTRQGRENAMLVRRLELLGEVAKLARSLHLPEDVSYTCENAAYFWLLHVYARWEQFLAACVPNKENPSFVKDRFPFSEFFLDTPQPVFTGESFEKDMHAAKGCFKHLSTIFQELEECRAFELLKSTAERANYLMTKQAKIVAMTCTHAALKRRDFLQLGFKYDNLLMEESAQILEIETFIPTLLQRQEDGYARLKRCILIGDHHQLPPVVKNMAFQKYSHMDQSLFTRFVRLGVPYIELNAQGRARPSIAQLYNWRYRELGDLPYVHEEAIFHKANSGFSYEYQLV

SEQ ID NO: 2979 - protein, 1578 aa, Brachypodium distachyon
MPKVYGTGVFEFRHPRAAEYPLPADVPAAAAPDKVPSSTGASITLLDIQRDRLTRVATEHWGSPAAAAAFDAELVKEIYATELRVEGRGRKTVPLHRVMILEVSQYLENYLWPHFDPDKASFEHVMSMILMVNEKFRENVAAWTCFHGRKDSFKGFLWRVLKLKEEDRPVSMAEKTNYLLFMINAFQSLEDELVRETILQVVSLKLWHTLSSGRLQMELCLNPELVKKWTKIKRKEAKEAKKAGLPCNPSDMLENKFLRNLIEEFLEILDLKVMLSSQDGGEESVLNESLSGQVDDSSVLYCERFMEFLIDMLSQLPTRRFLRPLVADVAVIAKCHLSTLYTHEKGRLFAQLVDLLQFYEGFEINDQSGTQLSDDDVLQAHYSRFQAFQLLAFKQIPKLRDLALCNIGSIHKRADLTKKLLVLSDTELQDLVCNKVKCSHGYNFSVLLLKIISEKDPYSGRRDFLIEVLVAFFEKRQSQKEAVNALPLYPNEQIMWDESLVPSINYSGEGCLALPKLNLQFLTLHDYLLRNFNLFRLESTYEIREDIQEAVPHLHSYINNEGDTAFRGWSRMAVPIKEFRITQVKQPNIGEVKPSAVTADVTFSISSYRPQIKSEWDSLKEHDVLFLLSIHPSFEPLSPEEAAKSTVPERLGLQYVRGCEVIEIRDEEGGLMNDYTGRIKRDEWKPPKGEIRTVKIALDTAQYHIDVTELAEKHTENVYGTFNILMRRKPKENNFKAILESIRDLMNETCVVPEWLHNIFLGYGNPSAAQWTNMPDLLETIDFKDTFLDADHVVQSFPAFQVTFINTDGTENMHPSPPFRIKLSKKMREISHALPGNVNSSDITSKNNMADDEGSQKEKLRVETYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLAEVAKLARSLHLPEDVSYTCENAAYFWLLHVYARWEQFLAACAPNKENPSFVKDRFPFSEFFSDTPQPIFTGESFEKDMHAAKGCFKHLSTIFQELEECRAFELLKSTAERANYLMTKQAKIVAMTCTHAALKRRDFLQLGFKYDNLLMEESAQILEIETFIPTLLQRQEDGYARLKRCILIGDHHQLPPVVKNMAFQKYSHMDQSLFTRFVRLGVPYIELNAQGRARPSIAELYNWRYRELGDLPYVREEAIFHKANSGFSYEYQLVDVPDYRGRGESAPSPWFYQNEGEAEYIVSVYIYMRLIGYPANKISILTTYNGQKLLIRDVISRRCKPWNIEPPCKVTTVDKFQGQQNDFILLSLVRTRFVGHLRDVRRLIVAMSRARLGLYVFCRRSLFEQCYELQPTFKLLLRRPDKLGLNLEECTPFTERPLGEAGNIHYITGVEDVGHLVNFRLEHLRQIQSMQCYTTPPENGNAGIVLRDAKEVMEEENGEAFDAMNSNRMDEDTVETKGDMMQEGNKMDAGNGEAGDVAIEDKMVEGSTDEAKDNMEEENADEAKDKMEEENADEAKDKMEEEKAESKGMEEE

SEQ ID NO: 2980 - protein, 1581 aa, Oryza sativa
MPKVYGTGVFEFRHPRAAEYPLPADVPASAASAPDKAIPTAAASTITLLDIQRDRLTRVAAEHWGAPTAGAAFDAALVREIYATELRVEGRGRKTVPLHRVMILEVSQYLENYLWPNFDPAGASFEHVMSMILMVNEKFRENVAAWTCFHDRKDAFKGFLWRVLKLKEEDRELNMAEKTNYLLFMINAFQSLEDELVRETILQLVSLKLWHTLSFGRLQMELCLNPELIKKWTKIKRKEAKEAKKAGQTCDASEMLENRFLRNLIEEFLEILDSKVILSSQDGGDESVLNVSLSGQVDDYCVLYCERFMEFLIDMLSQLPTRRFLRPLVADVAVVAKCHLSALYTHEKGRLFAQLVDLLQFYEGFEINDHSGTQLSDDDVLQAHYSRFQAFQLLAFKQVPKLRDFSLCNIGSIHKRADLAKKLLVLTDVELQDLVCNKFFYQLLLLFLKLISEEDPCSGRRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGDTAFRGWSRMAVPIKEFRITEVKQPNIGEVKPSAVTADVTFSISSYKPQIKSEWDALKEHDVLFLLSIRPSFEPLSPEEAAKSTVPERLGLQCVRGCEVIEIRDEEGSLMNDFTGRIKREEWKPPKGEIRTVKIALDTAQYHIDVTEVAEKGAENVYGTFNILMRRKPKENNFKAILESIRDLMNETCVVPEWLHNIFLGYGNPSAAQWINMPDLLENIDFKDTFLDADHVVQSFPDYQVTFINSDGTENLNPSPPFKIKLSKKMRESSHALPGNVNSVLSAKNNMVDDDGPQKEKIMVETYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVAKLASSLHLPEDVSYTCETAAYFWLLHVYARWEQFLAACAQNQDKPSFVKDRFPFSEFFSDTPQPTFTGESFEKDMHAAKGCFKHLLTIFQELEECRAFELLKSTAERANYLMTKQAKIVAMTCTHAALKRRDFLQLGFKYDNLLMEESAQILEIETFIPMLLQRQEDGYARLKRCILIGDHHQLPPVVKNMAFQKYSHMDQSLFTRFVRLGVPYIELNAQGRARPSIAELYNWRYRELGDLPYVREEAIFHKANSGFSYDYQLVDVPDFRGRGESAPSPWFYQNEGEAEFIVSVYIYMRLIGYPANKISILTTYNGQKLLIRDVINRRCKPWNIEPPSKVTTVDKFQGQQNDFILLSLVRTRFVGHLRDVRRLIVAMSRARLGLYVFCRRSLFEQCYELQPTFQLLLQRPDKLGLNLEECTPFTERPLEETGNIHYVAGIEDIGHLVNFRLEHLRQMQYMQYYAPHANVPPSAVPENNADATENGNAGNGMHKANDVMAEENGDAVMRNKMEEDTIDTMQEENKMDGKNPEANDMAMEEKTVDGDDDPKNKMEEGNTEAKNKMEEGNTEAKDKMEEENDVAKNNMEE

SEQ ID NO: 2981 - protein, 519 aa, Pennisetum glaucum
MHAAKGCFKHLSTIFQELEECRAFELLKSTVERANYLMTKQAKIVAMTCTHAALKRRDFLQLGFKFDNLLMEESAQILEIETFIPMLLQRQEDGYARLKRCILIGDHHQLPPVVKNMAFQKYSHMDQSLFTRFVRLGVPYIELNAQGRARPSIAKLYNWRYRELGDLPYVHEQAIFHKANAGFSFEYQLVDVPDYNGKGESAPSPWFYQNEGEAEYIVNVYIYMRLIGYPANKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRPDKLALNLDECTPFTERPLGETGNIYYVTGIEDIDHLVKFRLEHLRQMQYMQYYVPPANELPPAAPENIADVIPPENGSVLNQPKEHMAMEENGGGSDTTVSNRTEEDAVEAKDETMQEGNTMGEGNGHGDVAADKGDERADANDKMEEGDAPSKDKIEEENSEPSKDKIEEENSESKDKMDEE

SEQ ID NO: 2982 - protein, 707 aa, Pennisetum glaucum
VRFTPTQIGAIISGVQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNEDNPTFVKDRFPFSEFFSDTPQPIFTGESFEKDMHAAKGCFKHLSTIFQELEECRAFELLKSTVERANYLMTKQAKIVAMTCTHAALKRRDFLQLGFKFDNLLMEESAQILEIETFIPMLLQRQEDGYARLKRCILIGDHHQLPPVVKNMAFQKYSHMDQSLFTRFVRLGVPYIELNAQGRARPSIAKLYNWRYRELGDLPYVHEQAIFHKANAGFSFEYQLVDVPDYNGKGESAPSPWFYQNEGEAEYIVNVYIYMRLIGYPANKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRPDKLALNLDECTPFTERPLGETGNIYYVTGIEDIDHLVKFRLEHLRQMQYMQYYVPPANELPPAAPENIADVIPPENGSVLNQPKEHMAMEENGGGSDTTVSNRTEEDAVEAKDETMQEGNTMGEGNGHGDVAADKGDERADANDKMEEGDAPSKDKIEEENSEPSKDKIEEENSESKDKMDEE

SEQ ID NO: 2983 - protein, 760 aa, Panicum virgatum
FKIRLSKKMRESSHALPGNVNSSLAVKSNNNMADDESQKEKLIVETYVPADPGPYPQDKPKQNSVRFTPTQIGAIISGVQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDNPSFVKDRFPFSEFFSDTPQPIFTGESFDKDMHAAKGCFKHLSTIFQELEECRAFELLKSTVERANYLMTKQAKIVAMTCTHAALKRRDFLQLGFKFDNLLMEESAQILEIETFIPMLLQRQEDGYARLKRCILIGDHHQLPPVVKNMAFQKYSHMDQSLFTRFVRLGVPYIELNAQGRARPSIAKLYNWRYRELGDLPYVREQAIFHKANAGFSFEYQLVDVPDYKGKGESAPSPWFYQNEGEAEYIVNVYIYMRLIGYPANKISILTTYNGQKLLIRDVINKKCKPYNIEPPNKVTTVDKFQGQQNDFILLSLVRTRFVGHLRDVRRLIVAMSRTRLGLYVFCRRSLFEQCYELQPTFQLLLQRPDRLALNLEECTPFTERPLGETGNIHYVTGIEDIGHLVKFRLEHLRQMQYMQYYAPPANELPPAVPDNIAAVIPPENGSVLNQPNEHMAVEENGGANDTTVGNKMEEDAVEAKDETMQEGNKMCEGNGDGDLAAKDKDDKHADTNDKMEEGDAMSKDKIEEGNSEPKDKMDEE

SEQ ID NO: 2984 - protein, 1280 aa, Zea mays
MAEKTNYLLFMINSFQSLEDELVRETILQLVSLKLWNTLSFGRLQMELCLNPELIKKWTKIRRREAKEAKKADQPINPSEMLENKFLRNLIEEFVEILNSKVILSNQDGAEESVLNESFSGQIDDSCVLYCERFMEFLIDMLSQLPTRRFLRPLVADVAVVAKCHLSALYTHEKGRLFAQLVDLLQFYEGFEINDHSGTQLGDDDVLQAHYSRFQAFQLLAFKQVPKLRDFALSSIGSLHKRADLTKKLLVLSDVELQDLVCNKLKLISEKDPCSERRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGETAFRGWSRMAVPIKGFKITEVKQPNIGEVKPSAVTADVTFSISSYRYQIKSEWDALKEHDVLFLLSIRPSFEPLSPEEAEKSTVPERLGLQYVRGCEVIEIRDEEGALMNDFTGRIKREEWKPPKGEIRTVRVALDTAQYHIDVTETAEKGTENVYGTFNILMRRKPKENNFKAILESIRDLMNETCVVPEWLHNIFLGYGNPSAAQWMNMPDLLEVIDFKDTFLDANHVQQSFPDYQVTFINSDGTKNLHPSPPFKIRLSKKMRESSHALPGNMNSNLTVKSRNNMADGEPQKEKLIVETYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSTIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPANKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRSDKLALNLEECTPFTERPLEETGNIHYITGIEDINSSSKVQAGTSSSSAIHAVLCSSGK

SEQ ID NO: 2985 - protein, 1649 aa, Zea mays
MPKVFGTGVFEFRHPRAAEYPLPADAAPATAAAPDKVPASTGGGSITLLDIQRDRLTRVATEHWGTAAAAAAFDADLVRKIYGTELRVEGRGRKTVPLQRVMILEVSQYLENYLWPHFDPVDASFEHVMSIILMVNEKFRENVAAWTCFHDRKDAFKGFLWRVLKLKEEERALNMAEKTNYLLFMINSFQSLEDELVRETILQLVSLKLWNTLSFGRLQMELCLNPELIKKWTKIRRREAKEAKKADQPINPSEMLENKFLRNLIEEFVEILNSKVILSNQDGAEESVLNESFSGQIDDSCVLYCERFMEFLIDMLSQLPTRRFLRPLVADVAVVAKCHLSALYTHEKGRLFAQLVDLLQFYEGFEINDHSGTQLGDDDVLQAHYSRFQAFQLLAFKQVPKLRDFALSSIGSLHKRADLTKKLLVLSDVELQDLVCNKLKLISEKDPCSERRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGETAFRGWSRMAVPIKGFKITEVKQPNIGEVKPSAVTADVTFSISSYRYQIKSEWDALKEHDVLFLLSIRPSFEPLSPEEAEKSTVPERLGLQYVRGCEVIEIRDEEGALMNDFTGRIKREEWKPPKGEIRTVRVALDTAQYHIDVTETAEKGTENVYGTFNILMRRKPKENNFKAILESIRDLMNETCVVPEWLHNIFLGYGNPSAAQWMNMPDLLEVIDFKDTFLDANHVQQSFPDYQVTFINSDGTKNLHPSPPFKIRLSKKMRESSHALPGNMNSNLTVKSRNNMADGEPQKEKLIVETYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSTIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPANKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRSDKLALNLEECTPFTERPLEETGNIHYITGIEDINHLVKFRLEHLRQVQYMQYYAPPANELPQAAPENIADAIPSENGNAGRALNDGNEDMTREENGGATDTVISNRIEEDSVEAKDDMTQEGDKGEVSGKGHMATEDRKGEAQGGADGKLEEANVMSADKMMEEANATSADKMEEANATSADKMEEADATSSDKMEEADATLPDKMEEADATLPDKMEETNVTLPDKMEEANAMSPDRMEEKNSDPKDKMDEE

SEQ ID NO: 2986 - protein, 1550 aa, Prunus persica
MTKVYGTGAYDFKRHHVAEYPVEQPHQPGDKPVEAKPGSALPSSITLSEIQRDRLTMIAAANWSKTGDTSHPKQPLDPELVKEIYQTELSVKEGQRKTVPLQRVMILEVSQYLENYLWPNFDPETATFEHVMSMILMVNEKFRENVAAWVCFYDRKDVFKGFLERVLRLKSGRELSIAEKTNYLVFMINAFQSLEDEIVSDTVLTLASLESWHSLSYGRFQMELCFNPDLIKKWKKMIRKEAKEAAKRGEPFDPSTTLEVQFLRNLIEEFLEILDSKVVPPDRSINEDDQLVEANRLEHVDDACVLYCERFMEFLIDLLSQLPTRRYLRPLVADVAVVAKCHLSALYRHEKGKLFAQLVDLLQFYEGFEINDHDGTQLTDDEVLQSHYDRVQSFQLLAFKKVPKLRELALANIGSIDKRNDLSKKLSVLPPEELKDLVCSKLKVVSKDDPWSQRVDFLIEVMVSFFEKQQSQKEKINALPLYPNELIMWDESLVPSINYSGEGCLALPKLNLQFLTLHDYLLRNFNLFRLESTYEIREDIQEAVPHLLSYINNEGETAFRGWSRMAVPIKQFRISEVKQPNIGEVKPAAVTAEVTFSVSSYKAQIRSEWNALKEHDVLFLLSIRPSFEPLSAEEDGRASVPQRLGLQYVRGCEIIEIRDEEGTLMNDFTGRIKRDEWKPPKGELRTVTVALDTAQYHMDVSNIAAKGSEDVYGTFNILMRRKPKENNFKAILESIRDLMNEYCIVPDWLHNIFLGYGNPSAAQWTNMPGLLATVDFKDTFLDAEHLKECFPDDQVSFISPDGTENLNPSPPFRIRLPKTIKSSTNALPGNKKSTDSISDGPVKNSDIEKEKIVVEAYTPPDPGPYPQDQPKKNSVRFTPTQVGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACVDNKDKPSFVKDRFPFKEFFSNTPKPVFTGESFEKDMRAAKGCFRHLKTMFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRDLGDLPYVKEDAIFHRANSGFSYEYQLVDVPDYHDRGESAPSPWFYQNEGEAEYVVSVYIYMRLLGYPANKISILTTYNGQKLLIRDVINRRCAPYDFIGPPSKVTTVDKFQGQQNDFILLSLVRTRFVGHLRDVRRLIVAMSRARLGLYVFCRRSLFEQCYELQPTFQLLLQRPDHLALNLNEISPNTERHVEDTGPMHLVSSVDEMIGIYQQLYEVKFHQYMAYSGRVAPSIDAFEEKTTQENLISGQHHMDTDIPVTSDGAPEDNTQHGSNLEEDTKMDALANGQNLESSLENHSNGGTDVEAGGGDRNVPPESNSDETNMEE

SEQ ID NO: 2987 - protein, 1521 aa, Fragaria vesca
MTRVYGTGAYDFKRHHVAEYPVGDKPVEAKPGAALPSSITLSEIQRDQLTVIAAANWSRVGDAKEKKPAFDPELVKRIYETELRVKEGERKTVPLQRVMILEVSQYLENYLFPNFDAETATFEHVMSMILMVNEKFRENVAAWVCFYDRKDAFKGFLGRVLGLKSERELGIAEKTNYLVFMINAFQSLEDEIVSETVLRLASFQSWHSLSYGRFQMELGLNSDLIKKWRRMVKREAAKHGESFNPSTALEVQFLRNLIEEFLEILDSKVLRPNHGVNGEDQLLDVNGMEHVDDACVLYCERFVEFLIDLLSQLPTRRYLRPLVADVAVVPKCHLSALYRHEKGKLFTQLVDLLQFYEGFEINDNVGKQLTDDEVLQSHYDRVQSFQLLAFKKIPKLKELALANIGSIDNRNDLTKRLSVLSPEELKDLVCSKLKLISKNDPWSSRVDFLTEVMVSFFKRQQSQKEKINALPLYPNELIMWDESLVPSINYSGEGCLALPKLNLQFLTLHDYLLRNFDLFRLESTYEIREDIQEAVPHLNACINNEGETVFRGWSRMAVPIKEFKISEVKQPNIGEVKPAAVTAEITYSISSYKAQVRSEWNALKEHDVLFLLSIRPSFEPLSAEEGAKASVPQKLGLQYVRGCEIIEVRDEEGTLMNDFTGRIKRDEWKPPKGELRTLTVALDTAQYYMDVSNTAAKGAEDVYGTFNILMRRKPKENNFKAILESIRDLMNEYCIVPDWLHKTFLGYGNPSAAQWTNMPDLLETVDFKDTFLDADHLRECFPDYQVFFVSPDGTENMDPRPPFRVRLPKTIKSSTNALAGNKKAKMSSMSDVPIEDSDKGNEKFVVEAYTPPDPGPYPQDQPRQNSVRFTPTQVGAILSGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWELFLAACNENKNKQSFVKDRFPFKEFFSDSPKPVFTGESFEKDMRAAKGCFRHLKTVFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRELGDLPYVKQDAIFKRANSGFSFEYQLVDVPDYHDRGESAPSPWFYQNEGEAEYVVSVYIYMRLLGYPANKISILTTYNGQKLLIRDVINRRCAPYDFIGPPSKVTTVDKFQGQQNDFILLSLVRTRFVGHLRDVRRLIVAMSRARLGLYVFCRRSLFEQCYELQPTFQHLLQRPDCLALNFNETTPHTERHVEETGPVHLVSSVDEMISIYQQLYAVKFHQYVAPSILQTSMSGQDPMDADIPVSADGVPDDTPHVSNSELEDNGRKVDSSVENHSNGVTEMETSLDDAHVVPESNSDQVRMEE

SEQ ID NO: 2988 - protein, 1528 aa, Manihot esculenta
MTKVYGTGAYDFKRHHVAEYPVEVQTHLGDKPVESKPGSTLPNSITLSEIQRDQLTKIAAANWLQTGGTGSEEKKNDFDPELVKQIYETELKVKDGRKPVPLQRVMILEVSQYLENYLWPNFDPETATFEHVMSMILMINEKFRENVAAWLCFYDRKDVFKEFLERVIRLKEGRELSIAEKTNYLVFMINAFQSLEDEIVSETVLKLGSLQSWYSLSYGRFQMELCLNTDLIKKWKRMIKREAKEAMKQGELFDPSTSLEVKFLRNLIEEFLDVLDFQVFPHSSSLSEDGLDIGFEGVDDAAVLYCERFMEFLIDLLSQLPTRRYLRPLVADVAVVAKCHLSALYRHEKGKLFAQLVDLLQFYERFEINDHVGTQLTDDEVLQSHYDRFQAFQLLAFKKIPKLRELALSNIGAIHKRADLSKKLSVLSPEELKDLVCYKLKLVSDRDPWSKRVDFLIEVMVSFFEKQQSQKEAINALPLYPNEQIMWDESVVPSINYSGEGCLALPKLNLQFLTLHDYLLRNFNLFRLESTYEIREDIQEAVPHLLAYINNEGETAFRGWSRMAVPIKEFKITEVKQPNIGEVKPSSVTAEVTFSISSYKAQIRSEWNSLKEHDVLFLLSIRPSFEPLSAEEAGKATVPQRLGLQYVRGCEIIEIRDEEGTLMNDFTGRIKRDEWKPPKGELRTVTLALDTAQYHMDVTDIAEKGAEDVYKTFNVLMRRKPKENNFKAILESIRDLMNEYCIVPDWLHNVFLGYGNPSAAQWTNMPDLLETVDFKDTFLDADHLKESFPDYQVCFVNPDSTESLNPKPPFRIRLPRTMKGNTHAVPGNKKLSIDSMNDANMEDAGSEKEKLIVEAYIPPDPGPYPQDQPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLNEVERLARSLQLPEDVGYTCETAGYFWLLHVYSRWEQFLAACEDNKDKPTFVQDRFPFKEFFSNMPQPVLTGQSFEKDMRAAMGCFRHLKTMFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRDLGDLPYVKEGAIFHKANAGFSYEYQLVDVPDYHGRGETAPSPWFYQNEGEAEYVVSVYVYMRLLGYPANKISILTTYNGQKLLIRDVINRRCVPYDFIGPPSKVTTVDKFQGQQNDFILLSLVRTRFVGHLRDVRRLVVAMSRARLGLYVFCRRSLFEQCYELQPTFQLLLQRPDHLALNLNENLSHTERPVEDVGQPYLVSGVEEMGHIVIDKINQLYQARMMNYQFEQYYSSNTSAPANGAWDNTQHESKSEEVEEMEGIESGQNEDLPLQGKPDGERDAEMGRNDENGVPSESTNEETDKV

SEQ ID NO: 2989 - protein, 1553 aa, Theobroma cacao
MTKVHGTGVYDFKRHHVAEYPVEFTDQLDSKSGPGSSLPSSITLSEIQRDQLTRIATANWLKSGGSKPNKPFDPQLVKEIYDTELTVKSEGKSQRKTVPLQRVMILEVSQYLENYLWPNFDAETASYEHVMSMILMVNEKFRENVAAWSCFYDQKDVFTGFLGRVLRLKEGRDLTIAEKTNYLVFMINAFQGHAIAGEQHPVHHQLHPIPAHSGNRHQIYQCMSLEDEIVRETVLRLASLRSWHSLSYGRFQMELCLNPDLIKKWKRMIKKEADDAKKQGVHVDPLSSLEVNFLRNLIEEFLEVLDHKVFSRKHSVNEDDELDASSFEQVDDASVLYCERFMEFLIDLLSQLPTRRYLRPLVADVAVVAKCHLSALYRRDKGKLFAQLVDLLQFYENFEINDHVGTQLTDDEVLQSHYDRLQSLQLLAFKKIPKLQELALANIGATHKRADLSKKLSVLSPEELKDLVCCKIYHFSFQLKLVSKNDPWSDRVDFLIEVMVSFFEKQQSQKEAINALPLYPNEQIMWDESVVPSINYSGEGCLALPKLNLQFLTLHDYLLRNFNLFRLESTYEIREDIQEAVPHLLAYINNEGETAFRGWSRMAVPIKEFKITEVKQPNIGEVKPASVTAEVTYSISSYRSQIRSEWDALKEHDVLFLLSISPSFKPLSAEEDAKASVPEKLGLQYVRGCEIIEIRDEEGTLMNDFSGRTKREEWKPPKGELRTVTIALDTAQYHMDVTDIAEKGAEDVYGTFNVLMRRKPKENNFKAILESIRDLMNEYCIVPDWLHKIFLGYGHPSAAQWTNMPDLLETVDFKDTFLSADHLKESFPHYQVYFVDSDGRENLDPRPPFRIKLPQLLKSDTHALSGNGISDTGSVNDANTVHACIEKEKLIVEAYIPPDPGPYPQDQPKQNSVRFTPTQIGAIISGIQPGLTMVVGPPGTGKTDTAVQILNVLYHNCPSQRTLIITHSNQALNDLFEKIMERDVPARYLLRLGQELLSEVERLARSLQLPEDVGYTCETAGYFWLLHVYSRWEQFLAACAGNEDKPAFVQDRFPFKEFFSNTPQAVFTGQSFEKDMRAAKGCFRHLKTMFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAQLYNWRYRDLGDLPYVKEEPIFHRANAGFSYDYQLVDVPDYHGRGETAPSPWFYQNEGEAEYVVSVYIYMRLLGYPANKISILTTYNGQKLLIRDVINRRCLPYDFIGPPSKVTTVDKFQGQQNDFILLSLVRTRFVGHLRDVRRLVVAMSRARLGLYVFCRRSLFEQCYELQPTFHLLLQRPDHLALNLNESTSFTERHVEDIGHPYLVGGVEEMANVVYGKINQLQQARAMYQYMAYSGQYMGTSEEQNSEHNSISPNQAMDIDTSVAENGRIDDNVHENNGEEAKDVDGLANGPDGVLPPENLSNAEKDAEVCANDENRVP

SEQ ID NO: 2990 - protein, 659 aa, Quercus alba
VRTQLDLHYTDWSNHLWYSAWTNYGCGSTCTGKTDTAVQILNVLYHNCPSQRTLIITHSNQALNDLFEKIMQRDVPARYLLRLGQGEQELATDLDFSRQGRVNAMLVRRLELLGEVERLARSLQLPEDVGYTCETAGYFWLLHVYSRWEQFLAACAENEDKPTFVKDRFPFKEFFSDTPHPIFMGESFEKDMRAAKGCFRHLKTMFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRDLGDLPYVKEDAVFHRANAGFSYEYQLVDVPDYQGRGESAPSPWFYQNEGEAEYVVSVYMYLRLLGYPANKISILTTYNGQKLLIRDVINRRCVPYDFIGPPSKVTTVDKFQGQQNDFILLSLVRTRFVGHLRDVRRLVVAMSRARLGLYVFCRRSLFEQCYELQPTFQLLLQRPDRLALNLNEITSYTERHVEDTGPIHLVSGVEEMISIFNWRYQERYMSHQFDHYMTYSGQNDQQNSTTLFNAMDTDTPSVQHESSMEEDTRIDGDVLPASHSNGEVDKEASKNDENDRQPESSNSSEENMTE

SEQ ID NO: 2991 - protein, 561 aa, Cajanus cajan
MLVRRLELLSEVERLARSLQLPEDVGYTCETAGYFWLLHVYSRWEQFLAACAENKEKPTFVQDRFPFKEFFSDTPHPVFTGESFEKDMRAAMGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPSVKEEIIFNRANAGFAYDYQLVDVPDYLGKGETTPSPWFYQNEGEAEYVVSVYIYLRLLGYPANKISILTTYNGQKLLIRDVINRRCIPYDFIGPPSKVTTVDKFQGQQNDFILLSLVRTRFVGHLRDVRRLVVAMSRARLGLYVFCRRSLFEQCYELQPTFQLLLKRPDHLALNMNEITSYTVRDVEDPGPIHHIHLVSGIEEMASIIDSLYQEKLRHQFHQNGPYFSHLEPSENTDEVQNMQQTEDTDMREQTVDTPPESKGTTTVDNHVAGDMPPENSVEDVTMVDNSAGVANGSPTSNEGQV

SEQ ID NO: 2992 - protein, 196 aa, Sequoia sempervirens
SNQALNDLFEKIMQRDVPARYLLRLGQGEQELATDLDFSRQGRVNAMLARRLELLAEVERLAKTLGLPEDVAYTCETAGYFWLLHVFSRWELFLAACEGNQDKPSFVKDRFPFSEFFSDTPQPVFTGQSFERDMRAAKGCFRHLSTMFQELEECKAFELLKSTADRANYLMTKQAKIVAMTCTHAALKEKISSARI

SEQ ID NO: 2993 - protein, 1467 aa, Medicago truncatula
MTKVYGTGTYDFRRHRVAEYPLAEPKPVEWSQKSGGGGLPNNITVSEIQRDRLTKIAESNWLKGSEKKKEFDGELVKKIYETELLVKEGQGNNKPVPLQRVMILEVSQYLENYLWVNFDPETASFEHVMSIIIMVNEKFRENVAAWVCFHDRKDVFKEFLERVIRLKEGRELNIAEKTNYLVFMINAFQSLEDEVVNEAVLRLADLKSWFSLSYGRFQMELCLNPGLVKKWKNMLKKEPVKGGKHLDPSTTVEVTFLRNLIEEFLEILDSQVFYQRQLSGEDDELINETGSWLINDACVLYCERFMEFLIDLLSQLATRRYLRPLVADVAVVAKCHLSALYRHEKGKLFAQLVDLLQFYEGFEINDHTGVQLTDHEVVESHYSRLQSFQLLAFKKIDKLRELALTNIGSIHTRANLSKKLSVLSPEELRDLVCCKLKLVSKDDPWSERVDFLIEIMVSYFEKQQSQKEAINALPLYPNEQIMWDESVVPSINYSGEGCLALPKLNLQFLTLHDYLLRNFNLFRLESTYEIREDIQEAVPHLLAYINIDGETAFRGWSRMGVPIKEFRIAEVKQPNIGEVKPSSVTAKVTYSISSYRSHIRSEWDALKEHDVLFLLTIRPSFEPLSAEEENKASVPQKLGLQYVRGCEIIEIHDEEGTLMNDFSGKIKREDWKPPKGELRTVTVALDTAQYHMDVNNIAEKGGEDVYGTFNVLMRRKPKENNFKAILESIRDLMNEYCIVPKWLENIFLGYGDPSDAQWTSGSKLLPDLLETVDFKDTFLDADHLKGSFGDYEVTFVNHDGTENLNPSPPFKIKIPRTLKGSNGALPGRAVSTSGAANDINMVDTNHQKETLVIETYTPPDPGPYPQDQPKQNSVRFTATQVEAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAENKEKPTFVRDRFPFKEFFCDTPHPVFTGESFEKDMRAALGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPFLKEEAIFNRANAGFAYDYQLVDVPDHNGKGETTPSPWFYQNEGEAEYIVSVYIYMRLLGYPANKISILTTYNGQKLLIRDVINRRCVPYNFIGAPSKVATVDKFQGQQNDFILLSLVRTRFVGHLRDVRRLVVAMSRARLGLYVFCRRSLFEQCYELQPTFQLLLKRPDHLALNMNEITSYTERNAEDPGPRHHVHLVSGIEEMSSIIDRLYQVCLTSHDTRHNIQIHHDTQGYDKN

SEQ ID NO: 2994 - protein, 126 aa, Gossypium hirsutum
MTRKLFAQLVDLLQFYENFEINDHVGTQLTDDEVLQSHYDRFQSFQLLAFKKVPKLKELALANVGAIHKRVDLSKKLSVLSPGELKDLVCSKLKLVSNEDPWSDRVDFLIEVMVSFLRSTSLKKKP

SEQ ID NO: 2995 - protein, 1492 aa, Ricinus communis
MTKVYGTGAYDFKRHRVAEYPVESQALSSDNKPGSTLPNSITLSEIQRDRLTKIAAANWLKTGGSGTESEGFDPDVVKQIYETELKVKEGRKPVPLQRVMILEVSQYLENYLWPNFDPETASFEHVMSMILMINEKFRENVAAWLCFYDRKDVFRGFLERVLKLKEGRELSIAEKINYLVFMINAFQSLEDEIVSETVLKLGGLQSWHSLSYGRFQMELCLNPDLVKKWKRMIKKEAKEAMKRGEPFDPLTALEVKFLRNLVEEFLDVIFYLRTMKKLQNSVDGDDGLHVGFDEVDDAAILYCERFMEFLIDLLSQLPTRRYLRPLVADVAVVAKCHLSALYRHEKGKLFAQLVDLLQFYERFEINDHVGTQLTDDEVLQSHYDRFQAFQLLAFKTMPKLRELALSNIGAINKRADLSKKLSVLSPEELKDLVCCKLKLVSAEDPWSERVDFLIEVMVSFFEKQQSQKEAINALPLYPNEQIMWDESLVPSINYSGEGCLALPKLNLQFLTLHDYLLRNFNLFRLESMYEIREDIQEAVPHLLAYVNNEGETAYKAQIRSEWNALKEHDVLFLLSIRPSFEPLSAEEAGKATVPQRLGLQYVRGCEIIEIRDEEGTLMNDFTGRIKRDEWKPPKGELRTVTVALDTAQYHMDITGIAEKGAEDVYGTFNVLMRRKPKENNFKAILESIRDLMNEYCIVPDWLHNIFLGYGNPSAAQWINMPDLLETVDFKDTFLDADHLKESFLDYQVRFVNPDGTECLHPRPPFRISLPRTLKGNTHALPGNKKVATDSLNDVNMEDANSEKEKLIVEAYIPPDPGPYPQDQPKQNSVKFTPTQIGAIISGIQPGLTMVVGPPGTGKTDTAVQVLNVLYHNCTSQRTLIITHSNQALNDLFEKIMQRDVPARYLLRLGQGEQELATDLDFSRQGRVNAMLVRRLELLGEVERLARSLQLPEDVGYTCETAGYFWLLHVYSRWEQFLAACADNEDKPTFVQDRFPFKEFFSNSPKPVFTGQSFEKDMRAAKGCFRHLKTMFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRDLGDLSYVKDGAIFHRANSGFSYEYQLVDVPDYHGRGESAPSPWFYQNEGEAEYVVSVYIYMRLLGYPANKISILTTYNGQKLLIRDVINRRCVPYDFIGPPSKVATVDKFQGQQNDFILLSLVRTRFVGHLRDVRRLVVAMSRARLGLYVFCRRSLFEQCYELQPTFQLLLQRPDHLALNLNEVLPYTERPVEDIGHPYLVSSVEEMGQIVTDKMNQMYQARLNYQFEQMAYSSNVVAPANGAVDEKPLEGESEEAKESKSEEAKEMDGIEIDQNGDLPCQGQRNGEKDTEICPNDKNSKPSESTNEETRMQE

SEQ ID NO: 2996 - protein, 575 aa, Podocarpus macrophillus
MQRDVPARYLLRLGQGEQELATDLDFSRQGRVNAMLARRLELLAEVERLAKTLKLPEDVAYTCETAGYFWLLHVYSRWEQFLAACEVNQDKPCFVKDRFPFSEFFSDTPQPVFTGLSFERDMHAAKGCFRHLSTMFQELEECKAFELLKSTADRANYLMTKQAKIVAMTCTHAALKRKDFLQLGFKYDNLLMEESAQILEIETFIPMLLQRQEDGHSRLKRCILIGDHHQLPPVVKNMAFQKYSHMDQSLFTRFVRLGIPYVELNAQGRARPSIAKLYNWRYRQLGDLPYVQNESVFHLANAGFCYDYQLVDVPDHNGQGESAPVPWFYQNLGEAEYVVSVYMYMRLLGYPASKISILTTYNGQKHLIRDVVRQRCASHPLLGSPNKITTVDRFQGQQNDYILLSLVRTRFVGHLRDVRRLVVAMSRARLGLYVFCRRSLFEQCYELQPTFQLLLRRPDKLALNLDEATSSTERLVGETGRIHLVSGLEEIDHIALSKYYQLYQAPLMWQQIPSSTTPPIYGNNSGSIMPTSGDSSFQERLSAEPVIAPDVSTRTDENVEAATNDKSGEENGMQE

SEQ ID NO: 2997 - protein, 428 aa, Vigna unguiculata
KPSNGSLTGKAMSTAGATNGINTADTNYQKETLIIEAYTPPDPGPYPQDQPKQNSVRFTPTQVEAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFSDTPLPVFTGESFEKDMRAAMGCFCHLKTVFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRELGDLPSVKEEVIFKRANAGFAY

SEQ ID NO: 2998 - protein, 1554 aa, Populus trichocarpa
MTKVYGTGAYDFKRHHVAEYPLDLSATRTETKSADSKPGSTTLPSSITLSEIQRDRLTKIASANWLKTTPSAVADGGDMLAEEEERRGFDAELVKKIYETELKVKEGRKTVPLQRVMILEVSQYLENYLWPNFDPETATFEHVMSMILMINEKFRENVAAWSCFYDRKDVFKRFLDRVLHLKEGRELSIAEKTNYLVFMINAFQSLEDEMVSQTVLRIASFESWHSLSYGRFQMELCLNNKLIKKWRKTIRKEAEEATKRGEVFNPSTSLEVRFLRNFTEEFLDVLDFKVFPQKSSANEDEIDDAAVLYCERFMEFLIDLLSQLPTRRYLRPLVADVAVVAKCHLSALYRHEKGKLFAQLVDLLQFYERFEINDYYGTQLTDDEVVRSHYERFQAFQLLAFKKIPKLRELALSNVGAIHKRADLSKKLSVLSPEELKDLVCCKLKLVSAEDPWSERVDFLIEVMVSFFERQQSQKEAINALPLYPNEQIMWDESVVPSINYSGEGCLALPKLNLQFLTLHDYLLRNFNLFRLESTYEIREDIQEATPHLLPYINNEGETAFRGWSRMAVPIKEFKITEVKQPNIGEVKPSSVTAKITFSISSYKTQIRSEWNALKEHDVLFLLSVRPSFEPLSAEEAEKASVPERLGLQYVRGCEIIEIRDEEGTLMNDFTGKIKREEWKPPKGELRTVTVALDTAQYHMDVTDIAERGAEDIYGTFNVLMRRKPKENNFKAILESIRDLMNEYCIVPDWLHNIFLGYGDPSAAQWTKMPDHLQKVDFKDTFLDADHLKESFPDHQVCFVNPDGSANLNPRPPFRIRLPEKLKGYTHAIPGNEKSTIDSKNGVNMVDSGREKEELIVEAYIPPDPGPYPQDQPNQNSVRFTSTQIGAIMSGIQPGLTMVVGPPGTGKTDTAVQIMNVLYHNCPSQRTLIITHSNQALNDLFEKIMQRDVPARYLLRLGQGEQELATDLDFSRQGRVNAMLVRRLELLSEVERLARSLQLPEDVAYTCETAGYFWLLHVYSRWEQFLATCADNEDKPTLVQDRFPFKEFFSNTPQPVFTGQSFEKDMRAAKGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPYVKEGAIFKNANAGFSYDYQLVDVPDYHGRGETAPSPWFYQNEGEAEYIVSVYIYMRLLGYPANKISILTTYNGQKLLIRDVINRRCVPYDFIGPPCKVATVDKFQGQQNDFILLSLVRSRFVGHLRDVRRLVVAMSRARLGLYVFCRRSLFEQCYELQPTFQHLLQRPDRLALNFGEVSTYTERQVEDIGHPYFVSSVEEMGHIVVDKMNQLHQARMMSYQHEHYIAYPSDGPAPAKGAIINDTPDENEAEESKQIDDIPSGEDNQAEESKEMDAIPSGEDGDLQPDNQLNGEKVSEACPNDEDGMPPRSGANGETSMEE

SEQ ID NO: 2999 - protein, 1554 aa, Populus trichocarpa
MTKVYGTGAYDFKRHHVAEYPLDLSATRTETKSADSKPGSTTLPSSITLSEIQRDRLTKIASANWLKTTPSAVADGGDMLAEEEERRGFDAELVKKIYETELKVKEGRKTVPLQRVMILEVSQYLENYLWPNFDPETATFEHVMSMILMINEKFRENVAAWSCFYDRKDVFKRFLDRVLHLKEGRELSIAEKTNYLVFMINAFQSLEDEMVSQTVLRIASFESWHSLSYGRFQMELCLNNKLIKKWRKTIRKEAEEATKRGEVFNPSTSLEVRFLRNFTEEFLDVLDFKVFPQKSSANEDEIDDAAVLYCERFMEFLIDLLSQLPTRRYLRPLVADVAVVAKCHLSALYRHEKGKLFAQLVDLLQFYERFEINDYYGTQLTDDEVVRSHYERFQAFQLLAFKKIPKLRELALSNVGAIHKRADLSKKLSVLSPEELKDLVCCKLKLVSAEDPWSERVDFLIEVMVSFFERQQSQKEAINALPLYPNEQIMWDESVVPSINYSGEGCLALPKLNLQFLTLHDYLLRNFNLFRLESTYEIREDIQEATPHLLPYINNEGETAFRGWSRMAVPIKEFKITEVKQPNIGEVKPSSVTAKITFSISSYKTQIRSEWNALKEHDVLFLLSVRPSFEPLSAEEAEKASVPERLGLQYVRGCEIIEIRDEEGTLMNDFTGKIKREEWKPPKGELRTVTVALDTAQYHMDVTDIAERGAEDIYGTFNVLMRRKPKENNFKAILESIRDLMNEYCIVPDWLHNIFLGYGDPSAAQWTKMPDHLQKVDFKDTFLDADHLKESYPDHQVCFVNPDGSANLNPRPPFRIRLPEKLKGYTHAIPGNEKSTIDSKNGVNMVDSGREKEELIVEAYIPPDPGPYPQDQPNQNSVRFTSTQIGAIMSGIQPGLTMVVGPPGTGKTDTAVQIMNVLYHNCPSQRTLIITHSNQALNDLFEKIMQRDVPARYLLRLGQGEQELATDLDFSRQGRVNAMLVRRLELLSEVERLARSLQLPEDVAYTCETAGYFWLLHVYSRWEQFLATCADNEDKPTLVQDRFPFKEFFSNTPQPVFTGQSFEKDMRAAKGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPYVKEGAIFKNANAGFSYDYQLVDVPDYHGRGETAPSPWFYQNEGEAEYIVSVYIYMRLLGYPANKISILTTYNGQKLLIRDVINRRCVPYDFIGPPCKVATVDKFQGQQNDFILLSLVRSRFVGHLRDVRRLVVAMSRARLGLYVFCRRSLFEQCYELQPTFQHLLQRPDRLALNFGEVSTYTERQVEDIGHPYFVSSVEEMGHIVVDKMNQLHQARMMSYQHEHYIAYPSDGPAPAKGAIINDTPDENEAEESKQIDDIPSGEDNQAEESKEMDAIPSGEDGDLQPDNQLNGEKVSEACPNDEDGMPPRSGANGETSMEE

SEQ ID NO: 3000 - protein, 1509 aa, Arabidopsis thaliana
MTKVYGTGTYDFKRHRVAEYPLELPSHPAEKPLESKPGSNLPSSITLSEIQQDRLTKIAEESWIKTGGKLPEKPFDPEVVKEIYVTELKVTSGRKPVPLQRVMILEVSQYLENYLWPNFDPETATFEHVMSMILMINEKFRENVAAWICFHDRDDLFKKFLQKVLRLKEGRDLTIAEKTNYLVFMINAFQSLEDAVVNEIVLSLAGLQSWHSLSYGRFQMELCLQPDLIKKWKRSSKKWAAEAKSKGEKFDLSSSPEANFVRGLIEEFVEVLDHGVFADEVDDTAGSQLVDDSSVLYCERFMEFLIDMLNQLPTRRYLRPLVADIAVVAKCRLSALYKHEKGKLFAQLVDLLQFYEKFEIKDHDGTQLTDDEALQFHYDRFMAFQLLAFKKIPKLQDLSLANIGSIHKSSDLRRRLSVLSLEDLRDVVCSKLKLVSRHDPWADSKDFLTEVVVSSFEKQQSQKEAINALPLYPNEQIMWDESVIPSINYSGEGCLALPKLNLQFLTLHDYLLRNFNLFRLESTYEIREDIQEAVPHLLAHINNEGDTAFRGWSRMAVPINDFKIAQVKQPNIGEEKPSSVTAEVTFSIKSYRTQIRSEWNSLKEHDVLFLLCIRPSFEPLGPEEADKATVPQRLGLQYVRGCEIIDIRDEEGNLMNDFTGRVKRDEWKPPKGEMRTVTVALDAAQYHIDVTDIAEKGAEDVYGTFNVLMRRKPKENNFKAILESIRDLMNEYCIVPEWLHNVFLGYGNPSAAQWPNMPNLLEIVDFKDTFLNANHLSESFSDYEVSFINAEGAEALDPSPPFRITLPKTLKGNGAISGNKISEVNPADNVNMVDASPKEKLIVEAYTPPDPGPYPQDQPKQNSVKFTPTQVGAIISGIQPGLTMVVGPPGTGKTDTAVQILNVLYHNCPSQRTLIITHSNQALNDLFEKIMERDVPARYLLRLGQGEQELATDLDFSRQGRVNAMLVRRLELLSEVERLARSLQLPEDVGYTCETAGYFWLLHVYSRWELFLAACAGNEDNQSFVRDRFPFKDFFSDTPKPVFNGESFEKDMRAAKGCFSHLKTVFQELEECRAFELLKSTADRANYLMTKQAKIVAMTCTHAALKRRDFLQLGFKYDNLLMEESAQILEIETFIPMLLQRQEDGHARLKRCILIGDHHQLPPVVKNMAFQKYSHMDQSLFTRFVRLGIPYIELNAQGRARPSLAKLYNWRYRDLGDLSIVKEAPIFQRANAGFSYEYQLVNVPDYEGRGESTPSPWFYQNQGEAEYIVSVYIYMRLLGYPANKISILTTYNGQKLLIRDVINRRCVPYPFIGPPSKVTTVDKFQGQQNDFILLSLVRTRFVGHLRDVRRLVVAMSRARLGLYVFCRRSLFEQCYELQPTFQLLLQRPDRLGLNFNENTAYTDRVVEEVENSYLVHDVEEMAHIVDDRMNKFYQAQGAYEQYQNNMAQMEDGNHDMESDSVVDGDESEKNMQQLNQSPDIDGELSKEVVGMEVDNNGFSSENGKADEKN

SEQ ID NO: 3001 - protein, 1524 aa, Glycine max
MTKVYGTGLYDFRRHRVAEYPVAAAPAESKTLVPKTGGGGGGVPSSITLSEIQRDRLTKIAEANWLKSGDAGRPKKDFDPELVRKIYETELLVKEGSKPVPLQRVMILEVSQYLENYLWPYFDPLTATFEHVMSIIIMVNEKFRENVAAWTCFHERKDAFKGFLESVLRLKEGRELSIAEKTNYLVFMINAFQSLEDEVVSRTILRLANLKSWYSLSYGRFQMELCLNPGLIKKWKRMIKKEPVKGDGSHLDPSTTVEVMFVRNLIEEFLEILDSQVFPLKQLSGEDDELIDATGLGLVNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLSKKLSVLSPEELRDFVCCKLKLVSKEDPWSERVDFLIEVMVSYFEKQQSQKEAINALPLYPNEQIMWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPSFEPLSTEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDLLETVDFKDTFVDADHLKESFLDYEVSFVNPDGSGNLNPRPPFKIKLPRTLKPNNGALTGHAISTSGATNEINVVDANYQKEALIIETYTPPDPGPYPQDQPKQNSVRFTPTQVEAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFCDTPHPVFTGESFEKDMRAAMGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPTIAKLYNWRYRDLGDLPSVKEEVIFNRANAGFAYDYQLVDVPDYLGKGETTPSPWFYQNEGEAEYVVSVYIYMRLLGYPANKISILTTYNGQKLLIRDVINRRCVPYDFIGPPSKVTTVDKFQGQQNDFILLSLVRTRFVGHLRDVRRLVVAMSRARLGLYVFCRRSLFEQCYELQPTFQLLLKRPDHLALNVNEITSYTERNVEDPGPGHHLHLVSGIEEMGSIIDRLYQEKLRHQFDQNGAYFSHLEPSANTDWVQSGQQTMDTDMPEQTEEATTVDNHVAVDMPPENSMEDVTMVDNGDGVANGNPSP

SEQ ID NO: 3002 - protein, 1440 aa, Lotus japonicus
MTKVHGTGTYDFRRHRVAEYPVAAEPKPVEWSQKSGGALPSTLTVSEIQRDRLTKIAEENWSKKKKEKAFDAEVVEKIYESELLVKEGQGHKPVPLQRVMILEVSQYLENYLWPHFDPLTATFQHVMSIILMVNEKFRENVAAWVCFHERKDAFKGFLERVLRVKEGRELSIAEKTNYLIFMINAFQSLEDEVVSETVLKLASLKSWYSLSYGRFQMELCLNPSLIKKWKRMIKKESGKGGHHSDQSTAVEVMFLRNLIEEFLEILDSQVFPQRQLSGENDELIDGADFGVVNDACVLYCERFMEFLIDLLSQLPTRRYLRPLVADVAVVAKCHLSALYRHEKGKLFAQLVDLLQFYEGFEINDHTGTQLTDHEVLESHYSRLQAFQLLAFKKMSKLRELSLTNIGSIHKRANLSKKLSVLSPEELRDLVCCKLKLVSKEDPWSERVDFLIEVMVSFFEKQLSQKEAINALPLYPNEQIMWDESVVPSINYSGEGCLALPKLNLQFLTLHDYLLRNFNLFRLESTYEIREDIQEAVPHLQAYINSDGETAFRGWSRMAVPIKEFRITEVKQPNIGEVKPSSVTAKITYSISSYRAHVRSEWDALKEHDVLFLLSIRPSFEPLSAEEEARASVPQKLGLQFVRGCEVTEIRDEEGILMNDFSGRIKRDEWKPPKGELRTVTVALDTAQYHMDVNKIAEKGADDVYGTFNVLMRRKPKENNFKAILESIRDLMNEYCIVPKWLENIFLGYGDPSAAQWTNMPDLLEAVDFKDTFVDADHLRKSFVNYEVSFVNPDGTENLNPRPPFKIKLPRTLKGSIGSHPGGAVPAVDATNDINVVDANHQKEKLIIETYTPPDPGPYPQDQPKQNTVRFTPTQVEAIISGIQPGLTMVVGPPGTGKTDTAVQILNVLYHNCPSQRTLIITHSNQALNDLFEKIMQRDVPARYLLRLGQGEHELETDLDFSRQGRVNAMLVRRLELLSEVERLARSLNLPEDVGYTCETAGYFWLLHVYSRWEQFLAACSENNEKPTFVRDRFPFKEFFFDTPHPVFTGESFEKDMRAAMGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLFNWRYRDLGDLPIVKKEVIFNRANAGFAYDYQLVDVPDYMGKGETTPSPWFYQNEGEAEYVVSVYIYMRLLGYPANKISILTTYNGQKLLIRDVISRRCTPFDYIGAPSKVTTVDKFQGQQNDFILLSLVRTRFVGHLRDVRRLVVAMSRARLGLYVFCRRSLFEQCYELQPTFQLLLKRPDHLALNFSEITSCTERDVEDPGPHIHLVSGIEEMSSIIERLCQVCHFL

SEQ ID NO: 3003 - protein, 1522 aa, Glycine max
MTKVYGTGLYDFRRHRVAEYPVAAPPSESKAEVPKAGGGGGFPSSITLSEIQRDRLTKIAEANWLKSGDAARPKKDFDPELVRKIYETELLVKEGSKPVPLQRVMILEVSQYLENYLWPHFDPLAATFEHVMSIIIMVNEKFRENVAAWTCFHERKDAFKVFLERVLRLKEGRELSIAEKTNYLVFMINAFQSLEDEVVSRTILRLANLKSWYSLSYGRFQMELCLNPGLVKKWKRMIKKEPVKGGGSHLDPLTKVEVMFVRNLIEEFMEVVFPQKQLSGEDNELIDATGLGLLNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLTKKLSVLSPEELRNFVCCKLKLVSKEDPWSERVDFLIEVMLSYFEKQQSQKEAINALPLYPNEQIMWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPLFEPLSAEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDVLETVDFKDTFVDADHLKESFVDYEVSFVNSDGSENLNPRPPFKIKLPRTLKPNNGTLTGHAMSTSGATNDINVVDANYQKEALVIETYTPPDPGPYPQDQPKQNLVRFTPTQVEAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFYDTPHPVFTGESFEKDMQAATGCFRHLKNMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPSVKEEVVFNRANAGFAYDYQLVDVPDYLGKGETTPSPWFYQNEGEAEYVVSVYIYMRLLGYPANKISILTTYNGQKLLIRDVVNRRCVPYDFIGPPSKVTTVDKFQGQQNDFILLSIVRTRFVGHLRDVRRLVVAMSRARLGLYVFCRRSLFEQCYELQPTFQLLLERPDHLALNVNEITSYTERNFEDPGPGHHVHLVSGIEEMGSIIDRLYQEKLRHQFDQNGPYLSHLEPSENTDGMQSGQQTMDTDMPEQTEDDMPHKIKEATTVDNVTGYNNVEDVTMVDNSDGVANGNPSP

SEQ ID NO: 3004 - protein, 1526 aa, Glycine max
MTKVYGTGLYDFRRHRVAEYPVAAPPSESKAEVPKAGGGGGFPSSITLSEIQRDRLTKIAEANWLKSGDAARPKKDFDPELVRKIYETELLVKEGSKPVPLQRVMILEVSQYLENYLWPHFDPLAATFEHVMSIIIMVNEKFRENVAAWTCFHERKDAFKVFLERVLRLKEGRELSIAEKTNYLVFMINAFQSLEDEVVSRTILRLANLKSWYSLSYGRFQMELCLNPGLVKKWKRMIKKEPVKGGGSHLDPLTKVEVMFVRNLIEEFMEILDSQVFPQKQLSGEDNELIDATGLGLLNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLTKKLSVLSPEELRNFVCCKLKLVSKEDPWSERVDFLIEVMLSYFEKQQSQKEAINALPLYPNEQIMWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPLFEPLSAEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDVLETVDFKDTFVDADHLKESFVDYEVSFVNSDGSENLNPRPPFKIKLPRTLKPNNGTLTGHAMSTSGATNDINVVDANYQKEALVIETYTPPDPGPYPQDQPKQNLVRFTPTQVEAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFYDTPHPVFTGESFEKDMQAATGCFRHLKNMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPSVKEEVVFNRANAGFAYDYQLVDVPDYLGKGETTPSPWFYQNEGEAEYVVSVYIYMRLLGYPANKISILTTYNGQKLLIRDVVNRRCVPYDFIGPPSKVTTVDKFQGQQNDFILLSIVRTRFVGHLRDVRRLVVAMSRARLGLYVFCRRSLFEQCYELQPTFQLLLERPDHLALNVNEITSYTERNFEDPGPGHHVHLVSGIEEMGSIIDRLYQEKLRHQFDQNGPYLSHLEPSENTDGMQSGQQTMDTDMPEQTEDDMPHKIKEATTVDNVTGYNNVEDVTMVDNSDGVANGNPSP

SEQ ID NO: 3005 - protein, 1512 aa, Arabidopsis lyrata
MTKVYGTGTYDFKRHRVAEYPLELPSHPAEKPLEAKPGSNLPSSITLSEIQQDRLTKIAEESWIKTGGKLPEKPFDPEVVKEIYVTELKVTSGRKPVPLQRVMILEVSQYLENYLWPNFDPETATFEHVMSMILMINEKFRENVAAWICFHDRDDLFKKFLQKVLRLKVGRDLTIAEKTNYLVFMINAFQSLEDAVVNEIVLSLAGLQSWHSLSYGRFQMELCLQPDLIKKWKRSSKKWAAEAKSKGEKFDLSSSPEANFVRGIIEEFVEVLDHGVFADEVDDTAGSQLVDDSSVLYCERFMEFLIDMLNQLPTRRYLRPLVADIAVVAKCRLSALYKHEKGKLFAQLVDLLQFYEKFEIKDHDGTQLTDDEALQFHYDRFMAFQLLAFKKIPKLQDLSLANIGSVHKSSDLRRRLSVLSLEDLRDVVCSKLKLVSRHDPWADSKDFLTEVVVSSFEKQQSQKEAINALPLYPNEQIMWDESVIPSINYSGEGCLALPKLNLQFLTLHDYLLRNFNLFRLESTYEIREDIQEAVPHLLAHINNEGDTAFRGWSRMAVPINDFKIAQVKQPNIGEEKPSSVTAEVTFSIKSYRTQIRSEWNSLKEHDVLFLLCIRPSFEPLGPDEADKATVPQRLGLQYVRGCEIINIRDEEGNLMNDFTGRVKRDEWKPPKGEMRTVTVALDAAQYHIDVTDMAEKGAEDVYGTFNVLMRRKPKENNFKAILESIRDLMNEYCIVPEWLHNVFLGYGNPSAAQWPNMPNLLETVDFKDTFLDANHLSESFPDYEVSFINAEGAEALDPSPPFRITLPKTLKGNAAISGNKISEVNPADNVNMVDASPKEKLIVEAYTPPDPGPYPQDQPKQNSVKFTPTQVGAIISGIQPGLTMVVGPPGTGKTDTAVQILNVLYHNCPSQRTLIITHSNQALNDLFEKIMERDVPARYLLRLGQGEQELATDLDFSRQGRVNAMLVRRLELLNEVERLGRSLQLPEDVGYTCETAGYFWLLHVYSRWELFLAACAGNEDNQSFVRDRFPFKDFFSDTPKPVFSGESFEKDMRAAKGCFSHLKTVFQELEECRAFELLKSTADRANYLMTKQAKIVAMTCTHAALKRRDFLQLGFKYDNLLMEESAQILEIETFIPMLLQRQEDGHARLKRCILIGDHHQLPPVVKNMAFQKYSHMDQSLFTRFVRLGIPYIELNAQGRARPTLAKLYNWRYRDLGDLSIVKEAPIFQRANAGFSYEYQLVNVPDYEGKGESTPSPWFYQNQGEAEYIVSVYIYMRLLGYPANKISILTTYNGQKLLIRDVINRRCVPYPFIGPPSKVTTVDKFQGQQNDFILLSLVRTRFVGHLRDVRRLVVAMSRARLGLYVFCRRSLFEQCYELQPTFQLLLQRPDRLGLNLNENTTYTDRAVEEVGNPYLVHDVEEMAHIVHDRMNQFYQAQGVYEQYQNNMPQMEDGNHDMESDSVVGAVDGDESEKNMQQIKQAPDIDGELSKEVVGMEVDNNGFSSENGKADEKN

SEQ ID NO: 3006 - protein, 1560 aa, Aquilegia formosa
MPKVYGTGVYDFKRHRVAEYPILQRPIQDPKPVNSITSNSSAFSITLDEIQTDRLTKIAAENWSKTSVSSSITNPFSNELVKEIYETELLVKSGCNKPVYTQRVTMLEISQYLENYLWPNFDYETSSFEHVMSMILMVNEKFRENVAAWKCFYDRKDVFRGFLERVLRLKEQGRALSIAEKTNYLLFMINLFQSLEDEIVSGTVLKLVSLQSWHSLSYGRFQMELCLNPNLIKKWKKLTKKETKEAKKRGEPFEPSSMLEVKFLRSLIEEFLEILDLEVFSHKQSDHEDNEVDEYYGSKQVNDACVLYCERFMEFLIDLLSQLPTRRFLRPIVADVAVVSKCHLSTLYTHEKGKLFAQLVDLLQFYEGFEIDDHAGTQLSDDNVLLTHYYRLQTFQLLIFKKIPKLRDLALANIGSINKRADLTKKLSFLSPEELQDLVCKKLKLVSDGDPWAKRVDFLIEVMVSFFEKRQSQKEAINALPLYPNEQIMWDESLIPSINYSGEGCLALPKLNLQFLTLHDYLLRNFNLFRLESTYEIREDIQEAVPHLLAYINNEGEPAFRGWSRMAVPISRLRISEVKQPNIGEVKPSSVTAQVTFSISSYKGQMRSEWNSLKEHDVLFLLAIYPLFEPLSAEEAAKSSVPEKLGLKYVRGCEVIELRDEEGTLMNDFTGRIKRDEWKPPKGDLRTVTVALDTAQYYMDVSDIAEKGAEDVYGSFNILMRRKPKENNFKAILESIRDLMNESCIVPDWLHNIFLGYGNPSAAQWTNMPDLLETVDFKDTFLDADHLKDSFPDYQVCFVSQDGSENLHTEPPFRIKLPKALKGNTHALPGNKKSTTSTMNDVNMVDTGLERERLIVEAYVPPDPGPYPQDQPKQNSVRFTPTQIGAIISGVQPGLTMVVGPPGTGKTDTAVQILNVLYHNCPTQRTLIITHSNQALNDLFEKIMQRDVPARYLLRLGQGEQELATDLDFSRQGRVNAMLVRRLELLQEVERLARSLQLPEDVGYTCETAGYFWLLHVYSRWEQFLAACSQNQDKPSFVKDRFPFTEFFSDTPQPVFTGQSFEKDMRSAKGCFRHLKIMFQELEECRAFELLKTTADRANYLMTKQAKIVAMTCTHAALKRKDFLHLGFKYDNLLMEESAQILEIETFIPMLLQRQEDGYARLKRCILIGDHHQLPPVVKNIAFQKYSHMDQSLFTRFIRLGIPYIELNAQGRARPDIAKLYNWRYRDLGDLPYVREQAIFHRANPGFCYEYQLVDVPDYRGRGEISPSSYFFQNEGEAEYIVSVYMYMRLLGYPASKISILTTYNGQKFLIRDVINRRCAQYDFIGPPSKVTTVDKFQGQQNDFILLSLVRTRIVGHIRDVRRLIVAMSRARLGLYVFGRRSLFEQCYELQPTFQHLLQRPDLLALNCDEEVYPFTERLVGDIGNQFRFVSGVEEMANVVNLKLNYMYQARAMSHHYNQYPAHAGQVPAAIDAPEGVDNHISLPSSHHEVTSVTSPVNGDMLLENGGEDETQNSSPKTVVNGDTQVEGSSNLDSHMEDRVKSESDVPTEDNSKDESKMEE

SEQ ID NO: 3007 - protein, 414 aa, Brassica napus
MTKQAKIVAMTCTHAALKRRDFLKLGFKYDNLLMEESAQILEIETFIPMLLQRQEDGHARLKRCILIGDHHQLPPVVKNMAFQKYSHMDQSLFTRFVRLGIPYIELNAQGRARPSLAKLYNWRYRDLGDLSIVKEAPIFHRANAGFSYDYQLINAPDYEGRGESTPSPWFYQNQGEAEYIVSVYIYMRLLGYPANKISILTTYNGQKLLIRDVINRRCVPYAFIGPPSKVTTVDKFQGQQNDFILLSLVRTRFVGHLRDVRRLVVAMSRARLGLYVFCRRSLFEQCYELQPTFQLLLKRPDRLGLNLSENTAYTDRAVEEVGNPYLVHDVEEMAHIVHDRMNEFYKAQGVYEQCQNNMPQIEDGNHMESDSVVGEDGESEKTVQPELDGVVDETSKEMEVDNGVSSENGKADEN

SEQ ID NO: 3008 - protein, 855 aa, Pinus taeda
MNDFTGRVKREEWKPPKGELRTVVLALDTAQYQMDVNAIAEKDAEDIYKTFNVLMRRKPKENNFKAILESIRDLMNEACIVPEWLHDIFLGYGNPSAAQWTNMPDTLDIVDFKDTFLDADHLRESFPDYDVSFLHPDGDVDKFPKPPFRITLPRTLKSAANQVLPGATKRGGVDGDIVNKMMESNGKREQIIVETYVPPDPGPYPQDQPKKNNVRFTPVQIGAIISGIQPGLTMVVGPPGTGKTDTAVQILNVLYHNCPSQRTLIITHSNQALNDLFEKIMQRDVPARYLLRLGQGEQELATDVEFSRQGRVNAMLARRLELLAEVERLAKTLHLPEDVGYTCETAGYFWLLHVYSRWEQFLAACESNQDKASFVKDRFPFKEFFSDTPQPVFTGLSFERDMRAAKGCFRHLTTMFQELEECKAFELLKSTADRANYLMTKQAKVVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYVELNAQGRARPSIAKLYNWRYRQLGDLSYVQKEHVFHLANTGFCYEYQLVDVPDHRGMGESAPVPWFYQNLGEAEYVVSVYMYMRLLGYPASKISILTTYNGQKHLIRDVIRQRCASHPLIGSPSKVTTVDRFQGQQNDYILLSLVRTRFVGHLRDVRRLVVAMSRARLGLYVFCRRSLFEQCYELQPTFQLLLQRHDRLALNLDETTCPTERFVGDTGRIHLVSGLEEMEHIAMSKFYQLYQGQTIGQQVTIHYSNQQIHGYNSGATMPINTNFPAEQRSLVEPGFIPYRSPETEKNAEAPVDDKLDKNNDMQ

SEQ ID NO: 3009 - protein, 416 aa, Brassica napus
  misc_feature (271)..(271): Xaa can be any naturally occurring amino acid
MTKQAKIVAMTCTHAALKRRDFLKLGFKYDNLLMEESAQILEIETFIPMLLQRQEDGHARLKRCILIGDHHQLPPVVKNMAFQKYSHMDQSLFTRFVRLGIPYIELNAQGRARPSLAKLYNWRYRDLGDLSIVKEAPVFHRANAGFSYDYQLINVPDYEGRGESTPSPWFYQNQGEAEYIVSVYIYMRLLGYPANKISILTTYNGQKLLIRDVINRRCVPYAFIGPPSKVTTVDKFQGQQNDFILLSLVRTRFVGHLRDVRRLVVAMSRAXLGLYVFCRRSLFEQCYELQPTFQLLLKRPDRLGLNLSENSSAYTDRAVEEVGNPYLVHDVEEMAHIVHDRMNEFYKAQGVYEQYQNNMPQIEDGNQDMESDSVVGEDGESEKTVQPELDGVVDETSTEMEVDNGVSSENGKADEN

SEQ ID NO: 3010 - protein, 1413 aa, Solanum phureja
TLLQGRSLTIPEKINYLLFMINAFQSLEDEIVSKKVLRLAGLQCWHCLSYGRFQMELCVNPDLIKKWKKIAKRAKEAAKRGESFDTSTMLEVNFLRHLIEEFLEVLDCKVFPQPDSEVNNDLDFTSDFEGVNDASVLYCERFMEFLIDLLSQLPTRRYIRPVVADVAVVAKCHLSALYGHEKGKLFAQLVDLLQFYEGFEIDDHLGRQMTDDEVIQAHYDRFQSFQLLAFKKIPKLRELALANVGAIHRRADLSKKLSVLTPEELRDLVCRKLKLISVDDPCSNRVDFLIEVMVSFFERQQSQKEAINALPLYPNEQIMWDESLVPSINYTGEGCLALPKLNLQFLTLHDYLLRNFNLFRLESTYEIREDIQEAVPHLLAYINNEGEPAFRGWSRMAVPVKEFKITEVKQPNIGEVKPAAVTAEVTFSISSYKSQIRSEWNALKEHDVLFLLSIRPSFEPLSAEEAANATVPQRLGLQCVRGCEIIEMRDEEGILMNDFTGRIKRDEWKPPKGDLRTVTVALDTAQYHMDVGDIAEKGAEDIYGTFNILMRRKPKENNFKAILESIRDLMNETCIVPDWLHDIFLGYGNPSAAQWTNMPDLLETVDFKDTFLDADHVRESFPDYQVCFVDQDGLENVQPCPPFKIKLPRNLKGKAHALPGSENSTTASVDAAGMPEVHSERDKLIVEAYIPPDPGPYPQDQPKRNSVKFTATQVGAIISGVQPGLSMVVGPPGTGKTDTAVQVLNVLYHNCPSQRTLIITHSNQALNDLFEKIMQRDVPARYLLRLGQGEQELATDLDFSRQGRVNAMLVRRLELLSEVERLARSLQLPEDVGYTCETVGYFWLLHVYSRWEQFLAACAAEKDNPTIVQDKFPFKEFFSDTPQPVFTGQSFGKDMRSAKGCFRHLKTMFQELEECRAFELLKSTVDRSNYLMTKQAKIVAMTCTHAALKRKDFLQVGFKYDNLLMEESAQILEIETFIPMLLQRQEDGYARLKRCILIGDHHQLPPVVKNMAFQKYSHMDQSLFTRFVRLGIPYIELNAQGRARPSLARLYNWRYRELGDLPNVKENAVFHKANAGFSYDYQLVDVPDYNGRGESAPSPWFYQNEGEAEYIVSVYMYMRLLGYPANKISILTTYNGQKLLIRDVINRRCVPYDFIGPPHKVATVDKFQGQQNDFILLSLVRTRFVGHLRDVRRLIVAMSRARLGLYVFCRRSLFEQCYELQPTFRLLLERPDCLALNVEEATSLTNRPVGETGPVSVVSGPEEMQAIVNFKMHQVYQARMMSHIEYPAHPESVPEPSVEQNVMSLPHSMDTDKTAMEDGDTGPSELMESTKVQPDDGEMLVVGHSNGEVDGEDQRVVSGGLGTSTGSTEVPHDDAEMLVASQSNGEADGKDQRVDSDGTDLENSSNVESKMEE

SEQ ID NO: 3011 - protein, 1588 aa, Solanum lycopersicum
MTKVYGTGTYDFRRHRVAEYPVEALPQTAEAPQKMLPSMTEKPPESKPGSNIPSSITLAEIQRDRLTKIAASNWAKTGEKKAFSSELVKEIYDTELTVKGGRKPVPLQRVMILEVSQYLENYLWPNFDPEASSFEHVMSMILMVNEKFRENVAAWICFYDRKDMFKAFLDRVLRLKEGRSLTIPEKINYLLFMINAFQSLEDEIVSKKVLRLAGLQCWHCLSYGRFQMELCVNPDLIKKWKKIAKRAKEAAKRGESFDTSTMLEVNFLRHLIEEFLEVLDCKIFPQPDDEVDSDLNFTSDFEGVNDASVLYCERFMEFLIDLLSQLPTRRYIRPVVADVAVVAKCHLSALYRHEKGKLFAQLVDLLQFYEGFEIDDHLGRQMTDDEVIQAHYDRFQSFQLLAFKKIPKLRELALANVGAIHRRADLSKKLSGLTPEELRDLVCRKLKLISVDDPCSNRVDFLIEVMVSFFERQQSQKEAINALPLYPNEQIMWDESLVPSINYTGEGCLALPKLNLQFLTLHDYLLRNFNLFRLESTYEIREDIQEAVPHLLAYINNEGEPAFRGWSRMAVPVKEFKITEVKQPNIGEVKPAAVTAEVTFSISSYKSQIRSEWNALKEHDVLFLLSIRPSFEPLSAEEAANATVPQRLGLQCVRGCEIIEMRDEEGILMNDFTGRIKRDEWKPPKGDLRTVTVAIDTAQYHMDVGDIAEKGAEDIYGTFNILMRRKPKENNFKAILESIRDLMNETCIVPDWLHDIFLGYGNPSAAQWTNMPDLLETVDFKDTFLDADHVRESFPDYQVCFVDQDGLENLQPSPPFKIKLPRNLKGKAHAIPGSENSTTASVDAAGMPEVHSERDKLIVEAYIPPDPGPYPQDQPKRNSVRFTATQVGAIISGVQPGLSMVVGPPGTGKTDTAVQVLNVLYHNCPSQRTLIITHSNQALNDLFEKIMQRDVPARYLLRLGQGEQELATDLDFSRQGRVNAMLVRRLELLSEVERLARSLQLPEDVGYTCETAGYFWLLHVYSRWEQFLAACAAEQDNPTIVQDKFPFKEFFSDTPQPVFTGQSFGKDMRSAEGCFRHLKTMFQELEECRAFELLKSTVDRSNYLMTKQAKIVAMTCTHAALKRKDFLQVGFKYDNLLMEESAQILEIETFIPMLLQRQEDGYARLKRCILIGDHHQLPPVVKNMAFQKYSHMDQSLFTRFVRLGIPYIELNAQGRARPSLARLYNWRYRELGDLPYVKENAVFHKANAGFSYDYQLVDVPDYNGRGESAPSPWFYQNEGEAEYIVSVYMYMRLLGYPANKISILTTYNGQKLLIRDVINRRCVPYDFIGPPHKVATVDKFQGQQNDFILLSLVRTRFVGHLRDVRRLIVAMSRARLGLYVFCRRSLFEQCYELQPTFRLLLERPDCLALNVEEATSLTNRPVGETGPVSVVSGPEEMQAIVNFKMHQVYQARMMSHIEYPAHPESVPEPSVEQNVMSLSHSMDSDKTAMEDGTKDTGPSESMESTKVPPDAGEMLVVGHSNGEVDGENQRVDSGELGTSTGSIEAPHDDAEMLVASQSNGEADGKDQRVDRDGTDLENSSNVESKMEE

SEQ ID NO: 3012 - protein, 859 aa, Cucumis sativus
VTADVTFSISSYRAQIRSEWNALKEHDVLFLLSISPSFEPLSSEEAAKASVPQRLGLQCVRGCEIIEIRDEEGSLMNDFTGRIKPDEWKPPKGELRTVTVALDTAQYHMDVSAIAEKGTEDVYGTFNVLMRRKPKENNFKAILESIRDLMNEYCIVPDWLHNILLGYGNPSAAQWTNMPDLLEAVDFKDTFLDADHLKECFPDYQVCFTNPDGEEVLHPSPPFRIRIPRVLKGSNHALPENMKSSSVSKNDENTMDACTEKEKLIVEVYTPPDPGPYPQDQPKQNSVRFTPTQVGAIISGVQPGLTMVVGPPGTGKTDTAVQVLNVLYHSCPSQRTLIITHSNQALNDLFEKIMERDVPARYLLRLGQGEQELATDLDFSRQGRVNSMLVRRLELLSEVERLARSLQLPEDVGYTCETAGYFWLLHVYSRWEQFIAACAGNEDKSNFVQERFPFKEFFSNAPNPVFTGESFDKDMRAAKGCFRHLKIMFQELEECRAFELLKSTADRANYLMTKQAKIVAMTCTHAALKRKDFLRLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRELGDLPYVKEASIFHRANAGFSYDYQLVDVPDYQGRGETAPSPWFYQNEGEAEYIVSVYIYMRLLGYPANKISILTTYNGQKLLIRDVINRRCVPYNFIGAPSKVTTVDKFQGQQNDYILLSLVRTRFVGHLRDVRRLIVAMSRARLGLYVFCRRSLFEQCYELQPTFQLLLQRPDHLGLNLNEITSYTERNVADTGPIYHVSGTEEMASILEQLYQVLSDFS

SEQ ID NO: 3013 - protein, 486 aa, Citrus sinensis
  misc_feature (331)..(331): Xaa can be any naturally occurring amino acid
MRAAKGCFRHLQTLFQELEECRAFELLKSTADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAQLYNWRYRDLGDLPFVKEEPFFHRANAGFSYDYQLVDVPDYNGRGESAPSPWFYQNEGEAEYVVSVYIYMRLLGYPANKISILTTYNGQKLLIRDVINRQCVPYPFIGPPSKVTTVDKFQGQQNDFILLSLVRTRFVGHLRDVRRLVVAMSRARLGLYVFCRRSLFEQCYELQPTFXLLLQRPDKLALTMNEKTSYTDRHVEDIGVPYLVSGIEDMHAIVNSLLYQRHLAIQSQYVAYSGTTDAYAMEQISHQNSILEHNAMDTDMPAVANGSLGDTSHGSQSEEATEMNGPANGEIPLEGQLNGESGSEPPTDDKNGTPPESDSNEATKME

SEQ ID NO: 3014 - protein, 325 aa, Setaria italica
TGESFEKDMHAAKGCFKHLSTIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGIPYIELNAQGRARPSIAKLYNWRYRELGDLPYVREQAIFHKANAGFSFEYQLVDVPDYKGKGESAPSPWFYQNEGEAEYIVNIYIYMRLIGYPANKISILTTYNGQKLLIRDVINKRCKPWNIEPPNKVTTVDKFQGQQNDFILLSLVRTRFVGHLRDVRRLIVAMSRARLGLYVFCRRS

SEQ ID NO: 3015 - protein, 1350 aa, Mimulus guttatus
MTKIYGTGMYDFRRHRVAEYPVAADGLPLPEKPPESKPGSDVPSSMTLIEIQRDRLTKIAAENWAKTADSGPKKPFSPDLVNEIYYTELTVKAGRKPVPLQRVMILEVSQYLENYLWPNFSPETASFEHVMSMILMVNEKFRENVAAWICFYDKKDMFKAFLERVLRLKEGRSLTIAEKTNYLLFMINAFQSLEDEIVSEMIMRLASLECWHSLSYGRFQMELCLNKNLIRRWRRIAMRAKDATKRGETFDPTTIVEANFLRNLIEEFLVVLDSEVFCKHEDDDLVDVHGSEDVNDSCLLYCERFMEFLIDLLSQLPTRRLVRPLVADVAVISKCHLSALYRHEKGKLFAQLVDLLQYYEGFEIDDHKGVQMDDDDVLRAHYKRLQAFQLLAFRKIPKLRELALANVGSINKRADLAKKLSVLSPEELRDLVCVKLKLVSKDDPWSERVDFLIEVTVSFFEKQQSQKEAINALPLYPNEQIMWDESLVPSINYSGEGCLALPKLNLQFLTLHDYLLRNFNLFRLESTYEIREDIQEAVPHLLAYVNNEGETAFRGWSRMAVPIKEFRITEVKQPNIGEVKPSVVTAKVTFSISSYKAQIRSEWNALKEHDVLFLLSIRPSFEPLSSEEASNATVPQKLGLQYVRGCEIVEVRDEDGTLMNDFTGRIKRDEWKPPKGDLRTVTIALDTAQYHMDVSDIAETGADDVYGTFNILMRRKPKENNFKAILESIRDLMNETCIVPKWLHDILLGYGDPSAAQWTNMPDLIKKVDFKDTFLDAAHVIESFPNYKVRFINSDGTDNSNPCPPFRIKFPENLESMVHALPGNVISTQTSNDASSMQDDHSDKVELVVEAYVPPDPGPYPQDQPKQNSVRFTPTQVGVILSGVQPGLTMVVGPPGTGKTDTAVQILNVLYHNCPSQRTLIITHSNQALNDLFEKIMERDVPARYLLRLGQGEQELATELDFSRQGRVNAMLVRRLELLSEVERLARSLQLPEDVGYTCETAGYFWLLHVYSRWELFLAACAQNQDKPTFIQDRFPFKEFFSNTAKPIFAAESFEKDMHTAKGCFRHLQTMFQELEECRAFELLKSTVDRSNYLMTKQAKIVAMTCTHAALKRKDFLHLGFKYDNLLMEESAQILEIETFIPMLLQRQEDDRARLKRCILIGDHHQLPPVVKNMAFQKYSHMDQSLFTRFVRLGIPYIELNAQGRARPSLARLYNWRYKDLGDLSYVKENEIFQRANSGFSYDYQLVDVPDFHGRGESAPSPWFYQNEGEAEYIVSVYMYMRLLGYPASKISILTTYNGQKLLIRDVINRRCVPYDFIGPPHKLTSFKGNKMTSSCYPSFVLALWVTFVT

SEQ ID NO: 3016 - protein, 1089 aa, Mimulus guttatus
LRELALANVGSINKRADLAKKLSVLSPEELRDLVCVKLKLVSKDDPWSERVDFLIEVTVSFFEKQQSQKEAINALPLYPNEQIMWDESLVPSINYSGEGCLALPKLNLQFLTLHDYLLRNFNLFRLESTYEIREDIQEAVPHLLAYVNNEGETAFRGWSRMAVPIKEFRITEVKQPNIGEVKPSVVTAKVTFSISSYKAQIRSEWNALKEHDVLFLLSIRPSFEPLSSEEASNATVPQKLGLQYVRGCEIVEVRDEDGTLMNDFTGRIKRDEWKPPKGDLRTVTIALDTAQYHMDVSDIAETGADDVYGTFNILMRRKPKENNFKAILESIRDLMNETCIVPKWLHDILLGYGDPSAAQWTNMPDLIKKVDFKDTFLDAAHVIESFPNYKVRFINSDGTDNSNPCPPFRIKFPENLESMVHALPGNVISTQTSNDASSTDKVELVVEAYVPPDPGPYPQDQPKQNSVRFTPTQVGVILSGVQPGLTMVVGPPGTGKTDTAVQILNVLYHNCPSQRTLIITHSNQALNDLFEKIMERDVPARYLLRLGQGEQELATELDFSRQGRVNAMLVRRLELLSEVERLARSLQLPEDVGYTCETAGYFWLLHVYSRWELFLAACAQNQDKPTFIQDRFPFKEFFSNTAKPIFAAESFEKDMHTAKGCFRHLQTMFQELEECRAFELLKSTVDRSNYLMTKQAKIVAMTCTHAALKRKDFLHLGFKYDNLLMEESAQILEIETFIPMLLQRQEDDRARLKRCILIGDHHQLPPVVKNMAFQKYSHMDQSLFTRFVRLGIPYIELNAQGRARPSLARLYNWRYKDLGDLSYVKENEIFQRANSGFSYDYQLVDVPDFHGRGESAPSPWFYQNEGEAEYIVSVYMYMRLLGYPASKISILTTYNGQKLLIRDVINRRCVPYDFIGPPHKVATVDKFQGQQNDFILLSLVRSRFVGHLRDVRRLVVAMSRARLGLYVFCRRSLFEQCYELQPTFQLLLQRPDHLSLNLNEFTTFTDRHVEDTGPVQLVSGIEEMANIVNYKMHQVYQLELFVIFIYMVSGDLIFSFSPVATYIPNYILKVSLFTLNGPICIYPSLDVQL

SEQ ID NO: 3017 - protein, 530 aa, Aristolochia fimbriata
LTLQSHVFLLVESFEKDMRAAKGCFRHLKTMFQELEECRAFELLKSQADRANYLMTKQAKIVAMTCTHAALKRKDFLQLGFKYDNLLMEESAQILEIETFIPMLLQRQEDGYARLKRCILIGDHHQLPPVVKNMAFQKYSHMDQSLFTRFVRLGIPYIELNAQGRARPSIAKLYNWRYRDLGDLPYVCEQPLFHRANAGFSFDYQLVDVPDYHGRGETAPSPWFYQNEGEAEYIVSVYIYMKLLGYSGSKISILTTYNGQKLLIRDVVNRRCTTCGIEPPHKITTVDKYQGQQNDFILLSLVRTRFVGHLRDVRRLVVAMSRARLGLYIFCRRSLFEQCYELQPTFQLLLQRPDRLALNLDEMISSTERLVGDPGKIYLIGGIQEMENLINSRIYHQLYQAQFYHYSQHMPNEAVPNAEDAQEQNGHEQMPTKPPQNDVDMPLLNDENEQLPAKSPPNDVDIPLLNGENEQLPAISPQNDVDMPTITGENEQSPAKPAKDNVDDGPAVSGEDALLLSEEKSEENTQKTVE

SEQ ID NO: 3018 - protein, 241 aa, Aquilegia formosa
DTPQPVFTGQSFEKDMRSAKGCFRHLKIMFQELEECRAFELLKTTADRANYLMTKQAKIVAMTCTHAALKRKDFLHLGFKYDNLLMEESAQILEIETFIPMLLQRQEDGYARLKRCILIGDHHQLPPVVKNIAFQKYSHMDQSLFTRFIRLGIPYIELNAQGRARPDIAKLYNWRYRDLGDLPYVREQAIFHRANPGFCYEYQLVDVPDYRGRGEISPSSYFSKMKERQNISSVSICTCVC

SEQ ID NO: 3019 - protein, 333 aa, Triticum aestivum
MASVGGDAKKSLTQWLGEKGFDEEAIRRMSKRCRNLPNLDAGEASGVWDYLLNDVKIEHRKLRYVVTKCPKVLTMSVNDKLIPTVQCLTTLQAKPGEIAQAIVKFPPILFHSVEEKLCPLLAFFQTLAISEKQLAKLLMVNPRLISYSIQAKFSQTVDFLVGLGIDREVMIGKILTKEPYIMGYSIDKRLRPTAEFLKSAVGLQGSYLQRVIMNFPSILSRDVDKTLRPNLVFLQSAGFSKDQIMKLVAGYPPVLIKSIKHCLEPRVKFLVEEMGRDKGEVVDYPQFFHHGLKRSLEYRHKILKQMNSRCSLSEMLDCNQKKFAMKFGLIPVA

SEQ ID NO: 3020 - protein, 364 aa, Triticum aestivum
LSYPPLPRSHFTSPSSSTSRLDLDRQEISPAMASVGGDAKKSLTQWLREKGFDEEAIGRMSKRCRNLPNLDAGEASGVWDYLLNDVKIEQRKLRYVVTKCPKVLTMSVNDKLVPTVQCLTTLQAKPGEIAQAIVKFPPILFHSVEEKLCPLLAFFQTLAISEKQLAKLLMVNPRLISYSIQAKFSQTVDFLVGLGINREVMIGKILTKEPYIMGYSIDKRLRPTAEFLKSAVGLQGSYLQRVIMNFPSILSRDVDKTLRPNLVFLQSAGFSKDQIMKLVAGYPPVLIKSIKHCLEPRVKFLVEEMGRDKGEVVDYPQFFHHGLKRSLEYRHKILKQMNSRCSLSEMLDCNQKKFAMKFGLIPVA

SEQ ID NO: 3021 - protein, 334 aa, Brachypodium distachyon
MAGVGSGDAKSLTQWLREKGFDEETIGRMSRRCRNLPKLDAGEASAVWDYLLYDVNIERRKLRHLVTKCPKVLTVSVGDKLVPTVQCLNTLQAKPGEVAQAIVKFPPILFHSVEEKLCPLLAFFETLAISEKQLAKLLMVNPRLISYSIEAKFSQTIDFFVGLGIDKEGMIGKILAKEPYIMGYSVDKRLRPTAEFLKSAVGLQGSNLQRVIMNFPGILSRDVDKTLQPNLEFLQSSGFSKDQIMELVAGYPPVLIKSIKHCLEPRVKFLVEEMGRDKGEVVDYPQFFRHGLKRSLEYRHKILKKMNSRCSLSEMLDCNQKKFAMKFGLVAAAV

SEQ ID NO: 3022 - protein, 295 aa, Pseudoroegneria spicata
LDAGEASGVWDYLLNDVKIEQRKLRYVVTKCPKVLTMSVNEKLIPTVQCLTTLQAKPGEIAQAIVKFPPILFHSVEEKLCPLLAFFQTLAISEKQLAKLLMVNPRLISYSIQAKFSQTIDFLVGLGIDREVMIGKILTKEPYIMGYSIDKRLRPTAEFLRSAVGLQGSYLQRVIMNFPSILSRDVDKTLRPNFVFLQSAGFSKDQIMKLVAGYPPVLIKSIKHCLEPRVKFLVEEMGRDKGEVVDYPQFFHHGLKRSLEYRHKILKQMNSRCSLSEMLDCNQKKFAMKFGLIPVA

SEQ ID NO: 3023 - protein, 333 aa, Oryza sativa
MASGGSSNAGSLTQWLREKGFDEEAIGRMSRRCKNLHGLDAGEASGVWDYLLNVVKIERRKLRYVVTKCPKVLTLSVDDKLVPTVQCLTTLQAKPGEVAQAIVKFPQILFHSVEEKLCPLLAFFQTLGISEKQLAKLLMVNPRLISYSIEAKFSQTVNFLVGLGIDKEGMIGKIMAKEPYIMGYSVDKRLRPTAEFLKSAVGLEGSNLQRVIMSFPDILSRDVDKILRPNLAFLQSCGFSKDQVMALVAGYPPVLIKSVKHCLEPRMKFLVEEMGRDMGEVVDYPQFFRHGLKRSLEYRHKVLKQMNSRCSLSEMLDCNQKKFAMKFGLLAAV

SEQ ID NO: 3024 - protein, 538 aa, Oryza sativa
MEDAASEVFMETTICCAETPRASHSSSYLQQCHSRSVVSTHGNVLDISPRLSYHKPTTNKDKMLRRRYSLNLPEHLPEHHVITSAEQSEKTISKSIADLVWEIAALEEEVVRKELHLLSLYRAAFDQHLGVSPRVSTQVDQEIHHQKSRKKADEGALRLRNIKESASYNLPTVSTVSDSKHGLSRSSSGHSSLANFLSASIAEYVPKISCKLSEDIVRCISAVYCKLASQPSQNLADFETLSTPSFSSSSSTFSLKHRVDSWSPRCHYNVNTSSDKYDSLNEKSEQYNGMIICPRIYMDAEKFEYASKMLETVRSLIKRLEKIDPTKMAHEEQLCFWINIHNALVMHAFMAYGLQEKRMKNTDMILKAAYNVGGLSVNAQIIQNSIIGCQSHRTSVWVRTLFTPLKKSASGSSIHPYALHPPEPLAHFALSTGAISDPPVRLYTAKKVNHQLDQARTEFIQASVIVRKQTIFLPKVLHHYAKDAALELPDLVEMACEIMPEAQQKEIRQCLRRRIDKCVEWIPFKSSFRYTIHRSLAE

SEQ ID NO: 3025 - protein, 380 aa, Triticum aestivum
LLAHSLQSRLRQGFLILSYPPLPRSHFTSPSSSASRLDLDPQEISPAMASVGGDAKKSLTQWLGEKGFDEEAIRRMSKRCRNLPNLDAGEASGVWDYLLNDVKIEHRKLRYVVTKCPKVLTMSVNDKLIPTVQCLTTLQAKPGEIAQAIIKFPPILFHSVEEKLCPLLAFFQTLAISEKQLAKLLMVNPRLISYSIQAKFSQTVDFLVGLGIDREVMIGKILTKEPYIMGYSIDKRLRPTAEFLKSAVGLQGSYLQRVIMNFPSILSRDVDKTLRPNLVFLQSTGFSKDQIMKLVAGYPPVLIKSIKHCLEPRVKFLVEEMGRDKGEVVDYPQFFHHGLKRSLEYRHKILKQMNSRCSLSEMLDCNQKKFAMKFGLIPVA

SEQ ID NO: 3026 - protein, 332 aa, Panicum virgatum
  misc_feature (12)..(12): Xaa can be any naturally occurring amino acid
  misc_feature (282)..(282): Xaa can be any naturally occurring amino acid
MASSVRGSKSLXQWLRENGFDEETVARMSRRCKNLHSLDAGEASGVWDYLLTSVKIERRRLRHVVAKCPKVLTLPVDGKLVPTVQCLATLQAKPGEVAQAIAKFPQILFHSVEEKLCPLLAFFQTLGVSEKQLAKLLMVNPRLISYSIEAKFSQMVDFLVGLGIDKEGMIGKILTKEPYIMGYSVDKRLRPTAEFLKSGVGLQGSDLKRVIMSFPDILSRDVDKILRPNLAFLQSCGFSKSQVMALVAGYPPVLIKSVKHCLEPRIKFLVDEMGRDMGEVVXYPQFFRHGLKRSLEYRHKVLKQNKSSCSLSEMLDCNQKKFAMKFGLVAAV

SEQ ID NO: 3027 - protein, 131 aa, Secale cereale
MKASCFLVVLLLAVATGSRLSLAAREGGTLGELIAKAGSFLTSAGRAGADGWHSAAAAEVDASAKKAHGHPAGAKKRLKKSSVNCIPADMCRRKKVLCGKRCYKTSHAAAGLSHVPSSRCVVRCKKCVPTC

SEQ ID NO: 3028 - protein, 133 aa, Triticum aestivum
MKASCFLVVLLLAVATGSRLSLAAREGSTLGELIAKAGSFLTSAGRAGADGWRSAAAAEVDASAKKGHGHPAGAKKRLKKSSVNCIPADMCRRKKVLCGKRCYKTSHAAAAAGLSHVPPTRCVVRCKKCVPTC

SEQ ID NO: 3029 - protein, 136 aa, Triticum aestivum
MKASCFLVVLLLAVATGSRLSLAAREGSTLGGELGELIAKAGSFLTSAGRAGADGWHSAAAAEVDASAKKGHGHPAGPRKRLKKSSVNCIPADMCRRKKVLCGKRCYKTSHAAGAGLDHVPSNRCVVRCKKCVPTC

SEQ ID NO: 3030 - protein, 136 aa, Triticum aestivum
MKASCFLVVLLLAIATESRLSLAAREGSTLGGELGELIAKAGSFLTSAGRAGADGWHSAAAAEVDASAKKGHGHPAGPRKRLKKSSVNCIPADMCRRKKVLCGKRCYKTSHAAGAGLDHVPSNRCVVRCKKCVPTC

SEQ ID NO: 3031 - protein, 455 aa, Leymus cinereus x Leymus triticoides
  misc_feature (357)..(357): Xaa can be any naturally occurring amino acid
MAHGLGILLLLLASSFAGSAFADATALGRKAGAGAIAEEPELKAAPGKYAVIFDAGSTGTRVHVFRFDKKMELVDVGDDIEVFAKVEPGLSSYAGRPQEAAKSIVPLLEKAKSAVPRWLMKKTPVKLGATAGLRLIGDDKAEQILEAVRDAVHSKSKFQYNPSWINVLKGSQEGSYLWVALNYLLGKLGGDYSKTVAVIDLGGGSVQMAYAISADAAAVAPVVPQGEDPYVTKEYIKGRDYNVYVHSYLHYGAMASRVEIFKAKNGPVSYCLLRGFNGKYTYNGEQYDAIAPLQGAAYDKCREDVTRALKLGAPCEAKNCTFNGAWNGGGGPGQAELYVTSSFYYMAADVGLIDSEXSSGKTTPAAFRTAAEKICPMSFVEAKAAYPKVRSVDAPYICMDLIYQYSLLVDGFGLETTKEITVAQKVKHGEYFIEAAWPLGEAIEAVSPTKRLNDA

SEQ ID NO: 3032 - protein, 462 aa, Triticum aestivum
MAHHASGVLLFLLMAFSFAGSTFAADAAVLGRKAGIGAVAEEEPELKKAAPGKYAVIFDAGSTGTRVHVFRFDKKMELIDIGDGDDIEVFAKVEPGLSAYAGRPQEAAKSIVPLLEKAKSTVPRWLMKKTPVKLGATAGLRLIGDEKAEQILEAVRDAVHSKSKFQYNPSWINVLTGSQEGSYLWVALNYLLGNLGGDYSKTVGVIDLGGGSVQMAYAISADAAAAAPVVPQGDDPYVTKEYLKGRDYNVYVHSYLHYGAMASRVEIFKAKNGPVSYCMLRGYNGKYTYNGEQYDAVAPPQGAAYDKCREDVTKALKISAPCQAKNCTFNGAWNGGGGPGQADLYVTSSFYYMAADVGLIDSEATSGKTTPAAFRAAAEKICPMGFVEAKAAYPKVRSVDAPFICMDLIYQYSLLVDGFGLEPTKEITVAQKVKHGEYFIEAAWALGEAIEAVSPTKRLNDA

SEQ ID NO: 3033 - protein, 461 aa, Triticum aestivum
MARHASGLLLLLLVALSFAGSAFAADVAVLGRKAGIGAVAEEEPELKKAAGKYAVIFDAGSTGTRVHVFRFDKKMELIDIGDGDDIEVFAKVEPGLSAYAGRPQEAAKSIVPLLEKAKSTVPRSLMKKTPVKLGATAGLRLIGDEKAEQILEAVRDAVHSQSKFQYNPSWINVLKGSQEGSYLWVALNYLLGNLGGDYSKTVGVIDLGGGSVQMAYAISADAAATAPGVPQGDDPYVTKEYLKGRDYNVYVHSYLHYGAMASRVEIFKAKNGPVSYCMLRGYNGKYTYNGEQYDAIAPPQGAAYDKCREDVTKALKINAPCQAKNCTFNGAWNGGGGPGQADLYVTSSFYYMAADVGLIDSEATSGKTTPAAFRAAAEKICPMGFMEAKATYPKVRSVDTPYICMDLVYQYSLLVDGFGLEPTKEITVAQKVKHGEYFIEAAWALGEAIEAVSPTKRLNDA

SEQ ID NO: 3034 - protein, 463 aa, Triticum aestivum
MAQAHHASSVLLLLLVAFSFAGSAFAADVAVLGRKAGIGAVAEEGPELKAAPGKYAVIFDAGSTGTRVHVFRFDKKMELIDIGDGDDIEVFAKVEPGLSAYAGRPQEAAKSIVPLLEKAKSTVPRWLMKKTPVKLGATAGLRLIGDEKAEQILEAVRDAVHSQSKFQYNPSWINVLKGSQEGSYLWVALNYLLGNLGGDYSKTVGVIDLGGGSVQMAYAISADAAAAAPGVPQGDDPYVTKEYLKGRDYNVYVHSYLHYGAMASRVEIFKAKNGPVSYCMLRGYNGKYTYNGEQYDAIAPPQGAAYDKCREDVTRALKISAPCQAKNCTFNGAWNGGGGPGQADLYVTSSFYYMASDVGLIDSEATSGKTTPAAFRAAAEKICPMGFVEAKAAYPKVRSADAPYICMDLIYQYSLLADGFGLEPTKEITVAQKVKHGEYFIEAAWALGEAIEAVSPTKRLNDA

SEQ ID NO: 3035 - protein, 619 aa, Avena sativa
LPVSRRAPPPSAAHVPARRGASSSTACRCTTAPASASVSVSASAAASPSTWDWSRWSRHFAEVDQAESYASVLSFQLEEAVESEDFAEAASLKRAILEASADDAVAHVMAELKSAIEEQRYQDASRLTKLAGTSLVGWWVGYAKDTDDSIGRIVRISPGVGRYVAKSYSPRQLVTASSGSPLFEIFLVRDEDETYTMKVVHLRPTKGTSSASPISSTATEGPVKVESGSSLESSALSEGITEEANTDTTLKGTEDVEEKVQDVGRTKESGVEGLKSVLNFFKSRIPEFKVQVINVDVPEETDLVTDSSEELVQDDVKSTSESSLEEPSTEEFQEEDVSDGDSDSNDDSKSPEVKLFISGVVHNKEDAGAKSYVRVPAEINNLERDSFELYIPGKGSDRDLAETKAAKQKVADMAAKLASELMPSDVAKALWGTTKSSSKINKEVQELLKLTLSKARVKLTENTIFNRITTDSNGADPFNGLYVGAFSPYGPEVVQLRRKFGHWNSTDEVGFFEYVEAVKLTGDLSVPAGQITFRAKVGKGTRLENRGAYPEEFGVTASYKGQGRIAQPGFKNPRWVDGELLVLNGKSAIPHLGGAELGFLYSVPEQSFLVLFDRLTLPE

SEQ ID NO: 3036 - protein, 632 aa, Brachypodium distachyon
MPASCATPAAALPVSRRAPPPPPPQFAAHVPAARRGSSSATACRCTTASASASAAAAAPPSAWDWPRWTRHFAEVDQAESYASVLAFRLEEAVEGEDFAEAAALKRAIRDATAHDAVAHVMAQLKSAIEEQRYQDASRLTKLAGTSLVGWWVGYAKDTDDSIGRIVRISPGVGRYVAKSYSPRQLVTASSGSPLFEIFLVRDEDETYTMKVVHLRPTKGTSSASPLSTTTTEGRVKVENDTSSESSAPSDGVKEEANTDSQLKGNEDTEEKTQDVGNTKESSVEGLKSVLNFFKSRIPEFKVQVINVDVPDETELVSDSPEELVQDDVKSTSENSLEEPGTEEFEEEDVSDGESDSNEDSKSPGVKLFISGVVHNKEDMAGAKSYVRVPAEISNLEKDSFELYIPGKGSDRDLTETKAAKQKVADMAAKLASELMPSDVAKALWGTTKSSSKINKEVQELLKLTLSKARVKLTENTIFNRIITDSNGSDPFNGLYVGAFSPYGPEVVQLRRKFGHWNSTDEVEFFEYVEAVKLTGDLSVPAGQITFRAKVGKGSRLENRGAYPEEFGVTASYKGQGRIAQPGFKNPRWVDGELLVLNGKSTIPHLGGAELGFLYSVPEQSFLVLFDRLTLPE

SEQ ID NO: 3037 - protein, 627 aa, Oryza sativa
MSAATACASPAAARPPLHIPLRSPPSAAHLPSAAASRRASSAACRCTASASASASPSTWDWTRWTRHFADVDQAESYASLLKFQLEEAVDNEDFAEASKLKKAILEATGNDAVAQVMSELKTAIEEQRYQDASRLTKLARTNLVGWWVGYAKDTDDSIGRIVRISPGVGRYVAKSFSPRQLVTASSGTPLFEIFLVRDDDETYTMKVVHMRPTKGTSSASSVSSATAESPAKEENESSLESSAISEGITDEANTDTTLKGDEDVEDKEQDVGNAKDSSVEGLKSVLNFFKSRIPEFKVQVINVDVSEEAELASDSSEELVQDDVKSTSENSLEDSTTEELQQDDVPDGDSDSAEDSKSPEMKLFISGVVHNKEDAGAKSYVRVPAEINNLEKDSFELYIPGKGSDRDLADTKAAKQKVADMAAKLASELMPSDVAKALWGTTKSSSKINKEVQELLKLTLSKARVKLTENTIFNRIITDSNGSDPFSGLYVGAFSPYGPEVVQLRRKFGHWNSTDEVEFFEYVEAVKLTGDLSVPAGQITFRAKIGKGKRLENRGAYPEEFGVIASYKGQGRIAQPGFKNPRWVDGELLVLNGKSTIPHLGGAELGFLYSVPEQSFLVLFDRLKLPE

SEQ ID NO: 3038 - protein, 958 aa, Triticum aestivum
MAEKEAGNLEAVLKEVVDLENIPLEEVFDNLRCSREGLTAEQARQRLQIFGANKLEEKEESKVLKFLGFMWNPLSWVMEAAAIMAIALANGGNKPPDWQDFIGIITLLVINSTISFIEENNAGNAAAALMARLTPKAKILRDGRWTEEDAAILVPGDVISIKLGDIIPADARLLEGDPLKIDQSALTGESLPATKGPGDGVYSGSTVKQGEIEAVVIATGVHTFFGKAAHLVDSTNQVGHFQKVLTAIGNFCICSIGVGMFIKIIVMYPIQHRGYRPGIDNLLVLLIGGIPIAMPTVLSVTMAIGSHRLSQQGAITKRMTAIEEMAGMDVLCSDKTGTLTLNKLTVDKNLVEVFERGITQDQVILMAARASRTENQDAIDTAIVGMLADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKETGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVILGGYLAIMTVIFFWAAYKTNFFPRLFHVESLEKTAQDDFQKLAAAIYLQVSTISQALIFVTRSRSWSFAERPGFLLVFAFFVAQLIATLIAVYADWRFTQIKGIGWGWAGVVWLYNIITYLPLDIIKFLIRYTLSGKAWDLVIDQRIAFTRKKDFGKEERELKWAHAQRTLHGLQPPDAKMFSEKGGYNELNHMAEEAKRRAEIARLRELHTLKGHVESVVKLKGLDIETIQQSYTV

SEQ ID NO: 3039 - protein, 958 aa, Triticum aestivum
  misc_feature (44)..(44): Xaa can be any naturally occurring amino acid
  misc_feature (525)..(525): Xaa can be any naturally occurring amino acid
MAEKEAGNLEAVLKEVVDLENIPLEEVFDNLRCSREGLTAEQAXQRLQIFGANKLEEKEESKVLKFLGFMWNPLSWVMEAAAIMAIALANGGNKPPDWQDFIGIITLLVINSTISFIEENNAGNAAAALMARLTPKAKILRDGRWTEEDAAILVPGDVISIKLGDIIPADARLLEGDPLKIDQSALTGESLPATKGPGDGVYSGSTVKQGEIEAVVIATGVHTFFGKAAHLVDSTNQVGHFQKVLTAIGNFCICSIGVGMFIEIIVMYPIQHRGYRPGIDNLLVLLIGGIPIAMPTVLSVTMAIGSHRLSQQGAITKRMTAIEEMAGMDVLCSDKTGTLTLNKLTVDKNLVEVFERGITQDQVILMAARASRTENQDAIDTAIVGMLADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKXTGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVILGGYLAIMTVIFFWAAYKTNFFPRLFHVESLEKTAQDDFQKLAAAIYLQVSTISQALIFVTRSRSWSFAERPGFLLVFAFFVAQLIATLIAVYADWRFTQIKGIGWGWAGVVWLYNIITYLPLDIIKFLIRYTLSGKAWDLVIDQRIAFTRKKDFGKEERELKWAHAQRTLHGLQPPDAKMFSEKGGYNELNHMAEEAKRRAEIARLRELHTLKGHVESVVKLKGLDIETIQQSYTV

SEQ ID NO: 3040 - protein, 959 aa, Brachypodium distachyon
MAEAEKDAGNLEAVLKESVDLENIPLEEVFENLRCSRQGLSAQQAQQRLEIFGPNKLEEEEESKFLKFLGFMWNPLSWVMEAAAIMAIALANGGGKPPDWQDFVGIITLLVINSTISFIEENNAGNAAAALMARLAPKAKILRDGRWTEEDAAILVPGDVVSIKLGDIIPADARLLEGDPLKIDQSALTGESLPATKGPGDGVYSGSTVKQGEIEAVVIATGVHTFFGKAAHLVDSTNQVGHFQQVLTAIGNFCICSIAVGMFIEIIVMYPIQHRAYRPGIDNLLVLLIGGIPIAMPTVLSVTMAIGSHRLSQQGAITKRMTAIEEMAGMDVLCSDKTGTLTLNKLTVDKNLVEVFERGITQDQVILMAARASRTENQDAIDTAIVGMLADPKEARAGIQEVHFLPFNPTDKRTALTYTDGDGKMHRVSKGAPEQILHLAHNTSEIERRVHSVIDKFAERGLRSLAVAYQEVPDGKKESPGGPWHFAGLMPLFDPPRHDSAETIRRALNLGVNVKMITGDQLAIGKETGRRLGMGTNMYPSSALLGQNTDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAIMTVIFFWVAYKTNFFPRLFHVESLEKTAQDDFQKLASAIYLQVSTISQALIFVTRSRSWSFVERPGFLLVFAFFVAQLIATLIAVYADWAFTSIKGIGWGWAGIVWLYNIITYFPLDIIKFLIRYTLSGKAWDLVIDQRIAFTRKKDFGKEERELKWAHAQRTLHGLQPPDAKMFSEKAGYNELNHMAEEAKRRAEIARLRELHTLKGHVESVVKLKGLDIETIQQSYTV

SEQ ID NO: 3041 - protein, 956 aa, Sorghum bicolor
MAEKEGNLEAVLKEAVDLENIPLEEVFENLRCSREGLSTQQAQQRLEIFGPNKLEEKEESKFLKFLGFMWNPLSWVMEAAAIMAIALANGGGKPPDWQDFVGIITLLVINSTISFIEENNAGNAAAALMARLAPKAKVLRDGRWTEEDAAILVPGDIVSIKLGDIIPADARLLEGDPLKIDQSALTGESLPVTKGPGDGVYSGSTVKQGEIEAVVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLTVDKNLVDVFERGITQDQVILMAARASRTENQDAIDTAIVGMLADPKEARAGIQEVHFLPFNPTDKRTALTYIDGDGKMYRVSKGAPEQILHLAHNKSEIERRVHAVIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTNFFPKIFHVESLEKTAQDDFQKLASAVYLQVSTISQALIFVTRSRSWSFVERPGFLLVFAFLVAQLIATLIAVYADWAFTSIKGIGWGWAGIVWLYNIIFYFPLDIIKFLIRYALSGKAWDLVIEQRIAFTRKKDFGREERELKWAHAQRTLHGLQAPDAKMFPEKAGYNELNQMAEEAKRRAEIARLRELHTLKGHVESVVKLKGLDIETIQQSYTV

SEQ ID NO: 3042 - protein, 956 aa, Oryza sativa
MAEKEGNLDAVLKEAVDLENIPLEEVFENLRCSREGLTTQQAQQRLEIFGPNKLEEKEESKFLKFLGFMWNPLSWVMEAAAIMAIALANGGGKPPDWQDFVGIITLLVINSTISFIEENNAGNAAAALMARLAPKAKVLRDGRWTEEEAAILVPGDIVSIKLGDIIPADARLLEGDPLKIDQSALTGESLPVTKGPGDGVYSGSTVKQGEIEAIVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLTVDKNLIDVFERGITQDQVILMAARASRTENQDAIDTAIVGMLADPKEARAGIQEVHFLPFNPTDKRTALTYIDGDGKMYRVSKGAPEQILHLAHNKPEIERRVHAVIDKFAERGLRSLAVAYQEVPEGTKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYKTDFFPRIFHVESLEKTAQDDFQKLASAVYLQVSTISQALIFVTRSRSWSFVERPGFLLVFAFLVAQLIATLIAVYADWAFTSIKGIGWGWAGIVWLYNLIFYFPLDIIKFLIRYALSGKAWDLVIEQRIAFTRKKDFGKEERELKWAHAQRTLHGLQPPDAKMFSEKAGYNELNQMAEEAKRRAEIARLRELHTLKGHVESVVKLKGLDIETIQQSYTV

SEQ ID NO: 3043 - protein, 956 aa, Zea mays
MAEKEGNLEAVLKEAVDLENIPLEEVFENLRCSREGLSTEQAQQRLEIFGPNKLEEKEESKFLKFLGFMWNPLSWVMEAAAIMAIALANGGGKPPDWQDFVGIITLLVINSTISFIEENNAGNAAAALMARLAPKAKVLRDGRWTEEDAAILVPGDIVSIKLGDIIPADARLLEGDPLKIDQSALTGESLPVTKGPGDGVYSGSTVKQGEIEAVVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLTVDRNLVEVFERGTTQDQVILMAARASRTENQDAIDTAIVGMLADPKEARAGIQEVHFLPFNPTDKRTALTYIDGDGKMYRVSKGAPEQILHLAHNKSDIERRVHAMIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTNFFPKIFHVESLEKTAQDDFQKLASAVYLQVSTISQALIFVTRSRSWSFVERPGFLLVFAFLVAQLIATLIAVYADWAFTSIKGIGWGWAGIVWLYNIIFYFPLDIIKFLIRYALSGKAWDLVIEQRIAFTRKKDFGREERELKWAHAQRTLHGLQAPDAKMFPEKAGYNELNQMAEEAKRRAEIARLRELHTLKGHVESVVKLKGLDIETIQQSYTV

SEQ ID NO: 3044 - protein, 956 aa, Brachypodium distachyon
MADKEGNLDAVLKEVVDLENIPVDEVFENLRCGREGLTSQQAQQRLQIFGPNKLEEKEESKFLKFLGFMWNPLSWVMEAAAIMAIALANGGGKPPDWQDFVGIITLLLINSTISFIEENNAGNAAAALMARLAPKAKVLRDGRWTEEEAAVLVPGDIISIKLGDIIPADARLLDGDPLKIDQSALTGESLPATKGPGDGVYSGSTVKQGEIKAVVIATGVHTFFGKAAHLVDSTNQVGHFQQVLTAIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLSVDKNLIEVFERGVTQDQVILMAARASRIENQDAIDTAIVGMLADPKEARAGIQEVHFLPFNPTDKRTALTYIDGDGNMYRVSKGAPEQILNLAHNKSEIEQKVHAVIDKFAERGLRSLGVAYQDVPDGRKESPGRPWHFVALLPLFDPPRHDSAETIQRALNLGVNVKMITGDQLAIGKETGRRLGMGTNMYPSSALLGQNKDESIADLPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGVVLGGYLAMMTVIFFWAAYKTNFFPRIFHVKSLEKTAQDDFQMLASAVYLQVSTISQALIFVTRSRSWSFVERPGFLLVFAFFVAQLIATLIAVYADWGFTSIKGIGWGWAGTVWLYNLVFYFPLDIIKFLIRYALSGKAWDLVIDQRVAFTRKKHFGKEERELKWAHAQRTLHGLQPPDAKLFPEKAGYSEMNQMAEEAKRRAEIARLRELHTLKGHVESVVKLKGLDIDTIQQSYTV

SEQ ID NO: 3045 - protein, 956 aa, Oryza sativa
MAEDKGGLDAVLKESVDLENIPIEEVFQNLKCCRQGLTSEEAQLRLQLFGPNKLEEKEESKFLKFLGFMWNPLSWVMEAAAIMAIALANGGGKPPDWQDFVGIITLLLINSTISFIEENNAGNAAAALMARLAPKAKVLRNGSWTEEEAAILVPGDIISIKLGDIIPADARLLEGDPLKIDQSALTGESLPATKGPGDGVYSGSTVKQGEIEAVVIATGVHTFFGKAAHLVDSTNQVGHFQKVLTAIGNFCICSIAVGMFVEIIVMYPIQHRPYRPGIDNLLVLLIGGIPIAMPTVLSVTMAIGSHRLSQQGAITKRMTAIEEMAGMDVLCSDKTGTLTLNKLTVDKNLIEIFERGVTQDQVILMAARASRTENQDAIDTAIVGMLADPKEARAGIQEVHFLPFNPTDKRTALTYIDSDGKMYRVSKGAPEQILNLAHNKTQIERRVHAVIDKFAERGLRSLAVAYQEVPDGRKESPGGPWRFVALLPLFDPPRHDSAETIRRALNLGVNVKMITGDQLAIGKETGRRLGMGTNMYPSSALLGQNKDESVAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVFGFMLLALIWEFDFPPFMVLIIAILNDGTIMTISKDLVKPSPLPDSWKLAEIFTTGVVLGGYLAMMTVIFFWAAYKTNFFPRIFHVESLEKTAQDDYQKLASAVYLQVSTISQALIFVTRSRSWSFIERPGFLLVFAFFVAQLIATLIAVYANWAFTSIKGIGWGWAGIVWLYNLVFYFPLDIIKFLIRYALSGKAWDLVIEQRIAFTRKKDFGKEERELKWAHAHRTLHGLQPPDAKPFPEKTGYSELNQMAEEAKRRAEIARLRELHTLKGHVESVVKLKGLDIDTIHQSYTV

SEQ ID NO: 3046 - protein, 948 aa, Zea mays
MADNEGTLDAVLKEAVDLENIPLEEVFENLRCSRGGLTSEQAQQRLQLFGPNKLEEKEESKFLKFLGFMWNPLSWVMEAAAIMAIALANGGGKPPDWQDFVGIITLLLINSTISFIEENNAGNAAAALMARLAPKAKVLRDGRWAEEEAAVLVPGDVISIKLGDIIPADARLLDGDPLKIDQSSLTGESLPVTKGPGDGAYSGSTVKQGEIEAVVIATGVHTFFGKAAHLVDSTNQVLTAIGNFCICSIAVGMFVEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFEREVTQDQVILMAARASRIENQDAIDTAIVGMLADPKEARAGIQEVHFLPFNPTDKRTALTYIDSDGKMYRVSKGAPEQILNLVYNKLEIERRVHAVIDKFAERGLRSLAVAYQVVPDGRKESPGGPWHFVALMPLFDPPRHDSAETIRRALNLGVSVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTAQDDYQKLASAVYLQVSTISQALIFVTRSRSWSFAERPGFLLVFAFLVAQLIATLVAVYADWGFTSIEGIGWGWAGVVWLYNLVFYFPLDLLKFLIRYALSGKAWDLVIEQRIAFTRKKDFGKEERALKWAHAQRTLHGLQPPDAKLFPDRVNELNQMAEEAKRRAEIARLRELHTLKGHVESVVKLKGLDIDTIQQSYTV

SEQ ID NO: 3047 - protein, 955 aa, Zea mays
MADNEGTLDAVLKEAVDLENIPLEEVFENLRCSRGGLTSEQAQQRLQLFGPNKLEEKELNWPWLQESKFLKFLGFMWNPLSWVMEAAAIMAIALANGGGKPPDWQDFVGIITLLLINSTISFIEENNAGNAAAALMARLAPKAKVLRDGRWAEEEAAVLVPGDVISIKLGDIIPADARLLDGDPLKIDQSSLTGESLPVTKGPGDGAYSGSTVKQGEIEAVVIATGVHTFFGKAAHLVDSTNQVLTAIGNFCICSIAVGMFVEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFEREVTQDQVILMAARASRIENQDAIDTAIVGMLADPKEARAGIQEVHFLPFNPTDKRTALTYIDSDGKMYRVSKGAPEQILNLVYNKLEIERRVHAVIDKFAERGLRSLAVAYQVVPDGRKESPGGPWHFVALMPLFDPPRHDSAETIRRALNLGVSVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTAQDDYQKLASAVYLQVSTISQALIFVTRSRSWSFAERPGFLLVFAFLVAQLIATLVAVYADWGFTSIEGIGWGWAGVVWLYNLVFYFPLDLLKFLIRYALSGKAWDLVIEQRIAFTRKKDFGKEERALKWAHAQRTLHGLQPPDAKLFPDRVNELNQMAEEAKRRAEIARLRELHTLKGHVESVVKLKGLDIDTIQQSYTV

SEQ ID NO: 3048 - protein, 956 aa, Solanum phureja
MAEKPEVLDAVLKETVDLENIPIEEVFENLRCTREGLTTTAAQERLSIFGYNKLEEKKESKFLKFLGFMWNPLSWVMEAAAIMAIALANGGGKPPDWQDFVGIITLLIINSTISFIEENNAGNAAAALMARLAPKAKVLRDGKWDEEDAAVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKALIEVFAKGIDADTVVLMAARASRIENQDAIDTAIVGMLADPQEARAGIREIHFLPFNPTDKRTALTYLDGEGKMHRVSKGAPEQILNLAHNKSDIERRVHTVIDKFAERGLRSLGVAYQEVPEGRKESAGGPWQFIALLPLFDPPRHDSAETIRRALNLGVNVKMITGDQLAIGKETGRRLGMGTNMYPSSALLGQTKDESIAALPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVILGGYLAMMTVIFFWAAYKTNFFPRVFGVSTLEKTATDDFRKLASAIYLQVSTISQALIFVTRSRSWSFVERPGLLLVFAFFVAQLVATLIAVYANWSFAAIEGIGWGWAGVIWLYNIVTYIPLDLIKFLIRYALSGKAWDLVLEQRIAFTRKKDFGKELRELQWAHAQRTLHGLQVPDPKIFSETTNFNELNQLAEEAKRRAEIARLRELHTLKGHVESVVKLKGLDIETIQQSYTV

SEQ ID NO: 3049 - protein, 698 aa, Solanum lycopersicum
MIIEIIVMYPIQHRKYRPGIDNLLVLLIGGIPIAMPTVLSVTMAIGSHRLAQQGAITKRMTAIEEMAGMDVLCSDKTGTLTLNKLTVDKALIEVFAKGIDADTVVLMAARASRIENQDAIDTAIVGMLADPKEARAGIREIHFLPFNPTDKRTALTYLDGEGKMHRVSKGAPEQILNLAHNKSDIERRVHTVIDKFAERGLRSLGVAYQEVPEGRKESAGGPWQFIALLPLFDPPRHDSAETIRRALNLGVNVKMITGDQLAIGKETGRRLGMGTNMYPSSALLGQTKDESIAALPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYKTNFFPRIFGVSTLEKTATDDFRKLASAIYLQVSTISQALIFVTRSRSWSFVERPGLLLVFAFFVAQLVATLIAVYANWSFAAIEGIGWGWAGVIWLYNIVTYIPLDLIKFLIRYALSGKAWDLVLEQRIAFTRKKDFGKELRELQWAHAQRTLHGLQVPDPKIFSETTNFNELNQLAEEAKRRAEIARLRELHTLKGHVESVVKLKGLDIETIQQSYTV

SEQ ID NO: 3050 - protein, 956 aa, Zea mays
MEDKASNLDAVLKEAVDLENIPIEEVFENLRCSPQGLTTEQAEQRLAIFGPNKLEEKQESKFLKFLGFMWNPLSWVMEAAAIMAIALANGGNKPPDWQDFVGIITLLIINSTISFIEENNAGNAAAALMARLAPKAKVLRNGRWTEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMLVELVVMYAIQHRAYRPGIDNLLVLLIGGIPIAMPTVLSVTMAIGAHRLAQQGAITKRMTAIEEMAGMDVLCSDKTGTLTLNKLTVDKSLVEVFQRGVDQDTVILMAARASRTENQDAIDATIVGMLADPKEARAGVQEIHFLPFNPTDKRTALTYLDGEGRMHRVSKGAPEQILHLAHNKSDIERRVRAVIDKFAERGLRALGVAYQEVPDGRKESPGGPWQFIGLLPLFDPPRHDSAETIRRALNLGVNVKMITGDQLAIGKETARRLGMGTNMYPSSALLGQNKDESIASLPIDDLIEKADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTDFFPRLFHVESLEKTAQDDFQKLASAVYLQVSTISQALIFVTRSRSWSFVERPGFLLVFAFLVAQLIATLIAVYANWAFAAIKGIGWGWAGVIWLYNIVFYFPLDIIKFLIRYALSGRAWNLVLEQRIAFTSKKNFGTEERERKWAHAQRTLHGLQPPEASIFENKTTFNELNQLAEEARRRAEMARLREVSTLKGRMESVVKQKGLDIETIQQSYTV

SEQ ID NO: 3051 - protein, 955 aa, Glycine max
MGDKSQVLEAVLKETVDLENIPIEEVLENLRCGREGLSSEAAEERLTIFGHNKLEEKKESKFLKFLGFMWNPLSWVMEAAAIMAIALANGGGKAPDWQDFVGIITLLLINSTISFIEENNAGNAAAALMARLAPKAKVLRDGRWNEQDAAILVPGDIISIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIALGMVVEIIVMYPIQDRPYRPGIDNLLVLLIGGIPIAMPTVLSVTMAIGSHRLSQQGAITKRMTAIEEMAGMDVLCSDKTGTLTLNKLTVDKNLVEVFAKGVDPDTVILMAARASRLENQDAIDTAIVGMLADPKEARAGIQEVHFLPFNPTDKRTALTYLDQDGKMHRVSKGAPEQILNLAHNKADIERRVHSVIDKFAERGLRSLAVAYQEVPDGRKESAGGPWQFIGLLSLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVPSLEKTAHDDYRKLASAIYLQVSTISQALIFVTRSRGWSYVERPGLLLVFAFVVAQLIATLIAVYANWSFAAIEGIGWGWAGVIWLYNIIFYIPLDIVKFLIRYALSGRAWDLVIEQRIAFTRQKDFGKEQRELQWAHAQRTLHGLQPADTKFNERTHVSELNQMAEEAKRRAEIARLRELHTLKGHVESVVRLKGLDIDTIQQAYTL

SEQ ID NO: 3052 - protein, 698 aa, Theobroma cacao
MIIEIIVMYPIQDRQYRPGIDNLLVLLIGGIPIAMPTVLSVTMAIGSHRLSQQGAITKRMTAIEEMAGMDVLCSDKTGTLTLNKLTVDKNLVEVFAKGVDADTVVLMAARASRTENQDAIDSAIVGMLADPKEARAGIREVHFLPFNPTDKRTALTYIDNDGKMHRVSKGAPEQILNLAHNKSDIERRVHVVIDKFAERGLRSLAVAYQEVPEGRKESSGGPWQFIGLMPLFDPPRHDSAETIRRALNLGVNVKMITGDQLAIGKETGRRLGMGTNMYPSSALLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGSYLAVMTVIFFWAAYKTDFFPRIFGVPTLEKTAHDDLRKLASAVYLQVSIISQALIFVTRSRSWSYVERPGLLLVVAFVVAQLIATLIAVYANWSFAAIEGIGWGWAGVIWLYNIIFYIPLDFIKFFIRYALSGRAWDLVIEQRIAFTRQKDFGKEQRELQWAHAQRTLHGLQAPDTKMFTERTHFTELNQMAEEAKRRAEIARLRELHTLKGHVESVVRLKNLDIDTIQQAYTV

SEQ ID NO: 3053 - protein, 956 aa, Quercus alba
MGDKSQVLEAVLKETVDLENIPIEEVLENLRCSREGLTSVAAEERLVLFGHNKLEEKRESKFLKFLGFMWNPLSWVMEAAAIMAIALANGGGKPPDWQDFVGIIVLLFINSTISFIEENNAGNAAAALMARLAPKAKVLRDGRWNEQDAAILVPGDIISIKLGDIIPADARLLEGDPLKIDQSALTGESLPVTKGPGDGIYSGSTCKQGEIEAVVIATGVHTFFGKAAHLVDTTNQVGHFQKVLTAIGNFCICSIAIGMIIEIIVMYPIQDREYRPGIDNLLVLLIGGIPIAMPTVLSVTMAIGSHRLAQQGAITKRMTAIEEMAGMDVLCSDKTGTLTLNKLSVDKNLIEVFAKGVDGDTVVLMAAQASRTENQDAIDSAIVGMLADPKEARAGIQEVHFLPFNPTDKRTALTYIDRNGKMHRVSKGAPEQILNLAHNKSEIERRVHAVIDKFAERGLRSLAVAYQEVPEGRKESAGSPWQFIGLMPLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWAAYKTDFFPRVFGVPTLEKTAHDDFRKLASAIYLQVSTVSQALIFVTRSRSWSFVERPGMLLVVAFIIAQLIATVIAVYANWSFAAIEGIGWGWAGVIWLYNIIFYIPLDLIKFFIRYALSGRAWDLVIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 3054 - protein, 957 aa, Fragaria vesca
MAEEKPEVLDAVLKETVDLENIPIEEVFENLRCSKEGLTSEAAEERLTIFGHNKLEEKQESKFIKFLGFMWNPLSWVMEAAAIMAIALANGGGKPPDWQDFVGIITLLVINSTISFIEENNAGNAAAALMARLAPKAKVLRDGRWNEQDAAVLVPGDIISIKLGDIVPADARLLEGDPLKIDQSALTGESLPVTKGPGDGVYSGSTCKQGEIEAVVIATGVHTFFGKAAHLVDSTNQVGHFQKVLTAIGNFCICSIAVGMVIEIIVMYPIQDRDYRPGIDNLLVLLIGGIPIAMPTVLSVTMAIGSHRLAQQGAITKRMTAIEEMAGMDVLCSDKTGTLTLNKLTVDKNLIEVFAKGVDPDTVVLMAARASRTENQDAIDTAIVGMLADPKEARAGIQEIHFLPFNPTDKRTALTYIDRDGKMHRVSKGAPEQILHLAHNKSDIERRVHAVIDKFAERGLRSLAVAYQEVPEGIKEGAGGPWQFIGLMPLFDPPRHDSAETIRRALNLGVNVKMITGDQLAIGKETGRRLGMGTNMYPSSALLGQNKDESIAALPIDDLIEKADGFAGVFPEHKYEIVKRLQAMKHICGMTGDGVNDAPALKKADIGIAVADATDAARSASDIVLTEPGLSVIISAVLTSRAIFQRMKNYTIYAVSITIRIVMGFMLLALIWKFDFPPFMVLIIAILNDGTIMTISKDRVKPSPLPDSWKLAEIFATGIVLGSYLAIMTVIFFWAAYKTDFFPRTFGVSTLEKTANDDFRKLASAIYLQVSIISQALIFVTRSRGWSFLERPGMLLFVAFLIAQLIATLIAVYANWSFAAIEGIGWGWAGVIWLYNIVFYIPLDIIKFMIRYALSGKAWDLLIEQRIAFTRQKDFGKEQRELQWAHAQRTLHGLQPPDTKMFTERTHFTELNHMAEEAKRRAEIARLRELHTLKGHVESVVRLKGLDIDTIQQAYTV

SEQ ID NO: 3055 - protein, 956 aa, Cucumis sativus
MGDKDEVLEAVVKEAVDLENVPLEEVFQTLRCNKNGLTTEAAHERLAIFGHNKLEEKKESKLLKFLGFMWNPLSWVMEAAAIMAIALANGGGKPPDWQDFVGIITLLLINSTISFIEENNAGNAAAALMAHLAPKAKVLRDGKWVEEEASVLVPGDIISVKLGDIIPADARLLEGDPLKIDQSALTGESLPVTKGPGDSVYSGSTCKQGEIEAVVIATGVHTFFGKAAHLVDSTNQVGHFQKVLTAIGNFCICSIVVGMVVEIIVMYPIQHRPYRPGIDNLLVLLIGGIPIAMPTVLSVTMAIGSHRLSEQGAITKRMTAIEEMAGMDVLCSDKTGTLTLNKLTVDKTLIEVFAKGVDVDTVVLMAARASRVENQDAIDAAIVGMLSDPKEARAGIQEVHFLPFNPTDKRTALTYTDTDSKMHRVSKGAPEQILNLAHNKSEIERRVHAVIDKFAERGLRSLAVAYQEVSDGRKESHGGPWQFIGLMPLFDPPRHDSAETIRRALNLGVNVKMITGDQLAIGKETGRRLGMGTNMYPSSALLGQNKDESISGLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIYQFDFPPFMVLIIAILNDGTIMTISKDRVKPSPLPDSWKLAEIFGTGIILGGYLAMMTVIFFWAAYKTDFFPRTFGVSSLQKKDEDDFRKLASAIYLQVSTISQALIFVTRSRSWSFVERPGLLLVAAFIIAQLIATLIAVYANWSFAAIEGIGWGWAGVVWLYNLIFYFPLDIIKFAIRYAISGRAWDLVIEQRIAFTRKKDFGKEERELKWAHAQRTLHGLQPPEAKMFSDRTTYTELNQMAEEAKRRAEIARLRELHTLKGHVESVVRLKGLDINTIQQSYTV

SEQ ID NO: 3056 - protein, 956 aa, Cucumis sativus
KGEKPEVLEAVLKETVDLENIPIEEVFDNLRCSKEGLTTAAAEERLVIFGHNKLEEKKESKVLKFLGFMWNPLSWVMEAAAIMAIALANGGGKPPDWQDFVGIIALLLINSTISFIEENNAGNAAAALMASLAPQAKILRDGRWSVQDASVLVPGDIISIKLGDIIPADARLLDGDPLKIDQSALTGESLPVTKGPGDGIYSGSTCKQGEIEAVVIATGVHTFFGKAAHLVDTTNQVGHFQKVLTAIGNFCICSIALGMITEIIVMYPIQDRDYRPGIDNLLVLLIGGIPIAMPTVLSVTMAIGSHRLSQQGAITKRMTAIEEMAGMDVLCSDKTGTLTLNKLTVDKNLVEVFAKGVDVDTVVLMAARASRTENQDAIDTAIVGMLADPKEARAGIQEVHFLPFNPTDKRTALTYIDHEGKMHRVSKGAPEQILNLAHNKSEIERKVHAVIDKFAERGLRSLAVAYQEVPDGRKESAGGPWQFVGLLPLFDPPRHDSAETIRRALNLGVNVKMITGDQLAIGKETGRRLGMGTNMYPSSALLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIILGGYLAMMTVIFFWVAYKTNFFPRIFGVATLEKTAHDDIRKLASAVYLQVSTISQALIFVTRSRSWSFVERPGLLLVAAFLVAQLIATLIAVYANWGFAAIEGIGWGWAGVIWLYNIIFYIPLDLIKFFIRYALSGRAWDLVIEQRIAFTRQKDFGKEQRELQWAHAQRTLHGLQAPDAKMFHDRTHFTELNQMAEEAKRRAEIARLRELHTLKGHVESVVRLKGLDIDTIQQAYTV

SEQ ID NO: 3057 - protein, 955 aa, Glycine max
MGDKSQVLEAVLKETVDLENIPIEEVLENLRCGREGLSSEAAEERLTIFGHNKLEEKKESKFLKFLGFMWNPLSWVMEAAAIMAIALANGGGKAPDWQDFVGIITLLLINSTISFIEENNAGNAAAALMARLAPKAKVLRDGRWNEQDAAVLVPGDIISIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIALGMVIEIIVMYPIQDRPYRSGIDNLLVLLIGGIPIAMPTVLSVTMAIGSHRLAQQGAITKRMTAIEEMAGMDVLCSDKTGTLTLNKLTVDKNLVEVFAKGVDPDTVILMAARASRLENQDAIDTAIVGMLADPKEARAGIQEVHFLPFNPTDKRTALTYLDQDGKMHRVSKGAPEQILNLAHNKADIERRVHSVIDKFAERGLRSLAVAYQEVPDGRKESAGGPWQFIGLLSLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVPTLEKTAHDDYRKLASAIYLQVSTISQALIFVTRSRGWSYVERPGLLLVFAFIVAQLIATLIAVYGNWSFCSIEGIGWGWAGVIWLYNIIFYIPLDIIKFLIRYALSGRAWDLVIEQRIAFTRQKDFGKEQRELQWAHAQRTLHGLQPADTKFNERTHVNELNQMAEEAKRRAEIARLRELHTLKGHVESVVRLKGLDIDTIQQAYTV

SEQ ID NO: 3058 - protein, 956 aa, Glycine max
MGDKSQVLEAVLKEAVDLENIPIEEVFENLRCSKEGLSSEAAEERLVIFGHNKLEEKKESKFLKFLGFMWNPLSWVMEAAAIMAIALANGGGKPPDWQDFVGIITLLIINSTISFIEENNAGNAAAALMARLAPKAKVLRDGRWNEQDASVLVPGDIVSIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIAVGMVIEIIVMYPIQDREYRPGIDNLLVLLIGGIPIAMPTVLSVTMAIGSHRLSQQGAITKRMTAIEEMAGMDVLCSDKTGTLTLNKLTVDKNLIEVFAKGVDADTVVLMAAQASRLENQDAIDTAIVGMLADPKEARLGIQEVHFLPFNPTDKRTALTYIDRNGKMHRVSKGAPEQILNLAHNKSDIERRVHAVIDKFAERGLRSLAVAFQDVPDGRKESPGGPWQFIGLLPLFDPPRHDSAETIRRALNLGVNVKMITGDQLAIGKETGRRLGMGTNMYPSSALLGQDKDESISALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVSTLEKTAHHDFRKLASAIYLQVSTISQALIFVTRSRGWSYVERPGILLVTAFVIAQLIATLIAVYANWSFAAIEGIGWGWAGVIWLYNIIFYIPLDPIKFLIRYALSGRAWELVIEQRIAFTRQKDFGKEQRELQWAHAQRTLHGLQPPDTKMFTERPHFNELNQMAEEAKRRAEIARLRELHTLKGHVESVLKLKGIDVDTIQQAYTV

SEQ ID NO: 3059 - protein, 956 aa, Prunus persica
MAEKPEVLDAVLKETVDLENIPIEEVFENLRCSKEGLSSEAAEERLTIFGHNKLEEKQESKFLKFLGFMWNPLSWVMEAAAIMAIALANGGGKPPDWQDFVGIITLLVINSTISFIEENNAGNAAAALMARLAPKAKVLRDGRWNEQEAGVLVPGDIISIKLGDIVPADARLLEGDPLKIDQSALTGESLPVTKSPGDGVYSGSTCKQGEIEAVVIATGVHTFFGKAAHLVDSTNQVGHFQKVLTAIGNFCICSIAVGMVIEIIVMYPIQDRDYRPGIDNLLVLLIGGIPIAMPTVLSVTMAIGSHRLSQQGAITKRMTAIEEMAGMDVLCSDKTGTLTLNKLTVDKNLIEVFAKGMDPDTVVLMAARASRVENQDAIDTAIVGMLADPKEARAGVQELHFLPFNPTDKRTALTYLDRDGKMHRVSKGAPEQILNLAHNKSDIERRVHAVIDKFAERGLRSLAVAYQEVPEGRKESAGGPWQFVGLMPLFDPPRHDSAETIRRALDLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAIMTVIFFWAAYKTDFFPRVFGVSTLEKTANDDFRKLASAIYLQVSIISQALIFVTRSRSWSFVERPGLLLVVAFVIAQLIATLIAVYANWSFAAIEGIGWGWAGVIWLYNLVFYFPLDIIKFMIRYALSGKAWDLLIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 3060 - protein, 956 aa, Juglans hindsii x Juglans regia
MAEKPEVLDAVLKEVVDLENIPIEEVFENLRCSKEGLTTVAAEERLAIFGHNKLEEKKDSKFLKFLGFMWNPLSWVMEAAAIMAIALANGGGKPPDWQDFVGIIVLLFINSTISFIEENNAGNAAAALMARLAPKAKVLRDGKWSEYDAAVLVPGDIVSIKLGDIIPADARLLDGDPLKIDQSALTGESLPVTKGPGDGVYSGSTCKQGEIEAVVIATGVHTFFGKAAHLVDTTNQVGHFQKVLTAIGNFCICSIAVGMIIEIIVMYPIQDRKYRPGIDNLLVLLIGGIPIAMPTVLSVTMAIGSHRLSQQGAITKRMTAIEEMAGMDVLCSDKTGTLTLNKLSVDKALIEVFTKGVDADAVVLMAARASRVENQDAIDSAIVGMLADPKEARAGIQEVHFLPFNPTDKRTALTYIDRDGKMHRVSKGAPEQILNLAHNKSDIERRVHAVIDKFAERGLRSLAVAYQEVPEGRKESAGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLSEIFTTGIILGSYLAMMTVIFFWAAYKTDFFPRIFGVPTLEKTAHDDIRKLASAIYLQVSIISQALIFVTRSRSWSFIERPGFLLVVAFIIAQLIATLIAVYASWSFAAIEGIGWGWAGVIWLYNIIFYFPLDFIKFFIRYALSGRAWDLVIEQRIAFTRQKDFGKEQRELQWAHAQRTLHGLQPPDSKMFTERTHFTELNQIAEEAKRRAEIARLRELNTLKGHVESVVRLKGLDIDTIQQSYTV

SEQ ID NO: 3061 - protein, 956 aa, Glycine max
MGDKSQVLEAVLKEAVDLENIPIEEVFENLRCSKEGLSSEAAEERLVIFGHNKLEEKKESKFLKFLGFMWNPLSWVMEAAAIMAIALANGGGKPPDWQDFVGIITLLLINSTISFIEENNAGNAAAALMARLAPKAKVLRDGRWNEQDASVLVPGDIVSIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIAVGMVIEIIVMYPIQDREYRPGIDNLLVLLIGGIPIAMPTVLSVTMAIGSHRLSQQGAITKRMTAIEEMAGMDVLCSDKTGTLTLNKLTVDKNLIEVFTKGVDADTVVLMAAQASRLENQDAIDTAIVGMLADPKEARLGIQEVHFLPFNPTDKRTALTYIDRNGKMHRVSKGAPEQILNLAHNKSDIERRVHAVIDKFAERGLRSLAVAFQDVPDGRKESTGGPWQFIGLLPLFDPPRHDSAETIRRALNLGVNVKMITGDQLAIGKETGRRLGMGTNMYPSSALLGQDKDESISALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVSTLEKTAHDDFRKLASAIYLQVSTISQALIFVTRSRGWSYVERPGILLVTAFVIAQLIATLIAVYANWSFAAIEGIGWGWAGVIWLYNIIFYIPLDPIKFLIRYALSGRAWELVIEQRIAFTRQKDFGKEQRELQWAHAQRTLHGLQPPDTKMFTERTHFNELNQMAEEAKRRAEIARLRELHTLKGHVESVLKLKGIDVDTIQQAYTV

SEQ ID NO: 3062 - protein, 698 aa, Solanum lycopersicum
MIIEIIVMYPIQHRKYRPGIDNLLVLLIGGIPIAMPTVLSVTMAIGSHRLAQQGAITKRMTAIEEMAGMDVLCSDKTGTLTLNKLTVDKNLVEVFAKGVDADTVVLMAARASRTENQDAIDTAIVGMLSDPKEARAGIREIHFLPFNPTDKRTALTYLDGEGKMHRVSKGAPEQILNLAHNKSDIERRVHAVIDKFAERGLRSLGVAYQEVPEGRKESSGGPWQFIGLLPLFDPPRHDSAETIRRALNLGVNVKMITGDQLAIGKETGRRLGMGTNMYPSSALLGQTKDESIASLPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYETDFFPRVFGVSTLQRTATDDFRKLASAIYLQVSTISQALIFVTRSRSWSFVERPGLLLVVAFLIAQLVATLIAVYASWSFAAIEGIGWGWAGVIWLYNLVFYFPLDIIKFLIRYALSGRAWDLVLEQRIAFTRKKDFGKEQRELQWAHAQRTLHGLQVPDTKLFSEATNFNELNQLAEEAKRRAEIARQRELHTLKGHVESVVKLKGLDIETIQQSYTV

SEQ ID NO: 3063 - protein, 960 aa, Cucumis sativus
MGEKPEVLEAVLKEAVDLENIPIDEVFENLRCSKEGLTSEGAEERLKIFGHNKLEEKKESKVLKFLGFMWNPLSWVMEAAAIMAIALANGGGKPPDWQDFVGIITLLIINSTISFIEENNAGNAAAALMARLAPKAKVLRDGRWSEQDASILVPGDVISVKLGDIIPADARLLDGDPLKIDQSALTGESLPVTKGPGDGVYSGSTCKQGEIEAVVIATGVHTFFGKAAHLVDTTNQVGHFQKARRCVLTAIGNFCICSIALGMVIEIIVMYPIQDREYRPGIDNLLVLLIGGIPIAMPTVLSVTMAIGSHRLSQQGAITKRMTAIEEMAGMDVLCSDKTGTLTLNKLTVDKNLVEVFGKGIDADTIVLMAARASRIENQDAIDTAIVGMLADPKEARAGIQEVHFLPFNPTDKRTALTYIDHEGKMHRVSKGAPEQILNLAYNKSEIERRVHAVIDKFAERGLRSLAVAYQEVPEGRKESPGGPWQFMGLLPLFDPPRHDSAETIRRALNLGVNVKMITGDQLAIGKETGRRLGMGTNMYPSSALLGQEKDESIAALPVDDLIEKADGFAGVFPEHKYEIVKRLQAMKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWASYKTNFFPRIFGVSTLEKTAHDDFRKLASAIYLQVSTISQALIFVTRSRSWSYVERPGLFLVVAFILAQLVATLIAVYANWSFAAIEGIGWGWAGVIWLYNIIFYIPLDPIKFAIRYALSGKAWDLMLEQRVAFTRQKDFGKEQRELQWAHAQRTLHGLQPPDTKMFTERTHFTELNHMAEEAKRRAEIARLRELHTLKGHVESVVRLKGLDIETIQQAYTV

SEQ ID NO: 3064 - protein, 957 aa, Oryza sativa
MAEKGDNLEAVLNESVDLENIPLEEVFEHLRCNREGLTSANAEQRLNLFGPNRLEEKKESKFLKFLGFMWNPLSWVMEAAAIMAIALANGGGKPPDWQDFVGIITLLIINSTISFIEENNAGNAAAALMARLAPKAKVLRNGRWSEEEAAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAIGMVVEIIVMYPIQHRDYRPGIDNLLVLLIGGIPIAMPTVLSVTMAIGSHRLAQQGAITKRMTAIEEMAGMDVLCSDKTGTLTLNKLTVDKSLIEVFQRGVDQDTVILMAARASRTENQDAIDATIVGMLADPKEARAGIQEVHFLPFNPTDKRTALTYIDGEGKMHRVSKGAPEQILNLAHNKTEIERRVRAVIDKFAERGLRSLGVAYQQVPDGRKESPGGPWQFVGLLPLFDPPRHDSAETIRRALNLGVNVKMITGDQLAIGKETARRLGMGTNMYPSSALLGQDKDESIVALPVDELIEKADGFAGVFPEHKYEIVKRLQARKHICGMTGDGVNDAPALKKADIGIAVDDSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLSEIFATGVVLGSYLAMMTVIFFWVAYKTDFFPRVFHVESLEKTAQDDFQKLASAVYLQVSTISQALIFVTRSRSWSFVERPGFLLVFAFFVAQLIATLIAVYANWGFASIKGIGWGWAGVIWLYNIVFYLPLDIIKFLIRYALSGRAWDLVLEQRIAFTRKKDFGTQENQLKWATAQRTIHGLQPAATAAVFRDMTSYNDLNQLAEEARRRAEIARLRELTTLKGRMESVVKQKGLDLETIQQSYTV

SEQ ID NO: 3065 - protein, 956 aa, Sorghum bicolor
MEDKASNLDAVLKEAVDLENIPIEEVFENLRCSPQGLSTEQAEQRLAIFGPNKLEEKQESKIFKFLGFMWNPLSWVMEAAAIMAIALANGGNKPPDWQDFVGIITLLIINSTISFIEENNAGNAAAALMARLAPKAKVLRNGRWTEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMVVELIVMYPIQHRGYRPGIDNLLVLLIGGIPIAMPTVLSVTMAIGAHRLAQQGAITKRMTAIEEMAGMDVLCSDKTGTLTLNKLTVDKSLVEVFQKGIDQDTVILMAARASRTENQDAIDATIVGMLADPKEARAGVREIHFLPFNPTDKRTALTYLDGEGRMHRVSKGAPEQILHLAHNKSDIERRVRAVIDKFAERGLRALGVAYQEVPDGRKESPGGPWQFIGLLPLFDPPRHDSAETIRRALHLGVNVKMITGDQLAIGKETARRLGMGTNMYPSSALLGQNKDESIASLPIDELIEKADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTDFFPRLFHVESLEKTAQDDFQKLASAVYLQVSTISQALIFVTRSRSWSFVERPGFLLVFAFLVAQLIATLIAVYANWAFASIKGIGWGWAGVIWLYNLVFYFPLDIIKFLIRYALSGRAWNLVLEQRIAFTSKKNFGTEERERKWAHAQRTLHGLQPPEASIFENKTTFNELNQLAEEARRRAEMARLREVSTLKGKMESVVKQKGLDIETIQQSYTV

SEQ ID NO: 3066 - protein, 956 aa, Solanum phureja
MGEKPEVLDAVLKETVDLENIPIEEVFENLRCTKEGLTGTAAQERLAIFGYNKLEEKKESKFLKFLGFMWNPLSWVMEAAAIMAIALANGGGKPPDWQDFVGIITLLVINSTISFIEENNAGNAAAALMARLAPKAKVLRDGKWNEEDAAVLVPGDIISIKLGDIVPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKNLVEVFAKGVDADTVVLMAARASRTENQDAIDTAIVGMLSDPKEARAGIREIHFLPFNPTDKRTALTYLDGEGKMHRVSKGAPEQILNLAHNKSDIERRVHAVIDKFAERGLRSLGVAYQEVPEGRKESSGGPWQFIGLLPLFDPPRHDSAETIRRALNLGVNVKMITGDQLAIGKETGRRLGMGTNMYPSSALLGQTKDESIASLPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYETDFFPRVFGVSTLQRTATDDFRKLASAIYLQVSTISQALIFVTRSRSWSFVERPGLLLVVAFLIAQLVATLIAVYASWSFAAIEGIGWGWAGVIWLYNLVFYFPLDIIKFLIRYALSGRAWDLVLEQRIAFTRKKDFGKEQRELQWAHAQRTLHGLQVPDTKLFSESTNFNELNQLAEEAKRRAEIARQRELHTLKGHVESVVKLKGLDIETIQQSYTV

SEQ ID NO: 3067 - protein, 956 aa, Solanum tuberosum
MGEKPEVLDAVLKETVDLENIPIEEVFENLRCTKEGLTGTAAQERLAIFGYNKLEEKKESKFLKFLGFMWNPLSWVMEAAAIMAIALANGGGKPPDWQDFVGIITLLVINSTISFIEENNAGNAAAALMARLAPKAKVLRDGKWNEEDAAVLVPGDIISIKLGDIVPADRRLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKNLVEVFAKGVDADTVVLMAARASRTENQDAIDTAIVGMLSDPKEARAGIREIHFLPFNPTDKRTALTYLDGEGKMHRVSKGAPEQILNLAHNKSDIERRVHAVIDKFAERGLRSLGVAYQEVPEGRKESSGGPWQFIGLLPLFDPPRHDSAETIRRALNLGVNVKMITGDQLAIGKETGRRLGMGTNMYPSSALLGQTKDESIASLPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYETDFFPRVFGVSTLQRTATDDFRKLASAIYLQVSTISQALIFVTRSRSWSFVERPGLLLVVAFLIAQLVATLIAVYASWSFAAIEGIGWGWAGVIWLYNLVFYFPLDIIKFLIRYALSGRAWDLVLEQRIAFTRKKDFGKEQRELQWAHAQRTLHGLQVPDTKLFSESTNFNELNQLAEEAKRRAEIARQRELHTLKGHVESVVKLKGLDIETIQQSYTV

SEQ ID NO: 3068 - protein, 956 aa, Aquilegia formosa
MADKAEVLEAVLKEAVDLENIPIEEVFENLRCNTGGLTSEAAQERLTIFGYNKLEEKKESKFLKFLGFMWNPLSWVMEAAAVMAIALANGGGKPPDWQDFVGIIILLIINSTISFIEENNAGNAAAALMARLAPKAKVLRDGRWSEEDAAILVPGDIISIKLGDIVPADARLLSGDPLKIDQSSLTGESLPVTKGPGDGVYSGSTCKQGEIEAVVIATGVHTFFGKAAHLVDSTNQVGHFQKVLTAIGNFCICSIAVGMVIEIIVMYPIQDREYRPGIDNLLVLLIGGIPIAMPTVLSVTMAIGSHRLAQQGAITKRMTAIEEMAGMDVLCSDKTGTLTLNKLSVDKNLIEVFTKGVDPDTVVLMAARASRVENQDAIDTAIVGMLADPKEARAGIQEIHFLPFNPTDKRTALTYVDGEGKMHRVSKGAPEQILNLAHNKSDIERRVHTVIDKFAERGLRSLGVAYQEVPEGRKESTGGPWQFVGLLPLFDPPRHDSAETIRRALNLGVNVKMITGDQLAIAKETGRRLGMGTNMYPSSALLGQTKDESIAALPIDELIEKADGFAGVFPEHKYEIVKRLQARKHICGMTGDGVNDAPALKKADIGIAVDDSTDAARSASDIVLTEPGLSVIISAVLTSRAIFQRMKNYTIYAVSITIRIVLGFMLLALLWRFDFPPFMVLIIAILNDGTIMTISKDRVKPSPLPDSWKLAEIFATGIILGGYLAMMTVIFFWAAYKTDFFPRHFHVSSLQKKDADDFKKLASAIYLQVSTISQALIFVTRSRSWSFAERPGWWLIIAFAVAQLIATLIAVYANWAFAAIEGIGWRWAGVIWLYNIVFYFPLDVIKFIIRYALSGRAWDLVIEQRIAFTRQKDFGKEARELKWAHAQRTLHGLQAPDAKMFPDRGNFTELNQMAEEAKRRAEIARLRELHTLKGHVESVVRLKGLDIDTIQQAYTV

SEQ ID NO: 3069 - protein, 953 aa, Helianthus annuus
KPEALEAVLKETVDLESIPIEEVFENLRCSKDGLTTSAAEQRLIIFGHNKLEEKKESKFLKFLGFMWNPLSWVMEAAAIMAIALANGGGKPPDWQDFVGIITLLIINSTISFIEENNAGNAVAALMARLAPKAKILRDGKWNEEDASMLVPGDIISIKLGDIIPADARLLDGDPLKIDQSALTGESLPVTKGPGDGVYSGSTCKQGEIEAVVIATGVHTFFGKAAHLVDSTNQVGHFQKVLTAIGNFCICSIAVGMVIEIIVMFPIQDRQYRPGIDNLLVLLIGGIPIAMPTVLSVTMAIGSHRLAQQGAITKRMTAIEEMAGMDVLCSDKTGTLTLNKLTVDKNLIDVFAKGVDADTVVLMAARASRTENQDAIDAAIVGMLADPKEARADIQELHFLPFNPTDKRTALTYLDSQGKMHRVSKGAPEQILNLAHNKSDIERRVHAVIDKFADRGLRSLAVAYQEVPEGRKESPGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTDFFPRTFGVPTLEKTAHDDFRKLASAIYLQVSTISQALIFVTRSRSWSFVERPGWLLVIAFAIAQLVATLIAVYANWSFAAVEGIGWGWAGVIWLYNIVFYFPLDIIKFFIRYALSGRAWDLVIERRIAFTRQKDFGKEQRELQWAHAQRTLHGLEVPDTKMFGDRTNVTELNQMAEEAKRRAEIARLRELHTLKGHVESVVRLKGLDIETIQQAYTV

SEQ ID NO: 3070 - protein, 956 aa, Pennisetum glaucum
MEDKTSNLDAVLKEAVDLENIPIEEVFENLRCSPQGLSTEQAEQRLAIFGPNKLEEKQESKLLKFLGFMWNPLSWVMEAAAIMAIALANGGGKPPDWQDFVGIITLLIINSTISFIEENNAGNAAAALMARLAPKAKVLRNGRWNEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMAVELVVMYAIQHRAYRPGIDNLLVLLIGGIPIAMPTVLSVTMAIGAHRLAQQGAITKRMTAIEEMAGMDVLCSDKTGTLTLNKLTVDKSLIEVFQRGVDQDTVILMAARASRTENQDAIDATIVGMLADPKEARAGVQEIHFLPFNPTDKRTALTYLDGEGKMHRVSKGAPEQILHLAHNKSDIERRVRAVIDKFAERGLRALGVAYQEVPDGRKESPGGPWQFIGLLPLFDPPRHDSAETIRRALDLGVNVKMITGDQLAIGKETARRLGMGTNMYPSSALLGQDKDESIISLPVDELIEQADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPMPDSWKLAEIFATGVVLGGYLAMMTVIFFWAAYKTNFFPRVFGVESLEKTAQDDFQKLASAVYLQVSTISQALIFVTRSRSWSFMERPGFLLVFAFLVAQLIATLIAVYANWAFAAIKGIGWGWAGVIWLYNVVFYFPLDIIKFLTRYALSGRAWDLVLEQRIAFTRKKDFGREERELKWAHAQRTLHGLQAPEPSIFENKTTFNELNQLAEEARRRAEMARLREVNTLKGKMESVVRQKGLDMETIQQSYTV

SEQ ID NO: 3071 - protein, 956 aa, Pinus taeda
MGDKAATLEAINKEAVDLEHIPIEEVFENLRCSREGLSSQAAQERLTIFGYNKLEEKKESKFLKFLGFMWNPLSWVMEAAAVMAIAMANGGGKPPDWQDFVGIITLLVINSTISFIEENNAGNAAAALMARLAPKSKVLRDGQWNEEDAAVLVPGDIISIKLGDIVPADARLLEGDPLKIDQSALTGESLPVTKGPGDGVYSGSTCKQGELECVVIATGVHTFFGKAAHLVDSTNQVGHFQKVLTAIGNFCICSIAIGMIVEIIVMYPIQDRKYRPGIDNLLVLLIGGIPIAMPTVLSVTMAIGSHRLSQQGAITKRMTAIEEMAGMDVLCSDKTGTLTLNKLTVDKNIIEVFTKGYDKDAVVLMAARASRTENQDAIDAAIVGMLADPKEARAGIQEVHFLPFNPTDKRTALTYIDNEGKMHRVSKGAPEQILNLAHNKPEIERRVHTVIDKFAERGLRSLAVAYQEVPEGRKESPGGPWHFIGLMPLFDPPRHDSAETIRRALNLGVNVKMITGDQLAIAKETGRRLGMGTNMYPSSSLLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGVIIGSYLALMTVIFFWAAYKTDFFPRTFGVASLQKKDQDDIRKLSAAVYLQVSTVSQALIFVTRSRSWSFMERPGLLLVFAFCVAQLIATLIAVYANWGFAAIEGMGWGWAGVVWLYNIIFYFPLDIIKFLIRYALSGKAWDLVIEQRTAFTRQKDFGKEARELKWAHAQRTLHGLHTADTKMFSERGNITDLNQMAEEAKRRAEIARLRELHTLKGHVESVVRLKGLDIDTIQQAYTV

SEQ ID NO: 3072 - protein, 956 aa, Taxus baccata
MDDKAATLEAINKEAVDLENIPIEEVFENLRCGREGLSNDAAQERLGLFGHNKLEEKKESKFLKFLGFMWNPLSWVMEAAAIMAIALANGGGKPPDWQDFVGIITLLVINSTISFIEENNAGNAAAALMARLAPKAKVLRDGQWGEEDAAILVPGDIISIKLGDIVPADARLLEGDPLKIDQSALTGESLPVTKGPGDGVYSGSTCKQGEIEAVVIATGVHTFFGKAAHLVDSTNQVGHFQKVLTAIGNFCICSIAIGMLIEVVVMYPIQDRKYRPGIDNLLVLLIGGIPIAMPTVLSVTMAIGSHRLSQQGAITKRMTAIEEMAGMDVLCSDKTGTLTLNKLTVDKNLIEVFAKGVDKDTVVLMAARASRTENQDAIDSAIVGMLADPKEARANIQEIHFLPFNPTDKRTALTYIDRDGKMHRVSKGAPEQILNLAHNKSEIERRVHTVIDKFAERGLRSLAVSYQEVPEAKKDSAGGPWQFIGLMPLFDPPRHDSAETIRRALNLGVNVKMITGDQLAIGKETGRRLGMGTNMYPSSSLLGQNKDESIVALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLAEIFATGVIIGSYLALMTVIFFWAAYKTDFFPRTFGVESLHSKDQEDTKKLSAAVYLQVSTISQALIFVTRSRSWSFVERPGLLLVFAFCVAQLIATIIAVYANWGFAAIKGMGWGWAGVVWLYNIIFYFPLDVIKFFIRYALSGKAWDLVIEQRTAFTRQKDFGKEARELKWAHAQRTLHGLHPPDTRMFSERSNVTDLNQMAEEAKRRAEIARLRELHTLKGHVESVVRLKGLDIDTIQQAYTV

SEQ ID NO: 3073 - protein, 956 aa, Arabidopsis thaliana
MGDKEEVLEAVLKETVDLENVPIEEVFESLRCSREGLTTEAADERLALFGHNKLEEKKESKFLKFLGFMWNPLSWVMEAAAIMAIALANGGGKPPDWQDFVGIITLLVINSTISFIEENNAGNAAAALMARLAPKAKVLRDGRWGEQDAAILVPGDIISIKLGDIVPADARLLEGDPLKIDQSSLTGESLPVTKGPGDGVYSGSTCKQGELEAVVIATGVHTFFGKAAHLVDTTNHVGHFQQVLTAIGNFCICSIAVGMIIEIVVMYPIQHRAYRPGIDNLLVLLIGGIPIAMPTVLSVTMAIGSHRLSQQGAITKRMTAIEEMAGMDVLCSDKTGTLTLNKLTVDKNLIEVFTKGVDADTVVLMAAQASRLENQDAIDAAIVGMLADPKEARAGVREVHFLPFNPTDKRTALTYIDSDGKMHRVSKGAPEQILNLAHNRAEIERRVHAVIDKFAERGLRSLAVAYQEVPEGTKESAGGPWQFMGLMPLFDPPRHDSAETIRRALNLGVNVKMITGDQLAIGKETGRRLGMGTNMYPSSALLGQHKDESIGALPIDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGVVFGSYMAMMTVIFFWAAYKTDFFPRTFGVSTLEKTAHDDFRKLASAIYLQVSIISQALIFVTRSRSWSYVERPGMLLVVAFILAQLVATLIAVYANWSFAAIEGIGWGWAGVIWLYNIVFYIPLDIIKFLIRYALSGRAWDLVIEQRVAFTRQKDFGKEQRELQWAHAQRTLHGLQAPDAKMFPERTHFNELSQMAEEAKRRAEIARLRELHTLKGHVESVVRLKGLDIETIQQAYTV

SEQ ID NO: 3074 - protein, 956 aa, Orobanche aegyptiaca
MGEKPEVLDAVLKETVDLENIPVEEVFENLRCTKDGLSTDAAQERLSIFGYNKLEEKRESKFFKFLGFMWNPLSWVMEAAAIMAIALANGGGKPPDWQDFVGIITLLVINSTISFIEENNAGNAAAALMARLAPKAKVLRDGRWNEEEASVLVPGDIISIKLGDIVPADARLLEGDPLKIDQSALTGESLPVTKGPGDGVYSGSTCKQGEIEAIVIATGVHTFFGKAAHLVDSTNQVGHFQKVLTAIGNFCICSIAVGMIIEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFAKGVDADTVVLMAARASRTENQDAIDAAIVGMLADPKEARAGIREIHFLPFNPTDKRTALTYIDGQGKMHRVSKGAPEQILNLAHNKSDIERRVHAVIDKFAERGLRSLAVACQEVPEGTKESPGSQWQFIGLMPLFDPPRHDSAETIRRALNLGVNVKMITGDQLAIGKETGRRLGMGTNMYPSSALLGQHKDESIAALPVDELIEKADGFAGVFPEHKYEIVKRLQALKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGVILGGYLAMMTVIFFYAAYKTDFFPKVFGVSTLEKTAHDDFRKLASAIYLQVSTISQALIFVTRSRSWSFVERPGLLLVAAFLVAQLVATLIAVYANWSFAAIEGIGWGWAGVIWLYNIVFYIPLDIIKFLTRYALSGRAWDLVLEQRIAFTRKKDFGKEQRELKWAHAQRTLHGLQVPDTKMFNETNNFSELNQLAEEAKRRAEIARLRELHTLKGHVESVVRLKGLDIDTIQQAYTV

SEQ ID NO: 3075 - protein, 956 aa, Sciadopitys verticillata
MGDKAATLEAINKEAVDLENIPIEEVFENLRCSREGLSSQAAQERLGIFGYNKLEEKKESKFLKFLGFMWNPLSWVMEAAAIMAIALANGGGKPPDWQDFVGIITLLIINSTISFLEENNAGNAAAALMARLAPKAKVLRDGQWREEDAAVLVPGDIISIKLGDIVPADARLLEGDPLKIDQSALTGESLPVTKGPGDGVYSGSTCKQGEIEAIVIATGVHTFFGKAAHLVDSTNQVGHFQKVLTAIGNFCICSIAIGMIIEIIVMYPIQDRKYRPGIDNLLVLLIGGIPIAMPTVLSVTMAIGSHRLSEQGAITKRMTAIEEMAGMDVLCSDKTGTLTLNKLTVDKNLIEVFAKGVDKDTVVLMAARASRTENQDAIDAAIVGMLADPKEARAGIQEIHFLPFNPTDKRTALTYIDGEGKMHRVSKGAPEQILNLAHNKSEIERRVHTVIDKFAERGLRSLAVAYQEVPEGTKDSPGGPWQFIGLMPLFDPPRHDSAETIRRALNLGVNVKMITGDQLAIGKETGRRLGMGTNMYPSSSLLGQHKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLAEIFATGIIIGSYLALMTVIFFWAAYKTDFFPRTFGVESLQHKDQDDMRKLSAAVYLQVSTISQALIFVTRSRSWSFVERPGLLLVFAFCVAQLIATIIAVYANWGFAAIKGMGWGWAGVVWLYNIIFYFPLDIIKFFIRYAMSGKAWDLVIEQRTAFTRQKDFGKEARELKWAHAQRTLHGLHPPDTKMFSERSNFTDLNQMAEEAKRRAEIARLRELNTLKGHVESVVRLKGLDIDTIQQAYTV

SEQ ID NO: 3076 - protein, 966 aa, Populus trichocarpa
MGDKGEVLEAVLKETVDLENIPIEEVLENLRCSREGLTTQAAEERLAIFGHNKLEEKKERKFLKFLGFMWNPLSWVMEAAAIMAIALANGGGKPPDWQDFVGIITLLVINSTISFIEENNAGNAAAALMARLAPKAKVLRDGRWNEQDAAVLVPGDIISIKLGDIIPADARLLEGDPLKIDQSALTGESLPVTKGPGDGVYSGSTCKQGEIEAVVIATGVHTFFGKAAHLVDTTNQVGHFQKARRYNCYMIFVLTAIGNFCICSIAIGMVIELIVMYPIQDRKYRPGIDNLLVLLIGGIPIAMPTVLSVTMAIGSHRLSQQGAITKRMTAIEEMAGMDVLCSDKTGTLTLNKLTVDKNLIEVFAKGVDADAVVLMAARASRIENQDAIDTAIVGMLADPKEARAGIQEVHFLPFNPTDKRTALTYIDSGGKMHRVSKGAPEQILNLSHNKSDIERRVHAVIDKFAERGLRSLAVAYQEVPEGRKESAGGPWQFIGLLPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWVAYKTDFFPRVFGVSTLEKTAHDDFRKLASAIYLQVSTISQALIFVTRSRSWSFVERPGLLLVVAFIIAQLIATLIAVYANWSFAAIKGIGWGWAGVIWLYNIIFYFPLDFIKFFIRYALSGRAWDLVIEQRIAFTRQKDFGKEQRELQWAHAQRTLHGLPLPDTKMFTERTHFTELNQMAEEAKRRAEIARLRELHTLKGHVESVVRLKGLDIDTIQQAYTV

SEQ ID NO: 3077 - protein, 949 aa, Glycine max
MGDKSQVLEAVLKETVDLENIPIEEVLENLRCGREGLSSEAAEERLTIFGHNKLEEKKESKFLKFLGFMWNPLSWVMEAAAIMAIALANGGGKAPDWQDFVGIITLLLINSTISFIEENNAGNAAAALMARLAPKAKVLRDGRWNEQDAAVLVPGDIISIKLGDIIPADARLLEGDPLKIDQSALTGESLPVTKGPGDGVYSGSTCKQGEIEAVVIATGVHTFFGKAAHLVDTTNQVLTAIGNFCICSIALGMVIEIIVMYPIQDRPYRSGIDNLLVLLIGGIPIAMPTVLSVTMAIGSHRLAQQGAITKRMTAIEEMAGMDVLCSDKTGTLTLNKLTVDKNLVEVFAKGVDPDTVILMAARASRLENQDAIDTAIVGMLADPKEARAGIQEVHFLPFNPTDKRTALTYLDQDGKMHRVSKGAPEQILNLAHNKADIERRVHSVIDKFAERGLRSLAVAYQEVPDGRKESAGGPWQFIGLLSLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVPTLEKTAHDDYRKLASAIYLQVSTISQALIFVTRSRGWSYVERPGLLLVFAFIVAQLIATLIAVYGNWSFCSIEGIGWGWAGVIWLYNIIFYIPLDIIKFLIRYALSGRAWDLVIEQRIAFTRQKDFGKEQRELQWAHAQRTLHGLQPADTKFNERTHVNELNQMAEEAKRRAEIARLRELHTLKGHVESVVRLKGLDIDTIQQAYTV

SEQ ID NO: 3078 - protein, 956 aa, Pseudotsuga menziesii
MADKAATLEAINKEAVDLENIPIEEVFENLRCSREGLSSQAAQERLTIFGYNKLEEKKESKFLKFLGFMWNPLSWVMEAAAVMAIALANGGGKPPDWQDFVGILTLLVINSTISFIEENNAGNAAAALMARLAPKSKILRDGQWSEEDAAVLVPGDIISIKLGDIVPADARLLEGDPLKIDQSALTGESLPVTKGPGDGVYSGSTCKQGELECVVIATGVHTFFGKAAHLVDSTNQVGHFQKVLTAIGNFCICSIAIGMIIEIIVMYPIQDRHYRPGIDNLLVLLIGGIPIAMPTVLSVTMAIGSHRLAQQGAITKRMTAIEEMAGMDVLCSDKTGTLTLNKLTVDKNLIEVFTKGYDKDTVVLLAARASRIENQDAIDAAIVGMLADPKEARAGIQEVHFLPFNPTDKRTALTYVDNEGKMHRASKGAPEQILNLAHNKSEIERRVHTVIDKFAERGLRSLAVAYQEVPEGRKESPGGPWHLIGLMPLFDPPRHDSAETIRRALNLGVNVKMITGDQLAIAKETGRRLGMGTNMYPSSTLLGQDKDESIAALPVDDLIEKADGFAGVFPEHKYEIVKRLQARKHICGMTGDGVNDAPALKKADIGIAVADATDAARGASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGIIIGSYLALMTVIFFWAAYKTDFFPRTFGVASLQKKDQDDIRKLSAAVYLQVSTVSQALIFVTRSRSWSFMERPGLLLVFAFCVAQLIATLIAVYANWGFAAIEGMGWGWAGVVWLYNIIFYFPLDIIKFFIRYALSGKAWDLVIEQRTAFTRQKDFGKEARELKWAHAQRTLHGLHTTDTKMFSERGNFTDLNQMAEEAKRRAEIARLRELHTLKGHVESVVRLKGLDIDTIQQAYTV

SEQ ID NO: 3079 - protein, 967 aa, Brachypodium distachyon
MDEKASNLDAVLKESVDLENIPLEEVFENLRCSREGLSSTQAEQRLAIFGPNKLEEKKESKFLKFLGFMWNPLSWVMEAAAIMAIALANGGGKPPDWQDFVGIITLLIINSTISFIEENNAGNAAAALMARLAPKAKVLRNGRWNEEESAILVPGDIISVKLGDIIPADARLLEGDPLKIDQSSLTGESLPVTKGPGDGVYSGSTCKQGEIEAVVIATGVHTFFGKAAHLVDSTNQVGHFQKASFCSLFLDLFVLTAIGNFCICSIAVGMVIEIVVMYPIQHRAYRPGIDNLLVLLIGGIPIAMPTVLSVTMAIGSHRLAQQGAITKRMTAIEEMAGMDVLCSDKTGTLTLNKLTVDKNLIEVFQRGVDQDTVILMAARASRTENQDAIDATMVGMLADPKEARAGIQEVHFLPFNPTDKRTALTYLDGEGKMHRVSKGAPEQILELAYNKSEIERRVRVVIDKFAERGLRSLGVAYQEVPDGRKESPGGPWQFIGLLPLFDPPRHDSAETIRRALNLGVNVKMITGDQLAIGKETARRLGMGTNMYPSSALLGQHKDESIVALPVDELIEKADGFAGVFPEHKYEIVKRLQARKHICGMTGDGVNDAPALKKADIGIAVDDSTDAARSASDIVLTEPGLSVIISAVLTSRAIFQRMKNYTIYAVSITIRIVLGFMLLALIWQFDFPPFMVLIIAILNDGTIMTISKDRVKPSPQPDSWKLSEIFATGVVLGSYLAMMTVIFFWAAYKTDFFPRVFHVESLEKTAQDDFQKLASAIYLQVSTISQALIFVTRSRSWSFMERPGFLLVFAFLVAQLIATLIAVYADWGFAAIKGIGWGWAGVIWLYNIVFYLPLDVIKFLIRYALSGRAWDLVLDQRIAFTRKKDFGREERELKWATAQRTLHGLQPPESTTFQGMTSYSELNQLADEARRRAEIARLRELNTLKGRMESVVRQKGLDLETIQQSYTV

SEQ ID NO: 3080 - protein, 956 aa, Gossypium hirsutum
MENKDETLDAVLKEAVDLENVPLEEVFQTLRCNRDGLTTEAAEQRLSIFGYNKLEEKQESKILKFLGFMWNPLSWVMEAAAIMAIALANGGGKPPDWQDFVGIITLLIINSTISFIEENNAGNAAAALMARLAPKAKVFRDGKWSEEEASILVPGDVISIKLGDIIPADARLLDGDPLKIDQSSLTGESLPVTKGPGDSIYSGSTCKQGEIEAVVIATGVHTFFGKAAHLVDSTNQQGHFQKVLTAIGNFCICSIAVGMITEIIVMYPIQDREYRPGIDNLLVLLIGGIPIAMPTVLSVTMAIGSHRLSLQGAITKRMTAIEEMAGMDVLCSDKTGTLTLNKLSVDKNLIEIFAKGVDPDTVVLMAARASRLENQDAIDAAIVGMLADPKEARAGIQEVHFLPFNPTDKRTALTYIDNQGRMHRVSKGAPEQILNLAHNKSELERRVHAVIDKFAERGLRSLAVAYQEVPDGRKESSGGPWQFIGLMPLFDPPRHDSADTIRRALNLGVNVKMITGDQLAIAKETGRRLGMGTNMYPSSSLLGQNKEESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGIILGGYLAMMTVIFFWAAYKTDFFPRTFGVKSLQKTDRKDIKMLASAVYLQVSIISQALIFVTRARSWSFLERPGLLLVLAFVVAQLIATLIAVYANWGFAAIEGIGWGWAGVIWLYNLIFYIPLDFIKFFIRYALSGKAWDLVIEQRIAFTRKKDFGKEERELKWAHAQRTLHGLQPPDTKMFGDRTSYNELNQMAEEAKRRAEIARLRELTTLKGHVESVVRLKGLDIDTIQQAYTV

SEQ ID NO: 3081 - protein, 956 aa, Triphysaria pusilla
  misc_feature (204)..(204): Xaa can be any naturally occurring amino acid
MAEKPEALDAVLKEIVDLENIPIEEVFENLRCTREGLTNEAAEERLAIFGHNKLEEKKESKVLKFLGFMWNPLSWVMEAAAIMAIALANGGGKPPDWQDFVGIITLLVINSTISFIEENNAGNAAAALMASLAPKAKVLRNGRWNEEEASVLVPGDIISIKLGDIVPADSRLLDGDPLKIDQSALTGESLPVTKSPGDGVYSGXTCKQGEIEAIVIATGVHTFFGKAAHLVDSTHQVGHFQKVLTSIGNFCICSIAVGMIIEIIVMYPIQHRDYRPGIDNLLVLLIGGIPIAMPTVLSVTMAIGSHRLAQQGAITKRMTAIEEMAGMDVLCSDKTGTLTLNKLTVDKNLIEVFTKGIDADTVVLMAARASRTENQDAIDAAIVGMLADPKEARAGIREIHFLPFNPTDKRTALTYIDGEGKWHRVSKGAPEQIIHLAHNKSDIERRAHAVIDKFAERGLRSLAVAYQEVPEGTKESPGGPWQFIGLMPLFDPPRHDSAETIRRALNLGVNVKMITGDQLAIGKETGRRLGMGTNMYPLSALLGKNKDESIAALPIDELIEKADGFAGVFPEHKYEIVKRLQALKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFATGVVLGGYLAMMTVIFFWAAYKTDFFPSVFGVSTLEKTAHDDFRKLASAIYLQVSTISQALIFVTRSRSWSYVERPGLLLVAAFIVAQLVATLIAVYASWSFAAIEGIGWGWAGVIWLYNIITYIPLDILKFLIRYALSGRAWDLVFERRIAFTRQKDFGKEQRELKWAHAQRTLHGLEVPDTKMFGETNNFSELNQLAEEAKRRAEIARLRELHTLKGHVESVVRLKGLDIETIQQSYTV

SEQ ID NO: 3082 - protein, 956 aa, Manihot esculenta
MGDKDETLEAVLKEAVDLENVPIEEVFQTLRCNSNGLTTEAAEQRLAIFGYNKLEEKQESKILKFLGFMWNPLSWVMEAAAIMAIALANGGGKPPDWQDFVGIITLLLINSTISFIEENNAGNAAAALMARLAPKAKILRDGSWIEDDASILVPGDIISIKLGDILPADARLLEGDPLKIDQSALTGESLPVTKGPGDSVYSGSTCKQGEIEAVVIATGVHTFFGKAAHLVDTTNQVGHFQKVLTAIGNFCICSIAMGMIIEIIVMYPIQHRKYRPGIDNLLVLLIGGIPIAMPTVLSVTMAIGSHRLSQQGAITKRMTAIEEMAGMDVLCSDKTGTLTLNKLTVDKNLIEILAKGVDADTVVLMAARASRVENQDAIDAAIVGMLADPKEARANIQEIHFLPFNPMDKRTALTYIDSEGKMHRVSKGAPEQILNLVHNKSEVERRVHAVIDKFAERGLRSLAVAYQDVPDGRKESSGGPWQFIGLMPLFDPPRHDSADTIRRALNLGVNVKMITGDQLAIAKETGRRLGMGTNMYPSSALLGHNKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPQPDSWKLAEIFTTGIILGGYLAMMTVIFFWAAYRTDFFPKTFGVSSLQKKDEEDFRKLASAVYLQVSTISQALIFVTRSRSWSFIERPGLLLVAAFVVAQLIATLIAVYANWSFAAIEGTGWGWAGVVWLYNLIFYFPLDFIKFIVRYALSGKAWDLVIEQRIAFTRKKDFGKEERELKWAHAQRTLHGLHPPDTKMFHERSNYTELNQMAEEAKRRAEIARLRELHTLKGHVESVVRLKGLDIDTIQQAYTV

SEQ ID NO: 3083 - protein, 966 aa, Populus trichocarpa
MGEKAEVLEAVLKETVDLENIPIEEVFENLRCSREGLTSQAAEERLSIFGHNKLEEKKERKFLKFLGFMWNPLSWVMEAAAIMAIALANGGGKPPDWQDFVGIITLLFINSTISFIEENNAGNAAAALMARLAPKAKVLRDGRWSEQDAAVLVPGDIISIKLGDIIPADARLLEGDPLKIDQSALTGESLPVTKGPGDGVYSGSTCKQGEIEAVVIATGVHTFFGKAAHLVDTTNQVGHFQKARRYNCYMFFVLTAIGNFCICSIAIGMIIELIVMYPIQDRQYRPGIDNLLVLLIGGIPIAMPTVLSVTMAIGSHRLSQQGAITKRMTAIEEMAGMDVLCSDKTGTLTLNKLTVDKNLIEVFAKGVDADTVVLMAAQASRIENQDAIDTAIVGMLADPKEARAGIQEVHFLPFNPTDKRTALTYIDSGGIMHRVSKGAPEQILNLAHNKSDIERRVHAVIDKFAERGLRSLAVAYQKVPEGRKESAGGPWQFIGLMPLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVSTLEKTAHDDFRKLASAIYLQVSTISQALIFVTRSRSWSYVERPGILLVVAFVIAQLIATLIAVYANWSFAAIEGIGWGWAGVIWLYNIVFYIPLDLIKFIIRYALSGRAWDLVIEQRIAFTTQKDFGKEQRELQWAHAQRTLHGLQAPDTKMFTERTHFTELNHMAEEAKRRAEIARLRELHTLKGHVESVVRLKGLDIDTIQQAYTV

SEQ ID NO: 3084 - protein, 956 aa, Gossypium hirsutum
MENKDETMDAVLKEAVDLENVPLEEVFQTLRCNRDGLTTEAAEQRLSIFGYNKLEEKQESKILKFLGFMWNPLSWVMEAAAIMAIALANGGGKPPDWQDFVGIITLLTINSTISFIEENNAGNAAAALMARLAPKAKVFRDGKWSEEEASILVPGDIISIKLGDIIPADARLLDGDPLKIDQSSLTGESLPVTKGPGDSIYSGSTCKQGEIEAVVIATGVHTFFGKAAHLVDSTNQQGHFQKVLTAIGNFCICSIAVGMITEIIVMYPIQDRDYRPGIDNLLVLLIGGIPIAMPTVLSVTMAIGSHRLSLQGAITKRMTAIEEMAGMDVLCSDKTGTLTLNKLSVDKNLIEIFAKGVDPDTVVLMAARAARLENQDAIDAAIVGMLADPKEARAGIQEVHFLPFNPTDKRTALTYIDNQGRMHRVSKGAPEQILNLAHNKSELERRVHAVIDKFAERGLRSLAVAYQEVPEGRKESSGGPWQFIGLMPLFDPPRHDSADTIRRALNLGVNVKMITGDQLAIAKETGRRLGMGTNMYPSSALLGQNKEESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGIILGGYLAMMTVIFFWAAYKTDFFPSTFGVKSLQKTDRKDIKMLASAVYLQVSIISQALIFVTRARSWSFLERPGFLLVLAFVVAQLIATLIAVYANWGFAAIEGIGWGWAGVIWLYNLIFYIPLDFIKFFIRYALSGKAWDLVIEQRIAFTRKKDFGKEERELKWAHAQRTLHGLQPPDTKMFGDRTSYNELNQMAEEAKRRAEIARLRELTTLKGHVESVVRLKGLDIDTIQQAYTV

SEQ ID NO: 3085 - protein, 967 aa, Populus trichocarpa
MGEKAEVLEAVLKETVDLENIPIEEVFENLRCSREGLTSQAAEERLSIFGHNKLEEKKERKFLKFLGFMWNPLSWVMEAAAIMAIALANGGGKPPDWQDFVGIITLLFINSTISFIEENNAGNAAAALMARLAPKAKVLRDGRWSEQDAAVLVPGDIISIKLGDIIPADARLLEGDPLKIDQSALTGESLPVTKGPGDGVYSGSTCKQGEIEAVVIATGVHTFFGKAAHLVDTTNQVGHFQKARRYNCYMFFVLTAIGNFCICSIAIGMIIELIVMYPIQDRQYRPGIDNLLVLLIGGIPIAMPTVLSVTMAIGSHRLSQQGAITKRMTAIEEMAGMDVLCSDKTGTLTLNKLTVDKNLIEVVFAKGVDADTVVLMAAQASRIENQDAIDTAIVGMLADPKEARAGIQEVHFLPFNPTDKRTALTYIDSGGIMHRVSKGAPEQILNLAHNKSDIERRVHAVIDKFAERGLRSLAVAYQKVPEGRKESAGGPWQFIGLMPLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVSTLEKTAHDDFRKLASAIYLQVSTISQALIFVTRSRSWSYVERPGILLVVAFVIAQLIATLIAVYANWSFAAIEGIGWGWAGVIWLYNIVFYIPLDLIKFIIRYALSGRAWDLVIEQRIAFTTQKDFGKEQRELQWAHAQRTLHGLQAPDTKMFTERTHFTELNHMAEEAKRRAEIARLRELHTLKGHVESVVRLKGLDIDTIQQAYTV

SEQ ID NO: 3086 - protein, 955 aa, Mimulus guttatus
MAANDEAMEALKREAVDLENIPIEEVFDNLRCTKEGLSSEDAIRRLEIFGYNKLEEKEESKVLKFLGFMWNPLSWVMEAAAIMAIALANGGGKPPDWQDFVGIITLLVINSTISFIEENNAGNAAAALMARLAPKAKVLRDGHWNEEDAAVLVPGDVVSIKLGDIIPADARLLDGDPLKIDQSALTGESLPATKSPGDGVYSGSTVKQGEIEAVVIATGVHTFFGKAAHLVDSTNQVGHFQKVLTAIGNFCICSIAVGMVIEIIVMYPIQHRDYRPGIDNLLVLLIGGIPIAMPTVLSVTMAIGSHRLSQQGAITKRMTAIEEMAGMDVLCSDKTGTLTLNKLSVDKNLIEVFSKGVDADTVVLMAARASRIENQDAIDAAIVGMLADPKEARAGIQEIHFLPFNPTDKRTALTYLDNQGKMHRVSKGAPEQILNLAYNRSEIERRVHSVIDSFAERGLRSLAVAYQEVPEGTKESPGGPWRFVGLMPLFDPPRHDSAETIRRALNLGVNVKMITGDQLAIAKETGRRLGMGTNMYPSSSLLGHNKDESIVALPVDELIEKADGFAGVFPEHKYEIVKRLQAQKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGVVLGGYLAMMTVIFFWAVYDTDFFPRVFGVKSLERTVNLNFKMLASAIYLQVSIISQALIFVTRSRSWSFIERPGLLLVGAFLVAQLIATLIAVYANWNFAAIEGIGWGWAGVIWLYNIVFYFPLDMIKFFIRYALSGKAWDLVIEQRIAFTRKKDFGKEDRELKWAQAQRTLHGLHPPEKQSGDRTNYNELNQIAEEAKRRAEMARLRELHTLKGHVESVIKMKNLDIDTIQQSYTV

SEQ ID NO: 3087 - protein, 937 aa, Castanea mollissima
NIPIEEVLENLRCSREGLTSVAAEERLVLFGHNKLEEKRESKFLKFLGFMWNPLSWVMEAAAIMAIALANGGGKPPDWQDFVGIIVLLFINSTISFIEENNVGNAAAALMARLAPKAKVLRDGRWNEQDAAILVPGDIISIKLGDIIPADARLLEGDPLKIDQSALTGESLPVTKGPGDGIYSGSTCKQGEIEAVVIATGVHTFFGKAAHLVDTTNQVGHFQKVLTAIGNFCICSIAIGMIIEIIVMYPIQDREYRPGIDNLLVLLIGGIPIAMPTVLSVTMAIGSHRLAQQGAITKRMTAIEEMAGMDVLCSDKTGTLTLNKLTVDKNLIEVFAKGVDGDTVVLMAARASRTENQDAIDSAIVGMLADPKEARAGIQEVHFLPFNPTDKRTALTYIDRDGKMHRVSKGAPEQILNLAHNKSEIERRVHAVIDKFAERGLRSLAVAYQEVPEGRKESAGSPWQFIGLMPLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWAAYKTDFFPRVFGVSTLEKNAHDDFRKLASAIYLQVSTVSQALIFVTRSRSWSFVERPGMLLVVAFIIAQLIATVIAVYANWSFAAIEGIGWGWAGVIWLYNIIFYIPLDLIKFFIRYALSGRAWDLVIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 3088 - protein, 956 aa, Prunus persica
MDGKSETLDAVLKEAVDLENVPLEEVFLTLRCNRHGLTSEAAEQRLVIFGYNKLEEKKESKVLKFLGFMWNPLSWVMEAAAIMAIALANGGGKPPDWQDFVGIITLLIINSTISFIEENNAGNAAAALMAHLAPKAKVFRGGRWIEEDASILVPGDIISIKLGDIIPADARLLDGDPLKIDQSALTGESLPVTKGPGDSVYSGSTCKQGEIEAVVIATGVHTFFGKAAHLVDTTNQQGHFQKVLTAIGNFCICSIAVGMIIEIIVMYPIQHRKYRPGIDNLLVLLIGGIPIAMPTVLSVTMAIGSHRLSQQGAITKRMTAIEEMAGMDVLCSDKTGTLTLNKLSVDKNLLEVFAKGVDADTVVLMAARASRMENQDAIDAAIVGMLADPKEARASIQEVHFLPFNPTDKRTALTYIDSQGKMHRVSKGAPEQILNLVHNKSEIERRVHTVIDKFAERGLRSLAVAYQEVPDGRKESQGGAWQFIGLMPLFDPPRHDSAETIKRALNLGVNVKMITGDQLAIAKETGRRLGMGTNMYPSSSLLGQNKDESIVTLPVDELIEKADGFAGVFPEHKYEIVKRLQARKHICGMTGDGVNDAPALKKADIGIAVADATDAARSASDIVLTEPGLSVIISAVLTSRSIFQRMKNYTIYAVSITIRIVLGFMLLALIWQFDFPPFMVLIIAILNDGTIMTISKDRVKPSPLPDSWKLSEIFTTGIILGGYLAMMTVIFFWAACKTDFFPRTFGVSSLQHKNEDDNRKLASAVYLQVSTISQALIFVTRSRSWSFVERPGLLLVAAFVIAQLIATLIAVYANWSFAAIKGIGWGWAGVVWLYNLVFYFPLDFIKFVVRYALSGRAWDLIIDQRIAFTRKKDFGKEERELKWAHAQRTLHGLHPPEANIFGDRSNYSELNQMAEEAKRRAEIARLRELSTLKGHVESVVRNKGLDIDTIQQSYTV

SEQ ID NO: 3089 - protein, 965 aa, Mimulus guttatus
MAEEKPEVLDAVLKETVDLENIPIDEVFENLRCTREGLTSEAAEERLAIFGHNKLEEKRESKFLKFLGFMWNPLSWVMEAAAIMAIALANGGGKPPDWQDFVGIITLLVINSTISFIEENNAGNAAAALMARLAPKAKILRDGRWNEEDAAMLVPGDIISIKLGDIIPADSRLLDGDPLKIDQSALTGESLPVTKGPGDGVYSGSTCKQGEIEAIVIATGVHTFFGKAAHLVDSTNQVGHFQKASFFFFFSVLTSIGNFCICSIAVGMVIEIVVMYPIQHRKYRPGIDNLLVLLIGGIPIAMPTVLSVTMAIGSHRLAQQGAITKRMTAIEEMAGMDVLCSDKTGTLTLNKLTVDKNLIEVFTKGIDADTVVLMAARASRTENQDAIDGAIVGMLADPKEARAGVREIHFLPFNPTDKRTALTYIDGEGKMHRVSKGAPEQILNLSHNKSDIERRVHAVIDKFAERGLRSLGVAYQEVPECTKESAGGPWQFVGLMPLFDPPRHDSAETIRRALNLGVNVKMITGDQLAIAKETGRRLGMGTNMYPSSALLGQNKDESIASLPVDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLGEIFATGVVLGAYLAMMTVIFFWAAYKTDFFPRVFGVSTLEKTAHDDFRKLASAIYLQVSTISQALIFVTRSRSWSYVERPGLLLVAAFFIAQLVATLIAVYANWSFAAIEGIGWGWAGVIWLYNIIFYIPLDIIKFLTRYALSGRAWDLVLEQRIAFTRQKDFGKEQRELKWAHAQRTLHGLQVPDTKLFNENNNFSELNQLAEEAKRRAEIARLRELHTLKGHVESVVRLKGLDIDTIQQAYTV

SEQ ID NO: 3090 - protein, 972 aa, Ricinus communis
MDDKSETLEAVLKEAVDLENVPIEEVFQTLRCNSNGLTTEAAEQRLTIFGYNKLEEKQESKFLKFLGFMWNPLSWVMEAAAIMAIALANGGGKPPDWQDFVGIIILLFINSTISFIEENNAGNAAAALMARLAPKAKVLRDGRWIEEDASVLVPGDIISVKLGDIIPADARLLEGDPLKIDQAIFATFLPFCCYNGLQSALTGESLPVTKGPGDSVYSGSTCKQGEIGAVVIATGVHTFFGKAAHLVDSTNQVGHFQQVLTAIGNFCICSITVGMIIEIIVMYPIQHRPYRPGIDNLLVLLIGGIPIAMPTVLSVTMAIGSHRLSQQGAITKRMTAIEEMAGMDVLCSDKTGTLTLNKLTVDKNLIEIVAKGVDTDTVVLMAARASRVENQDAIDAAIVGMLADPKEARVGIQEIHFLPFNPTDKRTALTYIDIEGKMHRVSKGAPEQILNLVHNKSEIERRVHTVIDKFAERGLRSLAVAYQEVPEGRKESSGGPWQFIGLMPLFDPPRHDSAETIRRALNLGVNVKMITGDQLAIGKETGRRLGMGTNMYPSSTLLGHNKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLAEIFTTGIILGGYLAMMTVIFFWAAYSTDFFPRTFGVSSLQKKDDDDFRKLASAIYLQVSTISQALIFVTRARSWSFVERPGLLLVAAFVIAQLIATLIAVYANWSFAAIEGIGWGWAGVVWLYNLIFYFPLDFIKFIIRYALSGKAWDLVIEQRIAFTRKKDFGKEERELKWAHAQRTLHGLHPPDIKMFNDRSSYTELNQMAEEAKRRAEIARLRELHTLKGHVESVVRLKGLDIDTIQQAYTV

SEQ ID NO: 3091 - protein, 940 aa, Helianthus annuus
LQESIPIEEVFENLRCSKEGLTTAAAEERLVIFGHNKLEEKKESKFLKFLGFMWNPLSWVMEAAAIMAIALANGGGKPPDWQDFVGIITLLIINSTISFIEENNAGNAAAALMARLAPKAKILRDGKWNEEDASMLVPGDIISIKLGDIIPADARLLDGDPLKIDQSALTGESLPVTKGPGDGVYSGSTCKQGEIEAVVIATGVHTFFGKAAHLVDSTNQVGHFQKVLTAIGNFCICSIAVGMVIEIIVMFPIQDRQYRPGIDNLLVLLIGGIPIAMPTVLSVTMAIGSHRLAQQGAITKRMTAIEEMAGMDVLCSDKTGTLTLNKLTVDKNLIEVFSKGVDADTVVLMAARASRTENQDAIDAAIVGMLADPKEARADVQELHFLPFNPTDKRTALTYLDNQGKMHRVSKGAPEQILNLAHNKSDIERRVHAVIDKFADRGLRSLAVAYQEVPEGRKESAGGPWQFIGLMPLFDPPRHDSAETIRRALNLGVNVKMITGDQLAIGKETGRRLGMGTNMYPSSALLGQNKDESTAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTDFFPRTFGVPTLEKTAHDDFRKLASAIYLQVSTISQALIFVTRSRSWSFVERPGWLLVIAFAIAQLVATLIAVYANWSFAAVEGIGWGWAGVIWLYNIVFYFPLDIIKFFIRYALSGRAWDLVIERRIAFTRQKDFGKEQRELQWAHAQRTLHGLEVPDTKMFGDRTNVTELNQMAEEAKRRAEIARLRELHTLKGHVESVVRLKGLDIETIQQAYTV

SEQ ID NO: 3092 - protein, 960 aa, Arabidopsis thaliana
MTTTVEDNREVLEAVLKEAVDLENVPIEEVFENLRCSKEGLTTQAADERLALFGHNKLEEKKESKFLKFLGFMWNPLSWVMEAAAIMAIALANGGGKPPDWQDFVGIITLLVINSTISFIEENNAGNAAAALMARLAPKAKVLRDGRWGEQDAAILVPGDIISIKLGDIVPADARLLEGDPLKIDQSALTGESLPVTKSSGDGVYSGSTCKQGEIEAVVIATGVHTFFGKAAHLVDTTNQIGHFQQVLTAIGNFCICSIAVGMLIEIVVMYPIQHRAYRPGIDNLLVLLIGGIPIAMPTVLSVTMAIGSHRLSQQGAITKRMTAIEEMAGMDVLCSDKTGTLTLNKLTVDKNLIEVFMKGVDADTVVLMAARASRLENQDAIDAAIVGMLADPKDARAGIQEVHFLPFNPTDKRTALTYIDNEGNTHRVSKGAPEQILNLAHNKSEIERRVHAVIDKFAERGLRSLAVAYQDVPEGRKDSAGGPWQFVGLMPLFDPPRHDSAETIRRALNLGVSVKMITGDQLAIGKETGRRLGMGTNMYPSSALLGQNKDESIVALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLSEIFATGVVFGSYMAMMTVIFFWVSYKTDFFPRTFGVATLEKTAHDDFRKLASAIYLQVSIISQALIFVTRSRSWSFVERPGIFLMIAFILAQLVATLIAVYANWSFAAIEGIGWGWAGVIWLYNIIFYIPLDFIKFFIRYALSGRAWDLVIEQRVAFTRQKDFGKEQRELQWAHAQRTLHGLQAPDTKMFTDRTHVSELNQMAEEAKRRAEIARLRELHTLKGHVESVVRLKGLDIETIQQAYTV

SEQ ID NO: 3093 - protein, 877 aa, Setaria italica
MAEKEGNLDAVLKEAVDLENIPLEEVFENLRCSREGLSTQQAQQRLEIFGPNKLEEKEESKFLKFLGFMWNPLSWVMEAAAIMAIALANGGGKPPDWQDFVGIITLLVINSTISFIEENNAGNAAAALMARLAPKAKVLRDGRWTEEEAAILVPGDVVSIKLGDIIPADARLLEGDPLKIDQSALTGESLPVTKGPGDGVYSGSTVKQGEIEAVVIATGVHTFFGKAAHLVDSTNQVGHFQKVLTSIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLTVDKNLVEVFERGITQDQVILMAARASRTENQDAIDTAIVGMLADPKEARAGIQEVHFLPFNPTDKRTALTYIDSDGKMFRVSKGAPEQILHLAHNKSEIERRVHAVIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTDFFPRIFHVESLEKTAQDDFQKLASAVYLQVSTVSQALIFVTRSRSWSFVERPGFLLVFAFLVAQLIATLIAVYADWAFTSIKGIGWGWAGIVWLYNIIFYFPLDIIKFLIRYVLSGKAWDLVIEQRIAFTRKKDFGGS

SEQ ID NO: 3094 - protein, 956 aa, Glycine max
MAEKEEAMRVVLKEAVDLENVPLEEVFQTLRCDSNGLTTESAEERLAIFGHNKLEEKKESKVLKFLGFMWNPLSWVMEAAAIMAIALANGGGKPPDWQDFVGIITLLIINSTISFIEENNAGNAAAALMARLAPKAKFLRDGKWVEEDASILVPGDIISVKLGDIIPADARLLEGDPLKIDQSALTGESLPVTKGHGDSVYSGSTCKQGEINAVVIATGVHTFFGKAAHLVDSTNQVGHFQKVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDASIVGMLGDPKEARAGIQEVHFLPFNPTDKRTAITYIDSESKMHRVSKGAPEQILNLARNKSEIERRVHSVIDKFADRGLRSLAVAYQEVPDGKKESQGGPWQFIGLLPLFDPPRHDSAQTIRRALNLGVNVKMITGDQLAIGKETGRRLGMGTNMYPSSALLGQNKDESIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTVSQALIFVTRARSWSFVERPGLLLVAAFVIAQLIATLIAVYANWSFAAIEGIGWGWAGVVWLYNLVFYIPLDFIKFIIRYALSGRAWDLVIEQRIAFTRKKDFGKEERELKWAHAHRTLHGLHPPETKMFNERTSYTELNQMAEEARRRANIARLRELHTLTGHVESVFRLKGLDIDTIQQAYTI

SEQ ID NO: 3095 - protein, 972 aa, Theobroma cacao
MENNNETLDAVLKEAVDLENVPLEEVFQTLRCNKDGLTTEAAEQRLAIFGYNKLEEKKESKILKFLGFMWNPLSWVMEAAAIMAIALANGGGKPPDWQDFVGIITLLFINSTISFIEENNAGNAAAALMARLAPKAKVFRDGKWIEEDAAILVPGDIISIKLGDIIPADARLLDGDPLKIDQSALTGESLPVTKGPGDSIYSGSTCKQGEIEAVVIATGVHTFFGKAAHLVDSTNQQGHFQKVLTAIGNFCICSIAVGMITEIIVMYPIQHREYRPGIDNLLVLLIGGIPIAMPTVLSVTMAIGSHRLSLQGAITKRMTAIEEMAGMDVLCSDKTGTLTLNKLSVDKNLVEIFAKGVDPDTVVLMAARASRLENQDAIDAAIVGMLADPKEARAGIQEVHFLPFNPTDKRTALTYIDNQGRMHRVSKGAPEQILNLAHNKSELERRVHAVIDKFAERGLRSLAVAYQEVPDGRKESSGGLWQFIGLMPLFDPPRHDSADTIRRALNLGVNVKMITGAYPYIDTASNYLNALGDQLAIAKETGRRLGMGTNMYPSSALLGQNKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPQPDSWKLAEIFATGVILGGYLAMMTVIFFWAAYETDFFPRTFGVSSLQQKDHDDMRKLASAIYLQVSIISQALIFVTRARSWSYVERPGLLLVTAFVAAQLIATLIAVYANWSFAAIEGIGWGWAGVIWLYNLVFYIPLDFIKFFIRYALSGKAWDLVIEQRIAFTRKKDFGKEERELKWAHAQRTLHGLQAPDTKMFSDRTSFTELNQMAEEAKRRAEIARLRELTTLKGHVESVVRLKGLDIDTIQQAYTV

SEQ ID NO: 3096 - protein, 880 aa, Panicum virgatum
WVMEAAAIMAIVLANGGGKPPDWQDFVGIITLLLINSTISFIEENNAGNAAAALMARLAPKAKVLRDGHWTEEEAAILVPGDIISIKLGDIIPADARLLDGDPLKIDQSALTGESLPVTKGPGDGVYSGSTVKQGEIEAVVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFERGVTQDQVILMAARASRIENQDAIDTAIVGMLADPKEARAGIQEVHFLPFNPTDKRTALTYIDSDGKMYRVSKGAPEQILNLAYNKTEIERRVHAVIDKFAERGLRSLAVAYQEVPDGRKESPGGPWHFVALMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLNVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTAQDDYQKLASAVYLQVSTISQALIFVTRSRSWSFVERPGFLLVFAFLVAQLIATLIAVYANWGFTSIKGIGWGWAGVVWLYNLVFYFPLDILKFLIRYALSGKAWDLVIEQRIAFTRKKDFGKEERELKWAHAQRTLHGLQPPDAKLFPERVNELNQMAEEAKRRAEIARLRELHTLKGHVESVVKLKGLDIDTIQQSYTV

SEQ ID NO: 3097 - protein, 956 aa, Fragaria vesca
MDEKAEGLEVVVKEAVDLEHVPIEEVFLTLRCDEHGLTSEAAQQRLALFGYNKLEEKKESKVLKFLGFMWNPLSWVMEAAAIMAIALANGGGKPPDWQDFVGIITLLVINSTISFIEENNAGNAAAALMARLAPTAKVLRDGKWIEEDASILVPGDIISIKLGDILPADARLLDGDPLKIDQSSLTGESLPVTKSPGDSVYSGSTCKQGEIEAVVIATGVHTFFGKAAHLVDSTNQQGHFQQVLTAIGNFCICSIAVGMIIEIIVMYPIQHRSYRPGIDNLLVLLIGGIPIAMPTVLSVTMAIGSHRLAEQGAITKRMTAIEEMAGMDVLCSDKTGTLTLNKLTVDKTLLEVFVKGVDVDTVVLMAARASRIENQDAIDAAIVGMLADPKEARANIREVHFLPFNPTDKRTALTYIDLEGKMHRVSKGAPEQILNLVHNKSELERKVHVMIDKYAERGLRSLAVAYQEVPEGRKESLGGPWQFIALVPLFDPPRHDSAETIQRALNLGVNVKMITGDQLAIAKETGRRLGMGTNMYPSSALLGQKKDESVAGLPVDELIEKADGFAGVFPEHKYEIVKRLQAKGHICGMTGDGVNDAPALKKADIGIAVADATDAARSASDIVLTEPGLSVIISAVLTSRAIFQRMKNYTIYAVSITIRIVLGFMLLALIWHFDFPPFMVLIIAILNDGTIMTISKDRVKPSPMPDSWKLAEIFATGIILGTYLAVMTVIFFWAAYDTDFFPRHFGVPSLHRKDNDSYRKLAAAVYLQVSTISQALIFVTRARSWSILERPGLLLVAAFVIAQLIATLIAVYADWSFAAIEGIGWGWAGVVWLYNLVFYLPLDILKFIIRYALSGRAWDLVFEQRIAFTRKKHFGKEERELRWAHAQRTLHGLQPPDSKKFGERSSYTELNQMAEEAKRRAEIARLREFGTLKGHVESVVRMKGLDIDTIQQSYTV

SEQ ID NO: 3098 - protein, 888 aa, Aristolochia fimbriata
MWNPLSWVMEAAAIMAIALANGGGKPPDWQDFVGIITLLIINSTISFIEENNAGNAAAALMARLAPKAKVLRDGRWSEQDAAVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIVEIIVMYPIQDRQYRPGIDNLLVLLIGGIPIAMPTVLSVTMAIGSHRLSQQGAITKRMTAIEEMAGMDVLCSDKTGTLTLNKLTVDKNLVEVFAKGVDQDTVILMAARASRTENQDAIDTAIVGMLADPKEARAGIQEVHFLPFNPTDKRTALTYFDKDGKMHRVSKGAPEQILNLAHNKSDIERRVHSVIDKFAERGLRSLAVAYQEVPDGRKESPGGPWQFIGLMPLFDPPRHDSAETIRRALNLGVNVKMITGDQLAIGKETGRRLGMGTNMYPSSALLGQNKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFATGIILGSYLAMMTVIFFWAAYKTDFFPHTFGVASLHQKSQEDTKKLASAVYLQVSTISQALIFVTRSRTWSFVERPGLMLVSAFMIAQLVATLIAVYANWGFAAIKGIGWGWAGVIWLYNIIFYFPLDIIKFVIRYALSGRAWDLVIEQRIAFTRQKDFGKEARELKWAHAQRTLHGLQPPDTKMFNDRTNFTDLNQMAEEAKRRAEIARLRELHTLKGHVESVVRLKGLDIDTIQQAYTV

SEQ ID NO: 3099 - protein, 888 aa, Pinus taeda
MWNPLSWVMEAAAVMSIALANGGNKPPDWQDFVGIIALLLINSTISFIEENNAGNAAASLMAQLAPKAKVLRDGRWSEEDAACLVPGDIISIKLGDIVPADARLLEGDPLKIDQSALTGESLPVTKNPGDGVYSGSTCKQGELEAVVIATGVHTFFGKAAHLVDSTNNVGHFQKVLTAIGNFCICSIAVGMAVEIIVQYPIQGRPYRPGIDNLLVLLIGGIPIAMPTVLSVTMAIGSHRLSQQGAITKRMTAIEEMAGMDVLCSDKTGTLTLNKLTVDKTAVEVFAKGVDKDALLLMAARASRIENQDAIDAAVVGVLADPKEARAGIQEVHFLPFNPTDKRTALTYIDREGRMHRVSKGAPEQILALAHNKSEIQRRVHTVIDKYAERGLRSLAVAYQEVPDGKKESPGGPWQFIGLMPLFDPPRMDSAETIRRALDLGVSVKMITGDQLAIGKETGRRLGMGTNMYPSSSLLGQAKDAAAEAVNIDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVVGFMLLALIWKFDFPPFMVLIIAILNDGTIMTISKDRVKPSPLPDNWNLSEIFATGIIIGSYLAMMTVIFFWVTFKTDFFPRTFGVSSLHIPSEENTQKLNSAVYLQVSTISQALIFVTRSRSWSFAERPGLLLVTAFAIAQLGATLIAVYLDLDFASIRGIGWGWAGVIWLYNIIFYFPLDLIKFAIRYAISGRAWDLLIQQRVAFTTQKDFGREAREIKWAHAQRTLHGLETPDTKLFGDRSTFRELNQMAEEAKRRAEIARLREINTLKGHVESVVRLKGLDINTIQQSYTV

SEQ ID NO: 3100 - protein, 725 aa, Manihot esculenta
MAFTRVLLASKERLKQWLLPLASTPSLGRLLTLWIPRTKLVTSKRQGDRDKIVLTAIGNFCICSIAVGMVIEIVVMYPIQDREYRPGIDNLLVLLIGGIPIAMPTVLSVTMAIGSHRLSQQGAITKRMTAIEEMAGMDVLCSDKTGTLTLNKLTVDKNLVEVFAKGVDADTVVLMAARASRTENQDAIDSAIVGMLADPKEILNLAHNRSDIERRVHAVIDKFAERGLRSLAVAYQEVPERRKESLGGPWQFIGLLPLFDPPRHDSAETIRRALNLGVNVKMITGDQLAIGKETGRRLGMGTNMYPSSALLGHDKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWAAYKTDFFPRIFGVSTLEKTAHDDFRKLASAIYLQVSTISQALIFVTRSRSWSYVERPGILLMVAFLAAQLVATLIAVYANWSFAAIEGIGWGWAGVIWLYNIIFYIPLDFIKFFIRYALSGRAWDLVIEQRIAFTTQKDFGKEQRELQWAHAQRTLHGLQPPDTKMFTERTHFTELNQMAEEAKRRAEIARLRELHTLKGHVESVIRLKGIDIDTIQQAYTV

SEQ ID NO: 3101 - protein, 892 aa, Setaria italica
FLGFMWNPMSWVMEAAAIMAIALANGGGKPPDWPDFVGIITLLIINSTISFSEENNAGNAAAALMARLAPKAKVLRNGRWTEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIALGMLVELIVMYPIQRRAYRPGIDNLLVLLIGGIPIAMPTVLSVTMAIGAHRLAQQGAITKRMTAIEEMAGMDVLCSDKTGTLTLNKLTVDKSLIEVFQRGVDQDTVILMAARASRTENQDAIDATIVGMLADPKEARAGVQEIHFLPFNPTDKRTALTYLDGEGRMHRVSKGAPEQILHLAHNKSDIERRVRAVIDKFAERGLRALGVAYQEVPDGRKESPGGPWQFIGLLPLFDPPRHDSAETIRRALDLGVNVKMITGDQLAIGKETARRLGMGTNMYPSSALLGQHKDESIVSLPVDELIEQADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTDFFPRVFGVESLEKTAQDDFQKLASAVYLQVSTISQALIFVTRSRSWSFVERPGFLLVFAFLVAQLIATLIAVYANWAFAAIKGIGWGWAGVIWLYNVVFYFPLDVIKFLTRYALSGRAWDLVLEQRIAFTRKKDFGREERELKWAHAQRTLHGLQAPEASIFENKTTFNELNQLAEEARRRAEMARLREVNTLKGKMESVVRQKGLDMETIQQSYTV

SEQ ID NO: 3102 - protein, 949 aa, Zea mays
MGTTEDKASNLDAVLKEAVDLENIAIQEVFESLRCSPQGLSTEQAEQRLAIFGPNKLEEKQESKFLKFLGFMWNPLSWVMEAAAIMAIALANGGNKPPDWQDFVGIITLLIINSTISFIEENNAGNAAAALMARLAPKAKVLRNGRWAEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMLVEIIVMYPIQHRAYRSGIDNLLVLLIGGIPIAMPTVLSVTMAIGAHRLAQQGAITKRMTAIEELAGMDILCSDKTGTLTLNKLTVDKSLVEVFQRGVDQDTVILMAARASRTENQDAIDATIVGMLADPKEARAGVQEIHFLPFNPTDKRTALTYLDGEGRMHRVSKGAPEQILHLAHNKTDIETRVRAVIDNFAERGLRALGVAYQEVPDGRKESPGGPWEFMGLLPLFDPPRKDSADTISKALDLGVNVKMITGDQLAIGKETARRLGMGTNMYPSSALLEQNKDESIASLPIDELIETADGFAGVFPEHKYEIVKRLQARKHICGMTGDGVNDAPALKKADIGIAVADSTDAARSASDIVLTEVGLSVIISAVLTSRAIFQRMKNYTIYAVSITIRIVLGFMLLALIWKFDFPPFMVLIIAILNDGTIMTISKDRVKPSPQPDSWKLAEIFATGVVLGTYLAMMTVIFFWAAYKTDFFPRLFHVESLAHDDFQMLASAVYLQVSTISQALIFVTRSRSWSFVERPGFLLVSAFLVAQLIATLIAVYANWAFAAIKGIGWGWAGVIWLYNIVCYLPLDIIKFLIRYALSGRAWNLVLEQRIAFTSKKNFGAEERERRWAHAQRSLHGLELQPPEAASMFENKTSFSEVNQLAEEARRRAEMARSDCCLSSISTERGDQTLHCPV

SEQ ID NO: 3103 - protein, 888 aa, Glycine max
MWNPLSWVMEAAAIMAIALANGGGKPPDWQDFVGIITLLIINSTISFIEENNAGNAAAALMARLAPKAKFLRDGKWIEEDASILVPGDIISVKLGDIIPADARLLEGDPLKIDQSALTGESLPVTKGPGDSVYSGSTCKQGEINAVVIATGVHTFFGKAAHLVDSTNQVGHFQKVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDAAIVGMLGDPKEARAGIQEVHFLPFNPTDKRTAITYIDGESKMHRVSKGAPEQILNLARNKSEIERRVHSVIDKFAERGLRSLAVAYQEVPDGKKESQGGPWQFIGLLPLFDPPRHDSAETIRRALNLGVNVKMITGDQLAIGKETGRRLGMGTNMYPSSALLGQNKDEAIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWHFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTISQALIFITRARSWSYVERPGLLLVAAFVIAQLIATLIAVYANWSFAAIEGIGWGWAGVVWLYNLIFYIPLDFIKFIIRYALSGRAWDLVIEQRIAFTRKKDFGKEERELKWAHAQRTLHGLHPPETKMFNERTSYTELNQMAEEARRRAEIARLRELHTLKGRVESVVRLKGLNIDTIQQAYTV

SEQ ID NO: 3104 - protein, 933 aa, Glycine max
MAEKEEAMRVVLKEAVDLENVPLEEVFQTLRCDSNGLTTESAEERLAIFGHNKLEEKKESKVLKFLGFMWNPLSWVMEAAAIMAIALANGGGKPPDWQDFVGIITLLIINSTISFIEENNAGNAAAALMARLAPKAKFLRDGKWVEEDASILVPGDIISVKLGDIIPADARLLEGDPLKIDQSALTGESLPVTKGHGDSVYSGSTCKQGEINAVVIATGVHTFFGKAAHLVDSTNQVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDASIVGMLGDPKEVGSYMIIYITFSCLQNMLFNLIVVILNLARNKSEIERRVHSVIDKFADRGLRSLAVAYQEVPDGKKESQGGPWQFIGLLPLFDPPRHDSAQTIRRALNLGVNVKMITGDQLAIGKETGRRLGMGTNMYPSSALLGQNKDESIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTVSQALIFVTRARSWSFVERPGLLLVAAFVIAQLIATLIAVYANWSFAAIEGIGWGWAGVVWLYNLVFYIPLDFIKFIIRYALSGRAWDLVIEQRIAFTRKKDFGKEERELKWAHAHRTLHGLHPPETKMFNERTSYTELNQMAEEARRRANIARLRELHTLTGHVESVFRLKGLDIDTIQQAYTI

SEQ ID NO: 3105 - protein, 884 aa, Podocarpus macrophillus
MWNPLSWVMEAAAVMAIALANGGGKPPDWQDFVGIITLLFINSTISFIEENNAGNAAAALMARLAPKAKVLRDGRWSEEDAAVLVPGDIISIKLGDIIPADARLLDGDPLKIDQSALTGESLPVSKGPGDGIYSGSTCKQGEIEAIVIATGVHTFFGKAAHLVDTTNQVGHFQKVLTAIGNFCICSIAVGMIVEIIVMYPIQDRKYRPGIDNLLVLLIGGIPIAMPTVLSVTMAIGSHRLSQQGAITKRMTAIEEMAGMDVLCSDKTGTLTLNKLSVDKNLIEVFAKGVDKDTVVLMAARASRTENQDAIDAAIVGMLADPKEARAGIKEVHFLPFNPTDKRTALTYIDSEGKMHRVSKGAPEQILNLAHNKSEIERRVHTVIDKFAERGLRSLAVAYQEVHEGTKESPGGPWQFIGLLPLFDPPRHDSAETIRRALNLGVNVKMITGDQLAIAKETGRRLGMGTNMYPSSSLLGQEKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWRFDFPPFMVLIIAILNDGTIMTISKDRVKPSPLPDSWKLAEIFATGIIIGSYLALMTVIFFWAAYKTDFFPRTFGVESLQHKNGKLSAAVYLQVSTVSQALIFVTRSRSWSFVERPGLLLFFAFCVAQLIATIIAVYANWGFAAIEGMGWGWAGVVWLYNIIFYFPLDIIKFFIRYALSGKAWDLVFEQRTAFTRQKDFGKEARELKWAHAQRTLHGLHPPDTKMFGERSNFTEINQMAEEAKRRAEIARLRELNTLKGHVESVVRMKGLDIDTIQQSYTV

SEQ ID NO: 3106 - protein, 948 aa, Cleome gynandra
MSSLEDIKNETVDLEKIPIEEVFQQLKCSREGLTSQEGEDRLQIFGPNKLEEKKESKLLKFLGFMWNPLSWVMEAAAIMAIALANGGGKPPDWQDFVGIVCLLVINSTISFIEENNAGNAAAALMAGLAPKTKLLRDGKWSEQEAAILVPGDIISIKLGDIIPADARLLEGDPLKVDQSALTGESLPVTKHPGDEVFSGSTCKQGEIEAVVIATGVHTFFGKAAHLVDSTNNVGHFQKVLTAIGNFCICSIAVGMLIEIIVMYPIQHRKYRDGIDNLLVLLIGGIPIAMPTVLSVTMAIGSHRLSQQGAITKRMTAIEEMAGMDVLCSDKTGTLTLNKLSVDKNLVEVFAKGVDKDQVILFAARASRVENQDAIDAAMVGMLADPKEARAGIREVHFLPFNPVDKRTALTYIDSDGNWHRVSKGAPEQILDLCKARDDLRKKVHAVIDKYAERGLRSLAVARQVVPEKTKESPGGPWEFVGLLPLFDPPRHDSAETIRRALNLGVNVKMITGDQLAIGKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKFDFSAFMVLIIAILNDGTIMTISKDRVKPSPTPDSWKLKEIFATGVVLGGYLAIMTVIFFWAMYKTDFFSDKFGVKSIRNSPDELMAALYLQVSIISQALIFVTRSRSWSFVERPGMLLMVAFLIAQLIATIIAVYADWEFAKIKGIGWKWAGVIWLYSLVTYFPLDIMKFAIRYILSGKAWTNLFENKTAFTSKKDYGKEEREAQWALAQRTLHGLQPKEAVNIFPEKGNYRELSEIAEQAKRRAEIARLRELHTLKGHVESVVKLKGLDIDTPGHYTV

SEQ ID NO: 3107 - protein, 954 aa, Manihot esculenta
MATKGGISLEEIKNESVDLERIPIEEVFEQLKCTREGLTSEEGANRLQVFGPNKLEEKKESKILKFLGFMWNPLSWVMEAAAIMAIALANGDGRPPDWQDFVGIVALLFINSTISFIEENNAGNAAAALMAGLAPKTKVLRDGRWTEQEAAILVPGDIISIKLGDIIPADARLLEGDPLKVDQSALTGESLPVTKNPSDEVFSGSTCKQGEIEAVVIATGVHTFFGKAAHLVDSTNQVGHFQKVLTAIGNFCICSIAVGIIIEIIVMYPIQHRKYRQGIDNLLVLLIGGIPIAMPTVLSVTMAIGSHRLSQQGAITKRMTAIEEMAGMDVLCSDKTGTLTLNKLTVDRTLIEVFAKGVDKEYVILLAARASRTENQDAIDAAIVGMLADPKEARAGIRELHFLPFNPVDKRTALTYIDSDGNWHRVSKGAPEQILGLCNSKEDVKKKVHAVIDKFAERGLRSLAVARQEVPEKSKDSPGGPWQLVGLLPLFDPPRHDSAETIRRALNLGVNVKMITGDQLAIGKETGRRLGMGTNMYPSSSLLGQDKDASIAALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKYDFAPFMVLIIAILNDGTIMTISKDRVKPSPMPDSWKLKEIFSTGIVLGGYLALMTVIFFWAMYDTDFFTDKFGVRSLHGREREMMAALYLQVSIVSQALIFVTRSRSWSFVERPGLLLVSAFVVAQLVATLIAVYANWGFARIEGCGWGWAGVIWLYSLVTYVPLDLLKFAIRYILSGKAWDNLLENKTAFTTKKDYGKEEREAQWATAQRTLHGLQPPESSNLFADKNSYRELSEIAEQAKRRAEVARLRELHTLKGHVESVVKLKGLDIDTIQQHYTV

SEQ ID NO: 3108 - protein, 952 aa, Populus trichocarpa
MAKAFSLEEIKNENVDLEKIPVEEVFEQLKCTKEGLTSEEGANRLQIFGPNKLEEKKESKFLKFLGFMWNPLSWVMEAAAIMAIALANGDGRPPDWQDFVGITCLLVINSTISFIEENNAGNAAAALMAGLAPKTKVLRDGKWTEEDAAILVPGDIISVKLGDIIPADARLLEGDPLKVDQSALTGESLPVTKHPGDEVFSGSTCKQGEIEAVVIATGVHTFFGKAAHLVDSTNQVGHFQKVLTAIGNFCICSIAVGMVIEIIVMYPIQHRKYRDGIDNLLVLLIGGIPIAMPTVLSVTMAIGSHKLSQQGAITKRMTAIEEMAGMDVLCSDKTGTLTLNKLSIDKNLIEVFAKGVDKDYVILLAARASRVENQDAIDAAMVGMLADPKEARAGIREVHFLPFNPVDKRTALTYIDAAGNWHRASKGAPEQILALCNCREDVKKKVHSCIDKFAERGLRSLAVARQQVPEKSKESPGGPWEFVGLLNLFDPPRHDSAETIRRALNLGVNVKMITGDQLAIAKETGRRLGMGTNMYPSASLLGQDKDASIATLPVEELIERADGFAGVFPEHKYEIVKKLQERKHIVGMTGDGVNDAPALKKADIGIAVADATDAARSASDIVLTEPGLSVIISAVLTSRAIFQRMKNYTIYAVSITIRIVFGFMLIALIWKYDFSPFMVLIIAILNDGTIMTISKDRVKPSPLPDSWKLKEIFATGIVLGGYLALMTVIFFWAVHDTDFFSEKFGVRSLRKNDEEMMGALYLQVSIVSQALIFVTRSRSWSFIERPGLLLVSAFMIAQLVATVIAVYANWGFARIKGIGWGWAGVIWIYSIVFYFPLDIMKFAIRYILSGKAWLNLLENKTAFTTKKDYGKEEREAQWALAQRTLHGLQPPETAGVFNEKSGYRELSEIAEQAKRRAEVARLRELHTLKGHVESVVKLKGLDIDTIQQHYTV

SEQ ID NO: 3109 - protein, 951 aa, Glycine max
MGGISLEEIKNENVDLERIPIEEVFEQLKCSRAGLTSEEGANRLQVFGPNKLEEKKESKFLKFLGFMWNPLSWVMEAAAIMAIALANGGGRPPDWQDFVGIIALLVINSTISFIEENNAGNAAAALMAGLAPKTKVLRDNRWSEQDAAILVPGDIISIKLGDIIPADARLLEGDPLSVDQSALTGESLPVTKSPSDEVFSGSTVKKGEIEAVVIATGVHTFFGKAAHLVDSTNQVGHFQKVLTAIGNFCICSIAVGIAIELIVMYPIQHRRYREGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARSGVREVHFLPFNPVDKRTALTYIDSDGNWHRASKGAPEQIITLCNCKEDVRRKVHAVIDKFAERGLRSLGVARQEVPEKSKDSPGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVVFFWAMKDTNFFSNKFGVRPLRDSPDEMMAALYLQVSIISQALIFVTRSRSWSFVERPGLLLLGAFFIAQLVATFIAVYANWGFARIKGMGWGWAGVIWLYSVVTYIPLDLLKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 3110 - protein, 954 aa, Musa acuminata
MAGNKAITLEEIKNETVDLERIPIEEVFEELKCTKQGLSSEEGASRLQIFGPNKLEEKKESKILKFLGFMWNPLSWVMEMAAIMAIALANGDNKAPDWQDFVGIIVLLVINSTISFIEENNAGNAAAALMAGLAPKTKVLRDGRWSEQDAAILVPGDIISIKLGDIVPADARLLEGDPLKIDQSALTGESLPVTKNPGDEVFSGSTCKQGEIEAVVIATGVHTFFGKAAHLVDSTNQVGHFQKVLTAIGNFCICSIAIGMIVEIIVMYPIQRRRYRNGIDNLLVLLIGGIPIAMPTVLSVTMAIGSHRLSEQGAITKRMTAIEEMAGMDVLCSDKTGTLTLNKLSVDNNLIEVFTKGMFKEHVILLAARASRTENQDAIDAAMVGMLADPKEARAGIREVHFLPFNPVDKRTALTYIDADDNWHRVSKGAPEQILNICNCKEDVRNKVHTVIDKFAERGLRSLAVARQEVPEKCKESAGAPWQFVGLLPLFDPPRHDSAETIRRALNLGVNVKMITGDQLSIAKETGRRLGMGTNMYPSSSLLGQNKDASIAALPVDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVLGFMLIALIWRFDFSPFMVLIIAILNDGTIMTISKDRVKPSPLPDSWKLKEIFATGIVFGSYLALMTVIFFWAMKDTTFFSDIFKVRSLKDSEDEMMAALYLQVSIVSQALIFVTRSRSWCFVERPGLLLVSAFIIAQLVATVIAVYADWGFARIKGIGWRWAGVIWIYSIVFFFPLDWFKFAIRYILSGKAWDNLLQNKTAFTTKKDYGKEEREAQWAMAQRTLHGLQPPETTNLFSDKSSYRELSEIAEQAKRRAEIARLRELHTLKGHVESVVKLKGLDIDTIQQHYTV

SEQ ID NO: 3111 - protein, 954 aa, Ricinus communis
MATKGGISLEEIKNESVDLERIPIEEVFEQLKCSREGLSSEEGTNRLQVFGPNKLEEKKESKILKFLGFMWNPLSWVMEAAAIMAIALANGDGRPPDWQDFVGIVALLLINSTISFIEENNAGNAAAALMAGLAPKTKVLRDGRWTEQEAAILVPGDIISIKLGDIIPADARLLEGDPLKVDQSALTGESLPVTKNPSDEVFSGSTCKQGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLTVDRTLIEVFVKGVDKEYVILLAARASRTENQDAIDAAIVGMLADPKEARAGIRELHFLPFNPVDKRTALTYIDSDGNWHRASKGAPEQILTLCNSKEDVKKKVHAVIDKFAERGLRSLAVARQEVPERSKESPGGPWQLVGLLPLFDPPRHDSAETIRRALNLGVNVKMITGDQLAIAKETGRRLGMGTNMYPSSSLLGQDKDASIATLPVDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFLFIALIWKFDFSPFMVLIIAILNDGTIMTISKDRVKPSPQPDSWKLKEIFSTGVVLGGYLALMTVIFFWAMEETDFFSDKFGVRSLHNSEGEMMAALYLQVSIVSQALIFVTRSRSWSFVERPGLLLIGAFIAAQLIATVIAVYANWGFARIEGCGWGWAGVIWLYSVVTYVPLDLLKFAIRYILSGKAWDNLLENKTAFTTKKDYGKEEREAQWATAQRTLHGLQPPETTNFFADKNSYRELSEIAEQAKRRAEVARLRELHTLKGHVESVVKLKGLDIDTIQQHYTV

SEQ ID NO: 3112 - protein, 954 aa, Mimulus guttatus
MGSTKGLTLEEIKNEAVDLERIPVEEVFEQLKCTREGLTSEEGQNRLQIFGPNKLEEKKESKILKFLGFMWNPLSWVMEAAALMAIVLANGDNRPPDWQDFVGIVALLFINSTISFIEENNAGNAAAALMAGLAPKTKVLRDGRWSEQDASILVPGDIISIKLGDIIPADARLLEGDPLKVDQSALTGESLPVTKSPSDEVFSGSTCKQGEIEAVVIATGVHTFFGKAAHLVDSTNQVGHFQKVLTAIGNFCICSIFVGIIIELIVMYPIQHRKYRDGIDNLLVLLIGGIPIAMPTVLSVTMAIGSHRLSQQGAITKRMTAIEEMAGMDVLCSDKTGTLTLNKLTVDRSLVEVFVKGLDKEQVILLAARASRTENQDAIDAAIVGMLADPKEARAGAREVHFLPFNPVDKRTALTYIDANGNWHRASKGAPEQILALCNSKEDVRKRVHSVIDKFAERGLRSLGVARQEVPERTKESLGGPWQLVGLLPLFDPPRHDSAETIRRALNLGVNVKMITGDQLAIAKETGRRLGMGTNMYPSSSLLGQHKDEAIASLPVDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFMLIALIWKFDFAPFMVLIIAILNDGTIMTISKDRVKPSPLPDSWKLNEIFATGVVLGGYLALGTVLFFWVMKDTDFFSEKFGVRSLRDSPEEIMAALYLQVSIVSQALIFVTRSRSWSFAERPGMFLLGAFLIAQLVATLIAVYADWSFAKIKGCGWGWAGVIWLYSIVTYFPLDILKFCIRYVLSGKAWDNLLENRTAFTTKSNYGKEEREAQWAASQRTLHGLQPPETANLFAEKSSYRELSEIAEQAKRRAEVARLRELHTLKGHVESVVKLKGLDIDTIQQHYTV

SEQ ID NO: 3113 - protein, 951 aa, Sorghum bicolor
MGGLEEIKNEAVDLENIPIEEVFEQLKCTREGLSSSEGQQRLEIFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKVDQSALTGESLPVTRGPGDEVFSGSTCKQGEIEAVVIATGVHTFFGKAAHLVDSTNQVGHFQQVLTAIGNFCICSIAVGIIVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREVHFLPFNPVDKRTALTYIDGDGNWHRVSKGAPEQILDLCHCKEDLRRKVHGIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDSTLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWKYDFSPFMVLIIAILNDGTIMTISKDRVKPSPLPDSWKLKEIFATGIVLGSYLAIMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATNTLFNDKSSYRELSEIAEQAKRRAEIARLRELNTLKGHVESVVKLKGLDIDTIQQNYTV

SEQ ID NO: 3114 - protein, 885 aa, Glycine max
MWNPLSWVMEAAAIMAIALANGGGRPPDWQDFVGIIALLVINSTISFIEENNAGNAAAALMAGLAPKTKVLRDNRWSEQDAAILVPGDIISIKLGDIIPADARLLEGDPLSVDQSALTGESLPVTKSPSDEVFSGSTVKKGEIEAVVIATGVHTFFGKAAHLVDSTNQVGHFQKVLTAIGNFCICSIAVGIVIELIVMYPIQHRRYRDGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARSGIREVHFLPFNPVDKRTALTYIDSDGNWHRASKGAPEQIITLCNCKEDVRRKVHAVIDKFAERGLRSLGVARQEVPEKSKDSPGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVVFFWAMKDTNFFSNKFGVRPLSDSPDKMMAALYLQVSIISQALIFVTRSRSWSFVERPGLLLLGAFFIAQLVATFIAVYANWSFARIKGMGWGWAGVIWLYSVVTYIPLDLLKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 3115 - protein, 239 aa, Saccharum officinarum
MGGLEEIKNEAVDLENIPIEEVFEQLKCTREGLSSSEGQQRLEIFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKLTSLRLPENPSQLPGALGTKSSRGPLVSRARSRPWSLPLECTPSSARLLILWTAPIRSDTSNRS

SEQ ID NO: 3116 - protein, 951 aa, Zea mays
MGGLEEIKNEAVDLENIPIEEVFEQLKCTREGLSSSEGQQRLEIFGPNRLEEKKESKVLKFLGFMWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIIFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTV

SEQ ID NO: 3117 - protein, 954 aa, Quercus alba
MGGDKPISLEEIKNESVDLERIPIEEVFEQLKCTRQGLSAEEGAHRLQVFGPNKLEEKKESKLLKFLGFMWNPLSWVMEAAALMAIALANGDGKPPDWQDFVGIIVLLLINSTISFIEENNAGNAAAALMAGLAPKTKVLRDGRWSEQDASILVPGDIISIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAIGIIIEIIVMYPIQHRKYRSGIDNLLVLLIGGIPIAMPTVLSVTMAIGSHRLSQQGAITKRMTAIEEMAGMDVLCSDKTGTLTLNKLTVDTNLTEVFAKGVEKELVMLLAARASRTENQDAIDACIVGMLADPKEARAGIREVHFLPFNPVDKRTALTYIDEKGNWHRASKGAPEQIITLCNCKEDVRKKVHAVIDKFAERGLRSLGVARQEVPEKTKESPGGPWQFVGLLPLFDPPRHDSAETIRRALNLGVNVKMITGDQLAIAKETGRRLGMGTNMYPSSSLLGQDKDVSIAALPVDELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPMPDSWKLKEIFATGIVLGGYLALMTVIFFWAMKDTTFFSDKFHVRPLKGNDEEMMAALYLQVSIVSQALIFVTRSRSWSFIERPGLLLLGAFVIAQLIATFIAVYADWGFARIKGMGWGWAGVIWLYSLVTYFPLDILKFAIRYILSGKAWDNLLENKTAFTTKKDYGKEEREAQWAAAQRTLHGLQPPETSNLFTEKSSYRELSEIAEQAKRRAEVARLRELHTLKGHVESVVKLKGLDIDTIQQHYTV

SEQ ID NO: 3118 - protein, 954 aa, Castanea mollissima
MGGDKPISLEEIKNESVDLERIPIEEVFEQLKCTRQGLSAEEGANRLQVFGPNKLEEKKESKLLKFLGFMWNPLSWVMEAAALMAIALANGDGKPPDWQDFVGIIVLLLINSTISFIEENNAGNAAAALMAGLAPKTKVLRDGRWSEQDASILVPGDIISIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAIGIIIEIIVMYPIQHRKYRSGIDNLLVLLIGGIPIAMPTVLSVTMAIGSHRLSQQGAITKRMTAIEEMAGMDVLCSDKTGTLTLNKLTVDTNLTEVFAKGVEKELVMLLAARASRTENQDAIDACIVGMLADPKEARAGIREVHFLPFNPVDKRTALTYIDDKGNWHRASKGAPEQIITLCNCKEDVRKKVHAVIDKFAERGLRSLGVARQEVPEKTKEGPGGPWQFVGLLPLFDPPRHDSAETIRRALNLGVNVKMITGDQLAIAKETGRRLGMGTNMYPSSSLLGQDKDASIAALPVDELIEKADGFAGVFPEHKYEIVKKLQEKKHICGMTGDGVNDAPALKKADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPMPDSWKLKEIFATGIVLGGYLALMTVIFFWAMRDTTFFSDKFHVRSLRGNEEEMMAALYLQVSIISQALIFVTRSRSWSFIERPGLLLLGAFVIAQLIATFIAVYADWGFARIKGMGWGWAGVIWLYSLVTYFPLDILKFAIRYILSGKAWDNLLENKTAFTTKKDYGKEEREAQWAAAQRTLHGLQPPETSNLFTEKSSYRELSEIAEQAKRRAEVARLRELHTLKGHVESVVKLKGLDIDTIQQHYTV

SEQ ID NO: 3119 - protein, 951 aa, Setaria italica
MGGLEEIKNEAVDLENIPIEEVFEQLKCTREGLSSNEGAQRLEIFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKVDQSALTGESLPVTKGPGDEVFSGSTCKQGEIEAVVIATGVHTFFGKAAHLVDSTNQVGHFQKVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREVHFLPFNPVDKRTALTYIDSDGNWHRVSKGAPEQILDLCNCREDMRRKVHSIIDKYAERGLRSLAVARQEVPEKSKDASGGPWQFVGLLPLFDPPRHDSAETIRKALVLGVNVKMITGDQLAIGKETGRRLGMGTNMYPSSSLLGQNKDSTLESLPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWKYDFSPFMVLIIAILNDGTIMTISKDRVKPSPLPDSWKLKEIFATGVVLGSYLALMTVIFFWAMHKTDFFPEKFGVKPIRDSEGKMMSALYLQVSIVSQALIFVTRSRSWSFVERPGLLLVTAFLLAQLVATFLAVYANWGFARIEGIGWGWAGVVWLYSIVFYFPLDLFKFFIRFVLSGRAWDNLLENKTAFTTKKDYGREEREAQWATAQRTLHGLQPPEAASNTLFNDKSSYRELSEIAEQAKRRAEIARLRELNTLKGHVESVVKLKGLDIDTIQQNYTV

SEQ ID NO: 3120 - protein, 951 aa, Zea mays
MGGLEEIKNEAVDLENIPIEEVFEQLKCTREGLSSSEGQQRLEIFGPNRLEEKKESKILKFLGFMWNPLSWVMEMAAVMAIALANGGGKPPDWEDFVGIIVLLVINSTISFIEENNAGNAAAALMANLAPKTKVLRDGRWGEQEAAILVPGDIVSIKLGDIVPADARLLEGDPLKVDQSALTGESLPVTKGPGDEVFSGSTCKQGEIEAVVIATGVHTFFGKAAHLVDSTNQVGHFQQVLTAIGNFCICSIAVGIVVEIIVMFPIQHRRYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGHWHRVSKGAPEQILDLCHCKEDLRRKVHGIIDKYAERGLRSLAVARQEVPERNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATSTLFHDKNSYRELSEIAEQAKRRAEIARLRELNTLKGHVESVVKLKGLDIDTIQQNYTV

SEQ ID NO: 3121 - protein, 952 aa, Populus trichocarpa
MEKATSLEEIKNETVDLERIPVEEVFEQLKCTKEGLSSEEGASRIQIFGPNKLEEKKESKFLKFLGFMWNPLSWVMEAAAIMAIALANGSGKPPDWQDFVGIICLLVINSTISFIEENNAGNAAAALMAGLAPKTKVLRDGKWTEEDAAILVPGDIISVKLGDIIPADARLLEGDPLKIDQSALTGESLPVTKHPGDEVFSGSTCKQGEIEAVVIATGVHTFFGKAAHLVDSTNQVGHFQKVLTAIGNFCICSIAVGMVIELVVMYPIQHRRYRDGIDNLLVLLIGGIPIAMPTVLSVTMAIGSHKLSQQGAITKRMTAIEEMAGMDVLCSDKTGTLTLNKLSVDKNLIEVFAKGVDKDHVVLLAARASRVENQDAIDAAMVGMLADPKEARAGIREVHFLPFNPVDKRTALTYIDADGNWHRASKGAPEQILDLCNAREDVKKKTHSCMDKFAERGLRSLAVARQQVPEKSKESPGGPWEFVGLLNLFDPPRHDSAETIRRALNLGVNVKMITGDQLAIAKETGRRLGMGTNMYPSASLLGQHKDASIASLPVEELIEKADGFAGVFPEHKYEIVKKLQESKHIVGMTGDGVNDAPALKKADIGIAVADATDAARGASDIVLTEPGLSVIISAVLTSRAIFQRMKNYTIYAVSITIRIVFGFMLIALIWKYDFSPFMVLIIAILNDGTIMTISKDRVKPSPLPDSWKLKEIFATGIVLGGYLALMTVIFFWAVHDTDFFSNKFGVRSLRHHDEEMMGALYLQVSIVSQALIFVTRSRSWSFIERPGLLLLSAFMLAQLVATLIAVYANWGFARIKGIGWGWAGVIWIYSIVFYFPLDIMKFAIRYILSGKAWLNLLDNKTAFTTKKDYGKEEREAQWAHAQRTLHGLQPPETAGIFNEKSSYRELSEIAEQAKRRAEVARLRELHTLKGHVESVVKLKGLDIDTIQQHYTV

SEQ ID NO: 3122 - protein, 951 aa, Oryza sativa
MGGLEEIKNEAVDLENIPIEEVFEQLKCTREGLSSEEGNRRIEMFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKIDQSALTGESLPVTKNPGDEVFSGSTCKQGEIEAVVIATGVHTFFGKAAHLVDSTNQVGHFQTVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFTKGVDKDHVLLLAARASRTENQDAIDAAMVGMLADPKEARAGIREVHFLPFNPVDKRTALTYIDADGNWHRASKGAPEQILTLCNCKEDVKRKVHAVIDKYAERGLRSLAVARQEVPEKSKESAGGPWQFVGLLPLFDPPRHDSAETIRKALHLGVNVKMITGDQLAIGKETGRRLGMGTNMYPSSALLGQNKDASLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFLLIALIWKYDFSPFMVLIIAILNDGTIMTISKDRVKPSPLPDSWKLKEIFATGIVLGSYLALMTVIFFWAMHKTDFFTDKFGVRSIRNSEHEMMSALYLQVSIVSQALIFVTRSRSWSFIERPGLLLVTAFMLAQLVATFLAVYANWGFARIKGIGWGWAGVIWLYSIVFYFPLDIFKFFIRFVLSGRAWDNLLENKIAFTTKKDYGREEREAQWATAQRTLHGLQPPEVASNTLFNDKSSYRELSEIAEQAKRRAEIARLRELNTLKGHVESVVKLKGLDIDTIQQNYTV

SEQ ID NO: 3123 - protein, 955 aa, Glycine max
MAGDKGTITLEEIKNETVDLERIPIDEVFEQLKCTREGLSSTEGENRLQIFGPNKLEEKKESKFLKFLGFMWNPLSWVMEAAAIMAIALANGEGKPPDWQDFVGIVCLLLINSTISFIEENNAGNAAAALMAGLAPKTKVLRDGKWSEQEAAILVPGDIISIKLGDIIPADARLLEGDPLMVDQAALTGESLPVTKHPGQEVFSGSTCKQGEIEAVVIATGVHTFFGKAAHLVDSTNQVGHFQKVLTAIGNFCICSIAIGMLAEIIVMYPIQHRKYREGIDNLLVLLIGGIPIAMPTVLSVTMAIGSHKLSQQGAITKRMTAIEEMAGMDVLCSDKTGTLTLNKLTVDKNLVEVFAKGVDKDHVILLAARAARTENQDAIDAAIVGMLADPKEARAGIREVHFLPFNPVDKRTALTYIDANGNWHRASKGAPEQIMSLCNLRDDAKKKVHAIIDKFAERGLRSLAVARQEVPEKTKESAGAPWQFVGLLSLFDPPRHDSAETIRRALNLGVNVKMITGDQLAIAKETGRRLGMGTNMYPSASLLGQDKDASIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLNEIFATGVVLGGYLALMTVIFFWAIKETTFFPDKFGVRPIHDNPDEMTAALYLQVSIVSQALIFVTRSRSWSFIERPGLLLVTAFVIAQLIATVIAVYANWGFARIQGIGWGWAGVIWLYSIVFYFPLDIMKFAIRYILSGKAWNNLLENKTAFTTKKDYGKEEREAQWALAQRTLHGLQPPETSNIFNEKSSYRELTEIAEQAKRRAEVARLRELHTLKGHVESVVKLKGLDIDTIQQHYTV

SEQ ID NO: 3124 - protein, 955 aa, Glycine max
MAGDKGTITLEEIKNETVDLERIPIEEVFEQLKCTREGLSSTEGENRLQIFGPNKLEEKKESKFLKFLGFMWNPLSWVMEAAAIMAIALANGEGKPPDWQDFVGIVCLLLINSTISFIEENNAGNAAAALMAGLAPKTKVLRDGKWSEQEAAILVPGDIISIKLGDIIPADARLLEGDPLMVDQAALTGESLPVTKHPGQEVFSGSTCKQGEIEAVVIATGVHTFFGKAAHLVDSTNQVGHFQKVLTAIGNFCICSIAVGMLAEIIVMYPIQHRKYRDGIDNLLVLLIGGIPIAMPTVLSVTMAIGSHKLSQQGAITKRMTAIEEMAGMDVLCSDKTGTLTLNKLTVDKNLVEVFAKGVDKDHVILLAARAARTENQDAIDAAIVGMLADPKEARAGIREVHFLPFNPVDKRTALTYIDANGNWHRASKGAPEQIMALCNLRDDAKKKVHAIIDKFAERGLRSLAVARQEVPEKTKESAGAPWQFVGLLSLFDPPRHDSAETIRRALNLGVNVKMITGDQLAIAKETGRRLGMGTNMYPSATLLGQDKDASIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLNEIFATGVVLGGYLALMTVIFFWAMKETTFFPDKFGVRPIHDNPDEMTAALYLQVSIVSQALIFVTRSRSWSFIERPGLLLMTAFIIAQLIATVIAVYANWGFARIQGIGWGWAGVIWLYSIVFYFPLDLMKFAIRYILSGKAWNNLLENKTAFTTKKDYGKEEREAQWALAQRTLHGLQPPETSNIFNEKSSYRELTEIAEQAKRRAEVARLRELHTLKGHVESVVKLKGLDIDTIQQHYTV

SEQ ID NO: 3125 - protein, 952 aa, Solanum tuberosum
MAKAISLEEIKNETVDLEKIPIEEVFEQLKCSREGLTSDEGANRLQIFGPNKLEEKKESKILKFLGFMWNPLSWVMEAAAIMAIALANGNGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAVGMLIEIIVMYPIQHRKYRDGIDNLLVLLIGGIPIAMPTVLSVTMAIGSHRLSQQGAITKRMTAIEEMAGMDVLCSDKTGTLTLNKLSVDKTLVEVFVKGVDKEYVLLLAARASRVENQDAIDACMVGMLADPKEARAGIREVHFLPFNPVDKRTALTYIDNNGNWHRASKGAPEQILDLCNCKEDVRRKVHSMIDKYAERGLRSLAVARQEVPEKSKESAGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVLFFWAMHDTNFFSDKFGVKDIRGSDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 3126 - protein, 891 aa, Pseudotsuga menziesii
LGFMWNPLSWVMEAAALMAIALANGGNKPPDWQDFVGIILLLVLNSTISFIEENNAGNAAASLMAQLAPKAKVLRNGRWSEEDAACLVPGDIISIKLGDIVPADARLLEGDALKIDQSALTGESLPVTKNSGDGVYSGSTCKQGELEAVVIATGVHTFFGKAAHLVDSTNNVGHFQKVLTAIGNFCICSIAVGMVVEIIVQYPIQGRPYRPGIDNLLVLLIGGIPIAMPTVLSVTMAIGSHRLSQQGAITKRMTAIEEMAGMDVLCSDKTGTLTLNKLTVDKNLVEVFAKDVDKDALILMAARASRIENQDAIDAAIVGVLADPKEARAGIQEVHFLPFNPTDKRTALTYIDREGRMHRVSKGAPEQILSLAHNKSEIERRVHTVIDKFAERGLRSLAVAYQEVPNGKKESPGGPWQFIGLMPLFDPPRHDSAETIRRALNLGVSVKMITGDQLAIGKETGRRLGMGTNMYPSSSLLGQAKGESAEALEIDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVFGFMLLALIWKFDFPPFMVLIIAILNDGTIMTISKDRVKPSPLPDSWNLSEIFATGIILGSYLAVMTVIFFWATFKTDFFPRTFGVSSLHIPSEENTQKLNSAVYLQVSTISQALIFVTRSRGWSFVERPGLLLVTAFAIAQLAATLIAVYLNMGFASIRGIGWGWAGVIWLYNLIFYFPLDLLKFAIRYAISGRAWDLLIQQRVAFTTQKDFGKEAREIKWAHAQRTLHGLQPPDTKLFGDRSSFRELNQMAEEAKRRAEIARLRELNTLKGHVESVVRLKGLDINTIQQSYTV

SEQ ID NO: 3127 - protein, 952 aa, Solanum phureja
MAKAISLEEIKNETVDLEKIPIEEVFEQLKCSREGLTSDEGANRLQIFGPNKLEEKKESKILKFLGFMWNPLSWVMEAAAIMAIALANGNGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAVGMLIEIIVMYPIQHRKYRDGIDNLLVLLIGGIPIAMPTVLSVTMAIGSHRLSQQGAITKRMTAIEEMAGMDVLCSDKTGTLTLNKLSVDKTLVEVFVKGVDKEYVLLLAARASRVENQDAIDACMVGMLADPKEARAGIREVHFLPFNPVDKRTALTYIDNNGNWHRASKGAPEQILDLCNCKEDVRRKVHSMIDKYAERGLRSLAVARQEVPEKSKESAGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVLFFWAMHDTKFFSDKFGVKDIRESDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 3128 - protein, 949 aa, Glycine max
MAADKAAISLEEIKNETVDLERIPIEEVFQQLKCTREGLSSDEGANRLQIFGPNKLEEKKESKFLKFLGFMWNPLSWVMEAAAVMAIALANGDGKPPDWQDFVGIVCLLVINSTISFIEENNAGNAAAALMAGLAPKTKVLRDGKWTEEEAAILVPGDIISIKLGDIIPADARLLEGDPLKVDQSALTGESLPVTRGPGEEVFSGSTCKQGEIEAVVIATGVHTFFGKAAHLVDSTNQVGHFQKVLTAIGNFCICSIAVGMLAEIIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDHVILLAARASRTENQDAIDAAIVGMLADPKEARAGVREVHFLPFNPVDKRTALTYIDADGNWHRASKGAPEQIMTLCNLRDDAKRKVHAIIDKFAERGLRSLAVARQEVPEKTKESAGAPWQFVGLLSLFDPPRHDSAETIPRALHLGVNVKMILGSIQETGRRLGMGTNMYPSASLLGQDKDASIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLQEIFATGIVLGSYLALMTVIFFWAMKETDFFPDKFGVRHLSHDEMMSALYLQVSIVSQALIFVTRSRSWSFIERPGMLLVCAFVIAQLIATIIAVYADWGFAKVKGIGWGWAGVIWLYSIVFYIPLDVMKFATRYVLSGKAWVNMLENKTAFTTKKDYGKEEREAQWAHAQRTLHGLQPPETSGIFNEKNSYRELSEIAEQAKRRAEVARLRELHTLKGHVESVVKLKGLDIDTIQQHYTV

SEQ ID NO: 3129 - protein, 954 aa, Theobroma cacao
MGGDKGISLDEIKNESVDLERIPIEEVFEQLKCTRAGLTTEEGANRLQVFGPNKLEEKKESKFLKFLGFMWNPLSWVMEAAAIMAIALANGDGRPPDWQDFVGIIVLLFINSTISFIEENNAGNAAAALMANLAPKTKVLRDGRWSEQEAAILVPGDIITIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAVGIVVEIIVMYPIQHRKYRQGIDNLLVLLIGGIPIAMPTVLSVTMAIGSHRLSQQGAITKRMTAIEEMAGMDVLCSDKTGTLTLNKLTVDRNLIEVFAKGVEKEQVILYAARASRTENQDAIDTAIVGMLADPKEARAGIREIHFLPFNPVDKRTALTYIDSDGNWHRASKGAPEQIITLCNCKEDVKKKVHAVIDKFAERGLRSLGVARQEVPEKTKEAPGAPWQFIGLLPLFDPPRHDSAETIRRALNLGVNVKMITGDQLAIAKETGRRLGMGTNMYPSSSLLGQDKDASIAALPIDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFCTGIVLGGYLALMTVLFFWAMHDTDFFTDKFSVRSLRGSDKEMMAALYLQVSIVSQALIFVTRSRSWSYVERPGLLLVSAFVIAQLVATLIAVYANWGFARIKGMGWGWAGVIWLYSVVTFVPLDLIKFATRYVLSGKAWDNLLENKTAFTTKKDYGKEEREAQWAAAQRTLHGLQPPETSNIFSERSSYRELSEIAEQAKRRAEVARLRELNTLKGHVESVVKLKGLDIDTIQQHYTV

SEQ ID NO: 3130 - protein, 954 aa, Theobroma cacao
MGGDKGISLEEIKNETVDLEKIPIEEVFEQLKCTREGLSADEGANRLQIFGPNKLEEKKESKILKFLGFMWNPLSWVMESAAIMAIALANGDGKPPDWQDFVGIVCLLVINSTISFIEENNAGNAAAALMAGLAPKTKVLRDGKWTEQEAAILVPGDIISIKLGDIIPADARLLEGDPLKVDQSALTGESLPVTKNPGDEIFSGSTCKQGEIEAVVIATGVHTFFGKAAHLVDSTNQVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDKNLIEVFVKDVDKEHVVLLAARASRTENQDAIDAAIVGMLADPKEARAGIREVHFFPFNPVDKRTALTYIDSNGNWHRASKGAPEQILALCNAREDLKKKVHSIIDKFAERGLRSLAVGRQQVPEKTKESAGTPWQFVGLLPLFDPPRHDSAETIRRALNLGVNVKMITGDQLAIAKETGRRLGMGTNMYPSASLLGQDKDASIAALPVEELIERADGFAGVFPEHKYEIVRKLQERKHICGMTGDGVNDAPALKKADIGIAVADATDAARSASDIVLTEPGLSVIISAVLTSRAIFQRMKNYTIYAVSITIRIVFGFLFIALIWKFDFSPFMVLIIAILNDGTIMTISKDRVKPSPLPDSWKLKEIFATGIMLGGYLALMTVIFFWLMHDTKFFPDKFGVRSLRGSDHEMMAALYLQVSIVSQALIFVTRSRSWSYVERPGLLLVTAFFIAQLVATLIAVYANWGFAKIKGIGWGWAGVIWLYSIVFYIPLDLMKFAIRYILSGKAWLNLLENKTAFTTKKDYGKEEREAQWALAQRTLHGLQPPEATNLFNDKSSYRELSEIAEQAKRRAEVARLRELHTLKGHVESVVKLKGLDIDTIQQHYTV

SEQ ID NO: 3131 - protein, 954 aa, Gossypium hirsutum
MAGNKGISLDEIKNESVDLERIPIEEVFEQLKCTRAGLSTQEGNNRLQVFGPNKLEEKKESKFLKFLGFMWNPLSWVMEAAAIMAIALANGGGRPPDWQDFVGIIVLLVINSTISFIEENNAGNAAAALMANLAPKTKVLRDGRWSEQEAAILVPGDIITIKLGDIVPADARLLEGDPLKIDQSALTGESLPVTKNPSDEVFSGSTCKQGEIEAVVIATGVHTFFGKAAHLVDSTNQVGHFQQVLTAIGNFCICSIAVGIVIELIVMYPIQRRKYRDGIDNLLVLLIGGIPIAMPTVLSVTMAIGSHRLSQQGAITKRMTAIEEMAGMDVLCSDKTGTLTLNKLTVDRNLIEVFAKGVEKEQVLLYAARASRTENQDAIDAAIVGMLADPKEARAGIREVHFLPFNPVDKRTALTYIDSDGKWHRASKGAPEQIITLCNCKADVRNKVHAVIDKFAERGLRSLAVARQEVPEKTKESPGAPWQLVGLLPLFDPPRHDSAETITRALNLGVNVKMITGDQLAIAKETGRRLGMGTNMYPSSSLLGQDKDSSVSALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPQPDSWKLKEIFSTGIVLGGYLALMTVLFFWAMKDTDFFSDKFHVRSLRDRPEQMMAALYLQVSIVSQALIFVTRSRSWSFVERPGLLLVTAFIAAQLVATLIAVYANWRFAKIQGMGWGWAAVIWLYSLVTYIPLDLIKFAIRYVLSGKAWDNLLENKTAFTTKKDYGKEEREAQWAAAQRTLHGLQPPETSNVFNERSSYRELSEIAEQAKRRAEVARLRELNTLKGHVESVVKLKGLDIDTIQQHYTV

SEQ ID NO: 3132 - protein, 954 aa, Cucumis sativus
MGNDTALTLEEIKNETVDLEKIPIEEVFEQLKCTREGLSSQEGENRLQIFGPNKLEEKKESKILKFLGFMWNPLSWVMEAAAIMAIALANGGNRGPDWQDFVGIVCLLVINSTISFIEENNAGNAAAALMAGLAPKTKVLRDGKWCEQDASILVPGDVISVKLGDIIPADARLLEGDPLKVDQSALTGESLPVTKNPGDEVFSGSTCKQGEIEAIVIATGVHTFFGKAAHLVDSTNQVGHFQKVLTAIGNFCICSIAIGMLIEILVMYPIQHRAYRDGIDNLLVLLIGGIPIAMPTVLSVTMAIGSHKLSQQGAITKRMTAIEEMAGMDVLCSDKTGTLTLNKLSVDKNLIEVFVKGVDKEHVILLAARASRTENQDAIDAAMVGMLADPKEARAGIREIHFFPFNPVDKRTALTYIDSNGNWHRASKGAPEQILTLCNCKEDFKRKVFSVIDKFAERGLRSLAVSRQEVPEKNKESPGAPWQFVGLLPLFDPPRHDSAETIRRALNLGVNVKMITGDQLAIAKETGRRLGMGTNMYPSSSLLGQHKDESIAGLPVEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMLIALIWKFDFSPFMVLIIAILNDGTIMTISKDRVKPSPLPDSWKLKEIFATGIVLGGYLALMTVIFFWLMDGTNFFSDKFGVRSIRHNEDEMMAALYLQVSIVSQALIFVTRSRGWSYAERPGLLLVGAFFIAQLVATLIAVYANWGFAKIKGIGWGWAGVIWLYSIVFYIPLDVMKFAIRYILSGKAWLNLLENKTAFTTKKDYGKEEREAQWALAQRTLHGLQPPESTNIFSEKSSYRELSEIAEQAKRRAEIARLRELNTLKGHVESVVKLKGLDIDTIQQHYTV

SEQ ID NO: 3133 - protein, 954 aa, Mimulus guttatus
MGGDKAISLEEIKNETVDLEKVPIEEVFEQLKCTREGLSADEGESRLQIFGPNKLEEKKESKFLKFLGFMWNPLSWVMEAAAIMAIALANGGGKPPDWQDFVGIVCLLVINSTISFIEENNAGNAAAALMAGLAPKTKVLRDGRWSEQEAAILVPGDIISIKLGDIVPADARLLEGDPLKIDQSALTGESLPVTKNSYDEVFSGSTCKQGELEAVVIATGVHTFFGKAAHLVDSTNQVGHFQKVLTAIGNFCICSIAVGMLAEIIVMYPIQHREYRKGIDNLLVLLIGGIPIAMPTVLSVTMAIGSHRLSQQGAITKRMTAIEEMAGMDVLCSDKTGTLTLNKLTVDKSLIEVFTKGVEPDHVLLLAARASRVENQDAIDAAIVGTLADPKEARAGVKEIHFFPFNPVDKRTALTYIDSDGNWHRASKGAPEQILTLCNCREDLKKKVHSVIDKFAERGLRSLAVARQEVPEKSKESPGSPWQFIGLLSLFDPPRHDSAETIRRALNLGVNVKMITGDQLAIAKETGRRLGMGVNMYPSSSLLGNHKDESIAGLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLNEIFATGVVLGGYLALMTVIFFWMMHETDFFPDKFGVRSIRDNEDEMMAALYLQVSIVSQALIFVTRSRSWSFVERPGLLLLVAFCIAQLIATLIAVYANWGFARIQGCGWGWAGVIWLYSIVFYVPLDLMKFAIRYILSGKAWQNLYDNKIAFSTKQDYGKGEREAQWAHAQRTLHGLQNPEAGNLFNEKSSYRELSEIAEQAKRRAEIARLRELHTLKGHVESVVKLKGLDIDTIQQHYTV

SEQ ID NO: 3134 - protein, 954 aa, Orobanche aegyptiaca
MGGDKAISLEEIKNETVDLEKVPIEEVFEQLKCTREGLSSDEGGNRLQIFGPNKLEEKKESKLLKFLGFMWNPLSWVMEAAALMAIVLANGGGQGPDWQDFVGIVCLLVINSTISFIEENNAGNAAAALMAGLAPKTKVLRDGRWSEQEAAILVPGDIISIKLGDIIPADARLLEGDPLKVDQSALTGESLPVTKNCYDEVFSGSTCKQGEIEAVVIATGVHTFFGKAAHLVDSTNQVGHFQKVLTAIGNFCICSIAVGMLAEIIVMYPIQHRQYRKGIDNLLVLLIGGIPIAMPTVLSVTMAIGSHRLSQQGAITKRMTAIEEMAGMDVLCSDKTGTLTLNKLTVDKSLIEVFAKGVDPDHVLLLAARASRVENQDAIDGAIVGTLADPKEARAGIREVHFLPFNPVEKRTALTYIDANGNWHRASKGAPEQILDLCKCKEDLKKKVHSVIDKFAERGLRSLAVAYQEVPEKSKDSPGAPWTFIGLLSLFDPPRHDSAETIRRALNLGVNVKMITGDQLAIGKETGRRLGMGVNMYPSASLLGNHKDESIAGLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLNEIFATGVALGGYLALMTVVFFWLMHKTDFFHDKFGVKNIRNNEDEMMAALYLQVSIVSQALIFVTRSRSWSFLERPGLLLVTAFFIAQLVATLIAVYADWGFARIKGCGWGWAGVIWIYSIVFYFPLDLMKFAIRYILSGKAWQNLYDNKTAFTTKKDYGKEEREAQWAHAQRTLHGLQTSEANNIFHEKNSYRELSEIAEQAKRRAEIARLRELHTLKGHVESVVKLKGLDIETIQQHYTV

SEQ ID NO: 3135 - protein, 961 aa, Physcomitrella patens
MGEKLATKLAGLEALNNETVDLEHIPVDEVFQHLRCTEEGLSNEEAEARLQIFGFNKLEEKSESKFLKFLGFMWNPLSWVMEAAAIMAIALANGGGQPPDWQDFIGIICLLIINSTISFVEENNAGNAAAALMARLAPKTKVLRDGQWGERDAMILVPGDIISIKLGDIIPADARLLEGDPLKIDQSALTGESLPATKKPGDEVYSGSTCKQGEIEAVVIATGVHTFFGKAAHLVDSTNNVGHFQKVLKSIGNFCIVSIAIGIVIEIIVMYPIQHRKYRDGINNLLVLLIGGIPIAMPTVLSVTMAIGSHRLSQQGAITKRMTAIEEMAGMDVLCSDKTGTLTLNKLTVDKNLVECFTKGVDKDLVCLMAARASRLENQDAIDTAIVSILADPKEARAGIQEIHFLPFNPVDKRTAITYIDNADGKWYRSSKGAPEQILDLAHNKTDISARVHSIIDKFAERGLRSLAVARQEVPGKSKEDPGTPWQFLGLMPLFDPPRHDSAETIRRALNLGVSVKMITGDQLAIGKETGRRLGMGTNMYPSSSLLGAHKDESIAALPVDELIEKADGFAGVFPEHKYEIVARLQGLKHIVGMTGDGVNDAPALKKADIGIAVADATDAARSASDIVLTEPGLSVIISAVLTSRAIFQRMKNYTIYAVSITIRIVMGFLLLALIWKFDFSPFMILVIAILNDGTIMTISKDRVKPSPLPDSWKLREIFSIGVVLGTYMALMTVLFFWLMHETSFFTDRFGVRHIGRSSDQMTAAIYLQVSIISQALIFVTRSRSWSFMERPGGLLMFAFVAAQLIATFISVYANWGFASIKGIGWGWAGVIWLYSIVTYLPLDIIKFFVRYIQSGKAWDNLIERRTAFTRQKDFGKEAREAQWAHAQRTLHGLHPPESKDDVGISSGSGTRGELGDMAEQAKRRAEIARLREHNTLKGHVESVVRLKNLDIDMIQQSYTV

SEQ ID NO: 3136 - protein, 954 aa, Populus trichocarpa
MSSKGGISLEEIKNESVDLERIPIEEVFEQLKCSREGLTSDEGATRLQVFGPNKLEEKKESKILKFLGFMWNPLSWVMEAAALMAIVLANGDGRPPDWQDFVGIVVLLVINSTISFIEENNAGNAAAALMAGLAPKTKVLRDGRWSEQDAAILVPGDIISIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAIGIIIEIVVMYPIQKRKYRDGIDNLLVLLIGGIPIAMPTVLSVTMAIGSHRLSQQGAITKRMTAIEEMAGMDVLCSDKTGTLTLNKLTVDKSLIEVFAKGVEKEHVMLLAARASRTENQDAIDAAIVGMLADPKEARAGIREVHFLPFNPVDKRTALTYIDNNGNWHRASKGAPEQILTLCNCKEDVKRKVHSVIDKFAERGLRSLGVAKQEVPEKSKDAPGAPWQLVGLLPLFDPPRHDSAETIRRALHLGVNVKMITGDQLAIAKETGRRLGMGTNMYPSSSLLGQDKDAAIAALPVDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPLPDSWKLKEIFSTGVVLGGYLALMTVLFFWIMKDTDFFSDKFGVRSLRDSKYEMMAALYLQVSIVSQALIFVTRSRSWSFVERPGLLLVSAFVVAQLIATLIAVYANWGFAHIKGCGWGWAGVIWLFSLVTYLPLDVLKFAIRYILSGKAWDNFLENKTAFTTKKDYGKEEREAQWATAQRTLHGLQPAQTNTIFSDKSSYRELSEIAEQAKRRAEMARLRELNTLKGHVESVVKLKGLDIDTIQQHYTL

SEQ ID NO: 3137 - protein, 955 aa, Prunus persica
MGGTDKAISLEEIKNETVDLERIPIEEVFEQLKCSREGLNGEEGAQRLEIFGPNKLEEKKESKFLKFLGFMWNPLSWVMEAAAIMAIALANGDGKPPDWQDFVGIVCLLVINSTISFIEENNAGNAAAALMAGLAPKTKVLRDGKWSEEDAAILVPGDIISIKLGDIVPADARLLEGDPLKIDQSALTGESLPVTKNPGDEVFSGSTCKQGEIEAVVIATGVHTFFGKAAHLVDSTNQVGHFQKVLTAIGNFCICSIAVGMLIEIVVMYPIQHRKYRDGIDNLLVLLIGGIPIAMPTVLSVTMAIGSHRLSQQGAITKRMTAIEEMAGMDVLCSDKTGTLTLNKLSVDKNLVEVFAKGVEKEHVVLLAARSSRTENQDAIDAAMVGMLADPKEARAGIREVHFLPFNPVDKRTALTYIDGDGNWHRASKGAPEQILTLCNCKEDFKKKAFAIIDKYAERGLRSLAVARQEVPAKSKESAGGPWQFVGLLPLFDPPRHDSAETIRQALNLGVNVKMITGDQLAIAKETGRRLGMGTNMYPSASLLGQDKDASIAALPIEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGIVLGGYLALMTVIFFWLIKETDFFSDKFGVRSIRESPGELMAALYLQVSIVSQALIFVTRSRSWSFLERPGLLLLGAFMIAQLIATLVAVYANWGFARIHGVGWGWAGVIWVYSIVFYFPLDVMKFAIRYILSGKAWLNLLENKTAFTTKKDYGKEEREAQWALAQRTLHGLQAPEAANLFNDKSSYRELSEIAEQAKRRAEVARLRELHTLKGHVESVVKLKGLDIDTIQQHYTV

SEQ ID NO: 3138 - protein, 948 aa, Arabidopsis lyrata
MSSLEDIKNETVDLEKIPIEEVFQQLKCSREGLTTQEGEDRIQIFGPNKLEEKKESKILKFLGFMWNPLSWVMEMAAIMAIALANGDGRPPDWQDFVGIICLLVINSTISFIEENNAGNAAAALMAGLAPKTKVLRDGKWSEQEAAILVPGDIVSIKLGDIIPADARLLEGDPLKVDQSALTGESLPVTKHPGQEVFSGSTCKQGEIEAVVIATGVHTFFGKAAHLVDSTNQVGHFQKVLTAIGNFCICSIAIGMVIEIIVMYPIQRRKYRDGIDNLLVLLIGGIPIAMPTVLSVTMAIGSHRLSQQGAITKRMTAIEEMAGMDVLCSDKTGTLTLNKLSVDKNLVEVFCKGVEKDQVLLFAAMASRVENQDAIDAAMVGMLADPKEARAGIREVHFLPFNPVDKRTALTYIDGNGNWHRVSKGAPEQILELAKASNDLSKKVLSIIDKYAERGLRSLAVARQVVPEKTKESPGAPWEFVGLLPLFDPPRHDSAETIRRALNLGVNVKMITGDQLAIGKETGRRLGMGTNMYPSSALLGTHKDANLASIPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWEFDFSAFMVLIIAILNDGTIMTISKDRVKPSPTPDSWKLKEIFATGVVLGGYQAIMTVIFFWAAHKTDFFSDTFGVRSIRDNNHELMGAVYLQVSIISQALIFVTRSRSWSFVERPGALLMIAFLIAQLIATLIAVYANWEFAKIRGIGWGWAGVIWLYSIVTYFPLDVFKFAIRYILSGKAWLNLFENKTAFTMKKDYGKEEREAQWALAQRTLHGLQPKEAVNIFPEKGSYRELSEIAEQAKRRAEIARLRELHTLKGHVESVVKLKGLDIETPSHYTV

SEQ ID NO: 3139 - protein, 948 aa, Arabidopsis thaliana
MSSLEDIKNETVDLEKIPIEEVFQQLKCSREGLTTQEGEDRIQIFGPNKLEEKKESKLLKFLGFMWNPLSWVMEMAAIMAIALANGDGRPPDWQDFVGIICLLVINSTISFIEENNAGNAAAALMAGLAPKTKVLRDGKWSEQEAAILVPGDIVSIKLGDIIPADARLLEGDPLKVDQSALTGESLPVTKHPGQEVFSGSTCKQGEIEAVVIATGVHTFFGKAAHLVDSTNQVGHFQKVLTAIGNFCICSIAIGMVIEIIVMYPIQRRKYRDGIDNLLVLLIGGIPIAMPTVLSVTMAIGSHRLSQQGAITKRMTAIEEMAGMDVLCSDKTGTLTLNKLSVDKNLVEVFCKGVEKDQVLLFAAMASRVENQDAIDAAMVGMLADPKEARAGIREVHFLPFNPVDKRTALTYIDGSGNWHRVSKGAPEQILELAKASNDLSKKVLSIIDKYAERGLRSLAVARQVVPEKTKESPGAPWEFVGLLPLFDPPRHDSAETIRRALNLGVNVKMITGDQLAIGKETGRRLGMGTNMYPSSALLGTHKDANLASIPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWEFDFSAFMVLIIAILNDGTIMTISKDRVKPSPTPDSWKLKEIFATGVVLGGYQAIMTVIFFWAAHKTDFFSDTFGVRSIRDNNHELMGAVYLQVSIISQALIFVTRSRSWSFVERPGALLMIAFLIAQLIATLIAVYANWEFAKIRGIGWGWAGVIWLYSIVTYFPLDVFKFAIRYILSGKAWLNLFENKTAFTMKKDYGKEEREAQWALAQRTLHGLQPKEAVNIFPEKGSYRELSEIAEQAKRRAEIARLRELHTLKGHVESVVKLKGLDIETPSHYTV

SEQ ID NO: 3140 - protein, 957 aa, Gossypium hirsutum
MGGEKGISLEEIKNESVDLERIPIEEVFEQLKCTREGLSTEEGNNRLQVFGPNKLEEKKESKVLKFLGFMWNPLSWVMEAAAIMAIALANGDGRPPDWQDFVGIIVLLVINSTISFIEENNAGNAAAALMANLAPKTKVLRDGRWSEQEAAILVPGDIITIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAVGIIVELIVMYPIQHRKYRDGIDNMLVLLIGGIPIAMPTVLSVTMAIGSHRLSQQGAITKRMTAIEEMAGMDVLCSDKTGTLTLNKLTVDRNLIEVFTKGVEKEHVILYAARASRTENQDAIDAAIVGMLADPKEARAGVREIHFLPFNPVDKRTALTYIDSDGNWHRASKGAPEQIIDLCKCKDDVRKKVHSVIDKFAERGLRSLAVARQEIPEKTKESPGSPWQFIGLLPLFDPPRHDSAETIRRALNLGVNVKMITGDQLAIAKETGRRLGMGTNMYPSSSLLGQDKDASIAALPIDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFSTGIVLGGYLALMTVIFFWAMKDTNFFSNTFNVRSLRHSIDGEREMMAALYLQVSIVSQALIFVTRSRSWSYFERPGLLLVSAFLVAQLVATLIAVYADWGFARIKGMGWGWAGVIWLYSVVTFIPLDFIKFAIRYVLSGKAWDNLLENKTAFTTKKDYGKEEREAQWAAAQRTLHGLQPPETTSIFNERSSYRELSEIAEQAKRRAEVARLRELNTLKGHVESVVKLKGLDIDNIQQHYTV

SEQ ID NO: 3141 - protein, 951 aa, Pennisetum glaucum
MGGLEEIKNEAVDLENIPIEEVFEQLKCTREGLSSAEGAQRLEIFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIVSIKLGDIVPADARLLEGDPLKVDQSALTGESLPVTRGPGDEVFSGSTCKQGEIEAVVIATGVHTFFGKAAHLVDSTNQVGHFQQVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFCKGVDKEHVLLLAARASRTENQDAIDAAMVGMLADPKEARAGIREVHFLPFNPVDKRTALTYIDSDGNWHRVSKGAPEQILDLCNCREDVRRKVHSIIDKYAERGLRSLAVARQEVPEKSKDSAGGPWQFVGLLPLFDPPRHDSAETIRKALVLGVNVKMITGDQLAIGKETGRRLGMGTNMYPSSALLGTNKDATLESLPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWKYDFSPFMVLIIAILNDGTIMTISKDRVKPSPLPDSWKLKEIFATGVVLGSYLALMTVIFFWAIHKTDFFTDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLFKFFIRFVLSGRAWDNLLENKTAFTTKKDYGREEREAQWATAQRTLHGLQPPEAASNTLFNDKSSYRELSEIAEQAKRRAEIARLRELNTLKGHVESVVKLKGLDIDTIQQNYTV

SEQ ID NO: 3142 - protein, 952 aa, Solanum lycopersicum
MAKAISLEEIKNETVDLEKIPIEEVFEQLKCSREGLTSDEGANRLQIFGPNKLEEKKESKILKFLGFMWNPLSWVMEMAAIMAIALANGDGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRSLVEVFTKGVDKEYVLLLAARASRVENQDAIDACMVGMLADPKEARAGIREVHFLPFNPVDKRTALTYIDSNGNWHRASKGAPEQILDLCNCKEDVRRKVHSMIDKYAERGLRSLAVARQEVPEKSKESTGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVIFFWAMHDTSFFTDKFGVKDIRESDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 3143 - protein, 347 aa, Triticum aestivum
MFGFGHHGHHGQNPPAHAPAAAGGNQPTFKIFCKADEGYCLSVRDGNVVLAPSNPRDEHQHWFKDMRFSTQIKDEEGNPAFAIVNKATGLAVKHSLGQSHPVKLVPFNPEYLDESVMWTESGDVGKGFRCIRMVNNIRLNFDALNGDKDHGGVHDGTTVVLWEWAKGDNQSWKILPWGEEAYAGGSANAPRGGSSEPTVRIFCKADDGFSATVRNGAVVLAPTNPRDEYQHWFKDMRHSNRIKDEEGYPAFALVNKVTGEAIKHSQGEGHPVKLVPYNANYQDESVLWTESRDVGAGFRCIRMVNNIYLNFDALHGDKEHGGVRDGTSLVLWKWCEGDNQRWKILPW

SEQ ID NO: 3144 - protein, 347 aa, Pseudoroegneria spicata
MFGFGHHGHHDQNPPAHAPAAAGGNQPTFKIFCKADEGYCLSVRDGNVVLAPSNPRDEHQHWFKDMRFSTQIKDEEGNPAFAIVNKATGLAVKHSLGQSHPVKLVPFNPEFLDESVMWTESGDVGKGFRCIRMVNNIRLNFDALNGDKDHGGVHDGTTVVLWEWAKGDNQSWKILPWGEEAYTGGSANAPRGGSSEPTVRIFCKADDGFSATVRNGTVVLAPTNPRDEYQHWFKDMRHSNRIKDEEGYPAFALVNKVTGEAIKHSQGEGHPVKLVPYNANYEDESVLWTESRDVGAGFRCIRMVNNIYLNFDALHGDKEHGGVRDGTSLVLWKWCEGDNQRWKILPW

SEQ ID NO: 3145 - protein, 347 aa, Leymus cinereus x Leymus triticoides
MFGFGHHGHHGQNPPAHAPSAGGGNQPTFKIFCKADEGYCLSVRDGNVVLAPSNPRDEHQHWFKDMRFSTQIKDEEGNPAFAIVNKATGLAVKHSLGQSHPVKLVPFNPEYLDESVMWTESGDVGKGFRCIRMVNNIRLNFDALNGDKDHGGVHDGTTVVLWEWAKGDNQSWKILPWGEEAYAGGSANAPRGGSSEPTVRIFCKADEGFSATVRNGAVVLAPTNPRDEYQHWFKDMRHSNRIKDEEGYPAFALVNKVTGEAIKHSQGEGHPVKLVPYNPNYQDESVMWTESRDVGASFRCIRMVNNIYLNFDALHGDKEHGGVRDGTSLVLWKWCEGDNQRWKILPW

SEQ ID NO: 3146 - protein, 347 aa, Leymus cinereus x Leymus triticoides
MFGLGHHGHHGQNPPAHAPPAAGGNQPTFKIFCKADEGYCLSVRDGNVVLAPSNPRDEHQHWFKDMRFSTQMKDEEGNPAFAIVNKATGLAVKHSLGQSHPVKLVPFNPEYLDESVMWTESGDVGKGFRCIRMVNNIRLNFDALNGDKDHGGVHDGTTVVLWEWAKGDNQSWKILPWGEEAYAGGSANAPRGGSSEPTVRIFCKADEGFSATVRNGTVVLAPTNPRDEHQHWFKDMRHSNRIKDEEGYPAFALVNKVTGEAIKHSQGEGHPVKLVPYNPNYQDESVMWTESRDVGAGFRCIRMVNNIYLNFDAHHGDKDHGGVRDGTSLVLWKWCEGDNQRWKILPW

SEQ ID NO: 3147 - protein, 347 aa, Brachypodium distachyon
MFGFGHHGHHGQNPPAHAPTTAGGHQPTFKIFCKADEGYCLSVRDGNVVLAPTNPRDEHQHWFKDMRFSTNIKDEENNPAFALVNKATGLAVKHSLGQSHPVKLVPFNPDFQDESVLWTESGDVGKGFRCIRMVNNIRLNFDALNGDKDHGGVHDGTTVVLWEWAKGDNQSWKILPWGDEAYAGGSANAPRGGPSEPTVRIFCKADEGFSATVRNGTVCLAPTNPRDDHQHWIKDMRHSNRIKDEEGYPAFALVNKVTGEAIKHSQGEGHPVKLVPYNPNYQDESVLWTESRDVGAGFRCIRMVNNIYLNFDALHGDKDHGGVRDGTSLVLWKWCEGDNQRWKILPW

SEQ ID NO: 3148 - protein, 351 aa, Saccharum officinarum
MFGFGHHGHHGQNPPAHPPAHGGVHQPTFKIFCKADEGYCLTVRDGNVVLAPANPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKGHGGVHDGTTVVLWEWAKGDNQSWKILPWGDEAYAAGGSAAANAPYGHGGGEPTVRIYCKADDGFSVTVRNGTVCLAPTNPRDEYQHWVKDMRHSNSIKDEEGYPAFALVNRVTGEAIKHSQGEGHPVKLVPYNPNYQDESVLWTESRDVGHGFRCIRMVNNIYLNFDAFHGDKDHGGVRDGTAVVLWKWCEGDNQRWKIVPW

SEQ ID NO: 3149 - protein, 351 aa, Saccharum officinarum
MFGFGHHGHHGQNPPAHPPAHGGVHQPTFKIFCKADEGYCLTVRDGNVVLAPANPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKGHGGVHDGTTVVLWEWAKGDNQSWKILPWGDEAYAAGGSAAANAPYGHGGGEPTVRIYCKADDGFSVTVRNGTVCLAPTNPRDEYQHWVKDMRHSNSIKDEEGYPAFALVNRVTGEAIKHSQGEGHPVKLVPYNPSYQDESVLWTESRDVGHGFRCIRMVNNIYLNFDAFHGDKDHGGVRDGTAVVLWKWCEGDNQRWKIVPW

SEQ ID NO: 3150 - protein, 351 aa, Sorghum bicolor
MFGFGHHGHHHGENPPAHPPAHGGVHPPTFKIFCKADEGYCLTVRDGNVVLAPSNPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKDHGGVHDGTTVVLWEWAKGDNQSWKILPWGDEAYAGGSGGAAANAPYGHGEPTVRIYCKADDGFSVTVRNGSVCLAPTNPRDEYQHWVKDMRHSNRIKDEEGYPAFALVNRVTGEAIKHSQGEGHPVKLVPYNPNYQDESVLWTESRDVGHGFRCIRMVNNIYLNFDAFHGDKDHGGVRDGTAVVLWKWCEGDNQRWKIVPW

SEQ ID NO: 3151 - protein, 349 aa, Cenchrus ciliaris
MFGFGHHHHGHHGQNPPAPGGHHGGGAQQPTFKIFCKADEGYCLTVRDGNVVLAPANPRDAHQHWYKDMRFSTQIKDEEGNPAFALVNQATGLAIKHSLGQSHPVKLVLFNPEYPDESVLWTESGDVGKGFRCIRMVNNIRLNFDAFHGDKDHGGVHDGTTVVLWEWAKGDNQSWKILPWGDEAYAGGSAGNAYGHGEPTVRIYCKADEGFSVTVRHGTVCLAPTNPRDEYQHWIKDMRHSNSIKDEEGYPAFALVNKVTGEAIKHSQGEGHQVKLVPYNPNYQDESVLWTESRDVGHGFRCIRMVNNIYLNFDAFHGDKDHGGVRDGTNIVLWKWCEGDNQRWKIVPW

SEQ ID NO: 3152 - protein, 344 aa, Zea mays
MFGFGHHGQNPPAHGGVHQPTFKIFCKADEGYCLTVRDGNVVLAPANPRDEHQHWYKDMRFSTQVKDEEGNPAFALVNKATGLAIKHSLGQSHPVKLVPFNPEYQDESVLWTESGDVGKGFRCIRMVNNIRLNFDAFHGDKGHGGVHDGTTVVLWEWAKGDNQSWKILPWGDEAYAAGGSSAANAPRFGGGGEPTVRIYCKADEGFSATVRNGAVCLAPTNPRDEYQHWIKDMRHSNSVKDEEGYPAFALVNRVTGEAIKHSQGEGHPVKLVPYNPGYQDESVLWTESRDVGHGFRCVRMVNNIYLNFDAFHGDKDHGGVRDGTNIVLWKWCEGDNQRWKIVPW

SEQ ID NO: 3153 - protein, 356 aa, Panicum virgatum
MFGFGHHGHHGQNPPAHPPAPGPHGGAAHQPTFKIFCKADEGYCLTVRDGNVVLAPANPRDEHQHWYKDMRFSAQVKDEEGNPAFALVNKATGLAIKHSLGQSHPVKLVPFNPEYQDESVLWTESGDVGKGFRCIRMVNNIRLNFDAFHGDKDHGGVHDGTAVVLWEWAKGANQSWKILPWGDEAYAGGSSAANAPRGGGYGHGEPTVRIYCKADEGFSVTVRNGAVCLAPTNPRDEFQHWIKDMRHSNSIKDEEGYPAFALVNRVTGEAIKHSQGEGHQVKLVPYNPNYQDESVLWTESRDVGHGFRCIRMVNNIYLNFDAFHGDKDHGGVRDGTNIVLWKWCEGDNQRWKIVPW

SEQ ID NO: 3154 - protein, 350 aa, Panicum virgatum
MFGFGHHGHHGQNPPPPGPHGGGAHQPTFKILCKADEGYCLTVRDGNVVLAPANPRDEHQHWYKDMRFSTQVKDEEGNPAFALVNKATGLAIKHSLGQSHPVKLVPFNPQYQDESVLWTESGDVGKGFRCIRMVNNIRLNFDAFHGDKDHGGVHDGTGVVLWEWAKGDNQRWKILPWGDEAYAGGSAANAPHGGHGHGEPTVRIYCKADEGFSVTVRNGAVCLAPTNPRDEFQHWIKDMRHSNSIKDEEGYPAFALVNRVTGEAIKHSLGEGHQVKLVPYNPNYQDESVLWTESRDVGHGFRCIRMVNNIYLNFDAFHGDKDHGGVRDGTNIVLWKWCEGDNQRWKIVPW

SEQ ID NO: 3155 - protein, 348 aa, Oryza sativa
MFGFGHHGHHGQDQPPQHHGGGGGGAHQPTFKIFCRADEGYCVAVREGNVVLAPTNPRDEHQHWYKDMRFSAKIKDEEGNPAFALVNKATGLAIKHSLGQGHPVKLAPFNPEYPDESVLWTESGDVGKSFRCIRMLNNIRLNFDAFHGDKDHGGVHDGTTIVLWEWAKGDNQCWKILPWGDEAYAGGSANAPRGGNEPTVRIFCKADEGFSVTVRGGSVCLAPTNPRDEYQHWIKDMRHSNSIKDEEGYPAFALVNRVTGEAIKHSQGEGHPVKLVPYNPGYQDESVLWTESRDVGHGFRCIRMVNNIYLNFDALHGDKDHGGVRDGTTVALWKWCEGDNQRWKIVPW

SEQ ID NO: 3156 - protein, 289 aa, Setaria italica
MRFSSQVKDEEGNPAFALVNQATGLAIKHSLGQSHPVKLVPFNPEYQDESVLWTESGDVGKGFRCIRMVNNIRLNFDALHGDKDHGGVHDGTTVVLWEWAKGDNQSWKILPWGDEAGSAGAPRGGYGHGEPTVRIYCKADEGFSVTVRHGAVCLAPTNPRDEYQHWIKDMRHSNSIKDEEGYPAFALVNKVTGEAIKHSQGEGHQVKLVPYNPSYQDESVLWTESRDVGHGFRCIRMVNNIYLNFDAFHGDKDHGGVRDGTNIVLWKWCEGDNQRWKIVPWCKESHQSY

SEQ ID NO: 3157 - protein, 379 aa, Saccharum officinarum
  misc_feature (2)..(2): Xaa can be any naturally occurring amino acid
  misc_feature (4)..(5): Xaa can be any naturally occurring amino acid
  misc_feature (9)..(9): Xaa can be any naturally occurring amino acid
  misc_feature (17)..(17): Xaa can be any naturally occurring amino acid
  misc_feature (20)..(20): Xaa can be any naturally occurring amino acid
  misc_feature (192)..(192): Xaa can be any naturally occurring amino acid
  misc_feature (300)..(300): Xaa can be any naturally occurring amino acid
  misc_feature (304)..(304): Xaa can be any naturally occurring amino acid
MXGXXHHGXHGQNPPVXPPXHGGVHQPTFKIFCKADEGYCLTVRDGNVVLAPANPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKGHGGVHDGTTVVLWEWAKGDNQSWKILPWGPEANAAAGAHAANXGVHPVRVFCKAGGEDYSLTVRNGTACLAPTNPRDEYQHWIKDMRHSTRVRDEEGYPAFALVNKVTGEALKHSTGQGHPVKLVPYNPEYQDESVLWTESRDVGQRLPLXPHGXQHLPQLRRLPWRQGPRRGARRHRRRALEVVRGRQPALEDRPLVNVLCWGCIGHHRDLELELESTATCGQHLLPCC

SEQ ID NO: 3158 - protein, 488 aa, Triticum aestivum
MDVQMGEPQAAPPPAAAAAAPAPSTIQHLKEIAAVIEAGSVTKEVRRISRAVRLTVALRRRLAARDVSAFLAFALPANSDAYARLTPLLPKEDEAEMDIDAAAPATQISIKHGLPEIEIYCSLLVLIFLIDQKKYDEAKACATGSIARLKNLNRRTVDVLASRLYFYYSYVYELTNTLAEIRGNLLGLHRMATLHHDELGQETLLNLLLRNYLHYNLYDQAEKLRSKAPRFEAHSNQQFCRYLFYLGKIRTIQLEYTDAKESLLQAARKAPAAARGFRIQCNKWAIIVRLLLGEIPERTVFMQKGMKEALAPYFELTNAVRIGDLELFRAVADKFASTFSADRTHNLIVRLRHNVIRTGLRNISISYSRISLADIAKKLRLDTENPVADAECIVAKAIRDGAIDATIDHANGWMVSKETGDVYSTNEPQAAFNSRIAFCLNMHNEAVKAMRFPPNSHKEKESAEKRRERLQQEEELAKHMAEEDDDDF

SEQ ID NO: 3159 - protein, 504 aa, Triticum aestivum
SFGTNSPHSPLTAGMDVQMGEPQAAPPPAAAAAAPAPAPSTIQHLKEIAAVIEAGSVTKEVRRISRAVRLTVALRRRLAARDVSAFLAFALPANSDAYARLTPLLPKEDEAEMDIDAAAPATQISIKHGLPEIEIYCSLLVLIFLIDQKKYDEAKACATGSIARLKNLNRRTVDVLASRLYFYYSYVYELTNTLAEIRGNLLGLHRMATLHHDELGQETLLNLLLRNYLHYNLYDQAEKLRSKAPRFEAHSNQQFCRYLFYLGKIRTIQLEYTDAKESLLQAARKAPAAARGFRIQCNKWAIIVRLLLGEIPERTVFMQKGMKEALAPYFELTNAVRIGDLELFRAVADKFASTFSADRTHNLIVRLRHNVIRTGLRNISISYSRISLADIAKKLRLDTENPVADAECIVAKAIRDGAIDATIDHANGWMVSKETGDVYSTNEPQAAFNSRIAFCLNMHNEAVKAMRFPPNSHKEKESAEKRRERLQQEEELAKHMAEEDDDDF

SEQ ID NO: 3160 - protein, 490 aa, Panicum virgatum
MPEDVQMNDSEPQPAAPPPAAAPALSTLHHLKEIASVIEAGSLSKEVRRISRAVRLTIALRRRLAARDVSAFLAFALPASSEAYARLTALVPKEDDTEMDVDAAAPTTQISIKHGLPEIEIYCYLLVLIFLIDQKKYDEAKACATASIARLKNLNRRTVDVLASRLYFYYSYVYELTNSLAEIRGNLLALHRMATLHHDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3161 - protein, 491 aa, Setaria italica
MPEDVQMNDSEPQPAAPTPAAAAPALSTLHHLKEIASVIEAGSLSKEVRRISRAVRLTVALRRRLAARDVSAFLGFALPASSEAYARLTALVPKEDDTEMDVDAAAPATQISIKHGLPEIEIYCYLLVLIFLIDQKKYDEAKACATSSIARLKNLNRRTVDVLASRLYFYYSYVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTSARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3162 - protein, 495 aa, Pennisetum glaucum
MPEDVQMNDSEPQPAAPAPAAAPAAEAPTLSTLHHLKEIASVIEAGSLSKEVRRISRAVRLTVALRRRLAARDVSAFLAFALPASSEAYARLTALVPKEDDTEMDVDAAAPATQISIKHGLPEIEIYCYLLVLIFLIDQKKYDEAKACAIASIARLKSLNRRTVDVLASRLYFYYSYVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTAARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3163 - protein, 490 aa, Panicum virgatum
MPEDVQMNESEPQPAAPPPAAAPALSTLHHLKEIASVIEAGSLSKEVRRISRAFRLTVALRRRLAARDVSAFLGFALPASSEAYARLTALVPKEDDTEMDVDAAAPTTQISIKHGLPEIEIYCYLLVLIFLIDQNKYDEAKACATASIARLKNLNRRTVDVLASRLYFYYSNVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3164 - protein, 491 aa, Brachypodium distachyon
MPEDVQMSEQQAAPPAAATAAAPAPSTLHHLKEIASVIEAGSLTKEVRRISRAVRLTVALRRRLGHRDVSAFLAFALPASTEAYARLTSLLPKEDDTEMDLDATAQATQISIKHGLPEIEIYCYLLVLIFLIDQKKYDEAKACATTSIARLKNMNRRTVDVLASRLYFYYSYVHELTNSLAEIRGNLLALHRKATLHRDELGQGETLLNLLLRNYLHYNLYDQAEKLRSKAPRFEAHSNQQFCRYLFYLGKIRTIQLEYTDAKESLLQAARKAPTAARGFRIQCNKWAIIVRLLLGEIPERTVFMQKGMKKALTPYFELTNAVRIGDLELFRTVADKFASTFSADRTRNLIVRLRHNVIRTGLRNISISYSRISLADIAKKLRLDSQNPVADAECIVSKAIRDGAIDATIDHANGWMVSKETGDVYSTNEPQVAFNSRIAFCLNMHNEAVKAMRFPPNSHKEKESAEKRRERLQQEEELAKHMAEEDDDDF

SEQ ID NO: 3165 - protein, 492 aa, Zea mays
MPEDVQMNDSEPQSAAPAPAAAAAPALSTLHHLKEIASVIEAGSLSKEVRRISRAFRLTVALRRRLAARDVSAFLAFALPASSEAYGRLIALVPKEDDTEMDVDAVAPATQISIKHGLPEIEIYCYLLALIFLIDQKKYDEAKVCASVSIARLKNLNRRTVDVLASRLYFYYSYVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRTVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEEDDDF

SEQ ID NO: 3166 - protein, 486 aa, Oryza sativa
MTDVQMSDSEPQAAPPAAPAASALHHLKEIASVIEAGSLSKEVRRISRAVRLTVALRRRLAARDVSAFLAFALPPSSEAYTRLTSLVPKEDDTEMDIDMAAPATQISIKHGLPEIEIYCYLLVLIFLIDQKKYDDAKACANASIARLKNLNRRTVDVLASRLYFYYSYVHELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPITARGFRIQCNKWAIIVRLLLGEIPERTVFMQKGMKEALTPYFELTNAVRIGDLELFRAVADKFVSTFSADRTRNLIVRLRHNVIRTGLRNISISYSRISLADIAKKLRLDSDNPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3167 - protein, 496 aa, Sorghum bicolor
MPEDVQMNDSEPQPAAPVPVAAAAAAAAPALSTLHHLKEIATVIEAGSLSKEVRRISRAFRLTVALRRRLAARDVSAFLAFALPASSEAYGRLTALVPKEDDTEMDVDAAAPATQISIKHGLPEIEIFCYLLVLIFLIDQKKYDEAKACANVSIARLKNLNRRTVDVLASRLYFYYSYVYELTNSLAEIRGTLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPIADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3168 - protein, 491 aa, Saccharum officinarum
MPEDVQMNDSEPQPAAPAPAAAAPALSTLHHLKEIATVIEAGSLSKEVRRISRAFRLTVALRRRLTARDVSAFLAFALPASSEAYGRLTALVPKEDDTEMDVDAVAPATQISIKHGLPEIEIFCYLLVLIFLIDQKKYDEAKACANVSIFRLKNLNRRTVDVLASRLYFYYSYVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADSTRNLIVRLRHNVIRTGLRNISISYSRISLADIAKKLRLDSENPIADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3169 - protein, 491 aa, Zea mays
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTEMDVDAAAPATQISIKHGLPEIEIYCYLLVLIFLIDHKKYDEAKACASVSIARLKNLNRRTVDVLASRLYFYYSYVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPITACGFRIQCNKWAIIVRLLLGEIPERTVFMQKGMKKALIPYFELTNAVRVGDLELFRAVADKFASTFSADRTRNLIVRLRHNVIRTGLRNISISYSRISLADIAKKLRLDSENPIADAESIVAKAIRDGAIDATIDHANGWMVSKETGDVYSTNEPQIAFNSRIAFCLNMHNEAVKAMRFPPNSHKEKESAEKRRERLQQEEELAKHMAEDDDDDF

SEQ ID NO: 3170 - protein, 487 aa, Oryza sativa
MPEDVEMNDSQPQPAAAPPPAASTLQHLKEIASVIEAGSLTKEVRRISRAVRLTVALRRRLAARDVAAFLAFALPHSSEAFARLSSLLPKEDGSEMDVDLAAPAAQVSIKHGLPEIEIYCYLLVLIFLIDNKKYDEAKACASASITRLKNLNRRTVDVLASRVFTYYSYVHELTSSLAEIRGTLLALHRMATLHRDELGQETLLNLLLRNYLHYNLYDQAEKLRSKAPRFEAHSNQQFCRYLFYLGKIRTIQLEYTDAKESLLQAARKAPTTARGFRVQCNKWAIIVRLLLGEIPERTVFMQKGMKAALAPYFELTNAVRVGDLELFRAVAEKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKALRFPPNSHKEKESAEKRRERLQQEEELAKHMAEEDDDDF

SEQ ID NO: 3171 - protein, 493 aa, Panicum virgatum
MPEDVEMNDSQAPPAAAPAVSDAPAPAQSTLHHLKEIASVIEAGSLSKEVRRISRAVRLTIALRRRLAARDVAAFLAFALPPSSEAFARLSALVPKEDGSEMDVDTAAPAAQVSIKHGLPEIEIYCYLLVLIFLFDNKKYDEAKTCAAASIARLKSLNRRTVDVLASRLYSYYSYVHELTNTLAEIRGTLLALHRMATLHHDELGQETLLNLLLRNYLHYNLYDQAEKLRSKAPRFEAHSNQQFCRYLFYLGKIRTIQLEYTDAKESLLQAARKAPTTARGFQIQCNKWAIIVRLLLGEIPERTVFMQKGMKAALTPYFELTNAVRVGDLELFRSVADKFSSTFSADRTRNLIVRLRHNVIRTGLRNISISYSRISLADIAKKLRLNSENPVADAESIVAKAIRDGAIDATIDHANSCMVSKETGDVYSTNEPQIAFNSRIAFCLNMHNEAVKALRFPPNSHKEKESAEKRRERLQQEEELAKHMAEEDDDDF

SEQ ID NO: 3172 - protein, 497 aa, Brachypodium distachyon
MPEDVEMNDTPAPAPAPAATAVADAPASAPAPSTLQHLKEIALVVEAGSLTKEVRRISRAVRLTVALRRRLAARDVAAFLAFALAPSSEAFTRLSPLLPKEDGSEMDVDAAALAAQVSIKHGLPEIEIYCYLLVLIFLIDHKKYDEAKACANASIARLKNINRRTVDVLASRLYSYYSYAHELTNSLAEIRGTLLGLHRMATLHRDELGQETLLNLLLRNYLHYNLYDQAEKLRSKAPRFEAHSNQQFCRYLFYLGKIRTIQLEYTDAKESLLQAARKAPTAARGFRIQCNKWAIIVRLLLGEIPERTVFMQKGMKAALTPYFELTNAVRVGDLELFRAVAEKFASTFSADRTSNLIVRLRHNVIRTGLRNISISYSRISLVDIAKKLRLDSENPVADAESIVAKAIRDGAVDAIIDHANGWVVSKETGDVYSTNEPQAAFNSRIAFCLNMHNEAVKALRFPPNSHKEKESAEKRRERLQQEEELAKHMAEEDDDDF

SEQ ID NO: 3173 - protein, 164 aa, Triticum aestivum
  misc_feature (89)..(89): Xaa can be any naturally occurring amino acid
  misc_feature (94)..(94): Xaa can be any naturally occurring amino acid
  misc_feature (97)..(97): Xaa can be any naturally occurring amino acid
  misc_feature (133)..(135): Xaa can be any naturally occurring amino acid
  misc_feature (138)..(138): Xaa can be any naturally occurring amino acid
  misc_feature (164)..(164): Xaa can be any naturally occurring amino acid
MPEDVEMNDSAQPAPVAAPAAADAPAPAPALSTLQHLKEIASVVEAGSLTKEVRRISRAVRLTVALRRRLAAPDVAAFLAFALPASSEXFTRLXPLXPKEDGSEMDVDAAAPAAQVSIKHGLPEIEIYCYLLXXXFLXDHKKYDEAKACANSSIARLRISTEDX

SEQ ID NO: 3174 - protein, 425 aa, Avena sativa
AGDVSAFLAFALPASSDAYARLTSLLPKEDETEMDVDATAPATQISIKQGLPEIEIYCSLLVLIFLIDQKKYDEAKSCATASIARLKTLNRRTVDVLASRLYFYYSYVHELTNSLAEIRGNLLGLHRMATLHHDELGQETLLNLLLRNYLHYNLYDQAEKLRSKAPRFEAHSNQQFCRYLFYLGKIRTIQLEYTDAKESLLQAARKAPLAARGFRIQCNKWAIIVRLLLGEIPERTVFMQKGMKEALTPYFELTNAVRIGDLELFRAVAAKFASTFSADRTHNLIVRLRHNVIRTGLRNISISYSRISLADIAKKLRLDSVNPVADAECIVSKAIRDGAIDATIDHSNGWMVSKETGDVYSTNEPQAAFNSRIAFCLNMHNEAVKAMRFPPNSHKEKESAEKRRERLQQEEELAKHMAEEDDDDF

SEQ ID NO: 3175 - protein, 298 aa, Pennisetum glaucum
MATLHRDELGQETLLNLLLRNYLHYNLYDQAEKLRSKAPRFEAHSNQQFCRYLFYLGKIRTIQLEYTDAKESLLQAARKAPTAARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 3176 - protein, 487 aa, Quercus alba
MTQDVEMKELPAPSNSASSSPPSTLQHLKEIASLIETGAYAREVRRIMRVVRLTMALRRKLNATVLASFLNFALTPGSELHGRLFSYLPKEDEHDMDVDTATSGTQIVAKHSLPELEIYCYLLVLIFLIDQKRYNEAKACASASIARLKNLNRRTVDVLASRLYFYYSLSYELTGDLAEIRGNLLSLHRIATLRRDELGQETLLNLLLRNYLHYNLYDQAEKLRSKAPRFEAHSNQQFCRYLFYLGKIRTIQLEYTDAKESLLQAARKAPVAALGFRVQCNKWAIIVRLLLGEIPERTVFMQKGMENALRPYFELTNAVRIGDLELFRNVAEKFSDTFNSDRTHNLIVRLRHNVIRTGLRNISISYSRISLVDVAKKLRLDSANPVADAESIVSKAIRDGAIDATIDHANGWMVSKETGDIYSTNEPQFAFNSRIAFCLNMHNEAVRALRFPPNSHKEKESAEKRRERQQQEQELAKHIAEEDDDEF

SEQ ID NO: 3177 - protein, 487 aa, Theobroma cacao
MTQDVEMKDHQTPPHSVSSAVPSTLHHLKEIASLIETGSYTKEVRRIVRAVRLTFGLRRKLTAPVLSAFLDFALQPGSEALARLSSFLPKEDEHEMEVDTATSAVQTSGKHLLPELEIYCYLLVLLYLIDQKKYNEAKACSSASVNRLKSLNRRTLDVLASRLYFYYSYSYELTGDFAEIRGNLLALHRIATLHHDELGQETLLNLLLRNYLHYNLYDQAEKLRSKAPRFEAHSNQQFCRYLFYLGKIRTIQLEYTDAKESLLQAARKAPVAARGFRIQCNKWAILVRLLLGEIPERTMFMQKGMEKALRPYFELTNAVRIGDLELFRTVAEKFASTFSTDKTHNLIVRLRHNVIRTGLRNISISYSRISLADVAEKLRLNSKTPVADAESIVAKAIRDGAIDATLDHANGWMVSKETGDIYSTNEPQIAFHSRIAFCLNMHNEAVRALRFPPNTHKEKESAEKRRERQQQEQELAKHIAEEDDDDF

SEQ ID NO: 3178 - protein, 487 aa, Castanea mollissima
MTQDVEMKELPAPSNSASSSPPSTLHHLKEIAALIETGAYAREVRRIMRVVRLTMALRRKLNATVLASFLNFALTPGSELHGRLFSYLPKEDEHDMDVDTATSGTQIVAKHSLPELEIYCYLLVLIFLIDQKRYNEAKACASASITRLKNLNRRTVDVLASRLYFYYSLSYELTGDLAEIRGNLLSLHRIATLRRDELGQETLLNLLLRNYLHYNLYDQAEKLRSKAPRFEAHSNQQFCRYLFYLGKIRTIQLEYTDAKESLLQAARKAPVAALGFRVQCNKWAIIVRLLLGEIPERTVFMQKGMENALRPYFELTNAVRIGDLELFRNVAEKFSDTFNSDRTHNLIVRLRHNVIRTGLRNISISYSRVSLVDVAKKLRLDSANPVADAESIVSKAIRDGAIDATIDHANGWMVSKETGDIYSTNEPQFAFNSRIAFCLNMHNEAVRALRFPPNSHKEKECAEKRRERQQQEQELAKHIAEEDDDEF

SEQ ID NO: 3179 - protein, 487 aa, Glycine max
MTQDLEMRDRSTPSNSVSLPAPSTLQHLKEIASLIETGSYSKEVRRIARAVRLTIALRRKLTASAISSFLDLVLTPGSEVHAKLSAYLPKEDDHEMEVDAATSAIQTPAKHLLPELEIYCYLLVLLFLIDQKKYNEAKACSSASIVWLKNTNRRTVDVIASRLYFYYSYSYELTGDLAEIRGNLLALHRFATLRHDELGQETLLNLLLRNYLHYNLYDQAEKLRSKAPRFEAHSNQQFCRYLFYLGKIRTIQLEYTDAKESLLQAARKAPVAARGFRIQCNKWAVIVRLLLGEIPERTVFMQKGMEKALRPYFELTNAVRIGDLELFRNIADKFATTFNADRTHNLIVRLRHNVIRTGLRNISISYSRISLADVAKKLRLNSANPVADAESIVSKAIRDGAIDATLDHANGWMVSKETGDIYSTNEPQSAFNSRIAFCLNMHNEAVRALRFPPNTHKEKESAEKRRERQQQEQELAKHIAEEDDDDF

SEQ ID NO: 3180 - protein, 485 aa, Momordica charantia
MTQDAEMNELPAPLSSSSSSTSPSTLQHLKEIVSLLETGAYAREVRRIVRAIRLTMALRRKLKASVLSQFLNLVLPPGSEVHSRLSSFLPKDDGYEMDVDSATQAPAKHPLPEIEIFCYLIVLIFLIDQKKYDEAKACASASIARLKNLNRRTVDVLASRLYFYYSLSYELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPIAALGFRVQCNKWAIIVRLLLGEIPERTVFMQKGMETALRPYFELTNAVRIGDLELFRTVAEKFSSTFSTDRTNNLIVRLRHNVIRTGLRNISISYSRISLADVAKKLRLDCANPVADAESIVSKAIRDGAIDATVDHANGWMVSKETGDIYLTNEPQIAFNSRIAFCLNMHNEAVRALRFPPNSHKEKESAEKRRERQQQEQELAKHIAEEDDDDF

SEQ ID NO: 3181 - protein, 487 aa, Tropaeolum majus
MTQDVEMKDHQTPSQSVSSAVPSTLQSLKEIAALIDTGSYTKEVRRIARAVRLTMCLRRKLTVAVLSAFLDFALVQGSEIHARLSAYLPKDNEHEMEVDTATSATQTAAKHPSPELEIHCYLLVLLFLIDHKKYSEAKACSSASIVRLKNLNRRTVDVLASRLYFYYSYSYELMGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPIAARGFRIQCNKWAILVRLLLGEIPERTVFMQKGMEKALRPYFELTNAVRIGDLELFRSIADKFAATFSADRTHNLIVRLRHNVIRTGLRNISISYSRISLADVAKKLRLNSANPVADAESIVAKAIRDGAIDATLDHANGWMVSKETGDIYSTNEPQVAFNSRIAFCLNMHNEAVRALRYPPNTHKEKESAEKRRERQQQEQELAQHIAEEDDDDF

SEQ ID NO: 3182 - protein, 486 aa, Populus trichocarpa
MTQDVEMKEQHQPSNSTTSSPSTLHHLKEIASLIETGAYAKETRRIQRAVRLTNTLRRKLKASVLYAFLNFALSAGSESFNRLISYLPKEDEYEMEVDTATSVTQAPAKHPLPELEIYCYLLVLIFLIDQKKHIEAKACSSASIARLKNLNRRTVDVLASRLYSYYSLSYELTGDLAEIRGSLLALHRIATLRHDELGQETLLNLLLRNYLHYNLYDQAEKLRSKAPRFEAHSNQQFCRYLFYLGKIRTIQLEYTDAKESLLQAARKAPAAALAFRVQCNKWAVIVRLLLGEIPERTVFMQKGMESALRPYFELTNAVRIGDLELFKSVAEKFSSTFSKDRTHNLIVRLRHNVIRTGLRNISISYSRISLADVAKKLRLDSANPVADAESIVAKAIRDGAIDATLDRANGWMVSKETGDIYSTNEPQLAFNSRIAFCLNMHNEAVRALRFPPNSHKEKESAEKRRERQQQEQELAKHIAEEDDDEF

SEQ ID NO: 3183 - protein, 490 aa, Medicago truncatula
MTQDLEMKDRSTPSNSVSPPVPSTLQHLKEIASVIETGSYSKEVRRIARAVRLTIALRKKLTASVISSFLDHVLTPGSEPHAKLSAYLPKEDDHEMEVDAATSAIQTPIPTAKHLLPELEIYCYLLVLLFLIDQKKYNEAKACSSASVAWLKNVNRRTVDVIASRLFFYYSYSHELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPVAARGFRIQCNKWAIIVRLLLGEIPERTVFMQKGMEKALRPYFELTNAVRIGDLELFRNIADKFATTFSADGTHNLIVRLRHNVIRTGLRNISISYSRISLADVAKKLRLDSPNPVADAESIVSKAIRDGAIDATLDHANGWMVSKETGDIYSTNEPQLAFNSRIAFCLNMHNEAVRALRFPPNTHKEKESAEKRRERQQQEQELAKHIAEEDDDDF

SEQ ID NO: 3184 - protein, 485 aa, Cucumis melo
MTQDAEMKELPAPLSSSSSSASPSALQNLKEIVSLIETGAYAREVRRIVRAIRLTMALRRKLKASVLSQFLNLVLPTGSEVHTRLSSFLPKEDDCEMDVDTATQAPAKHPLPEIEIYSYLIVLIFLIDHKKYDDAKACASASIARLKNLNRRTVDVLASRLYFYYSLSYELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPIAALGFRVQCNKWAIIVRLLLGEIPERTVFMQKGMETALRPYFELTNAVRIGDLELFRTVAEKFSSTFSSDRTNNLIVRLRHNVIRTGLRNISISYSRISLVDVAKKLRLDSANPVADAESIVSKAIRDGAIDATVDHANGWMVSKETGDIYSTNEPQIAFNSRIAFCLNMHNEAVRALRFPPNSHKEKESAEKRRERQQQEQELAKHIAEEDDDDF

SEQ ID NO: 3185 - protein, 487 aa, Arachis hypogaea
MTQDLEMKDRSTPSNSVSSAVPSTLQHLKEIASLIETGSYSKEVRRIARAVRLTIALRRKLTASVISSFLDYVLTTGSEAHAKLSAYIPKDEDHEMEVDAATSAIQTPAKHLLPEIEIYCYLLVLLFLIDQKRYNEAKACSSASIVLLKNLNRRTVDVIASRLYFYYSYSYELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPVAARGFRIQCNKWAVIVRLLLGEIPERTVFMQRGMEKALRPYFELTNAVRIGDLELFRNIADKFATTFSTDRTHNLIVRLRHNVIRTGLRNISISYSRISLADVAKKLRLNSANPVADAESIVSKAIRDGAIDATLDHANGWMVSKETGDIYSTNEPQLAFNSRIAFCLNMHNEAVRALRFPPNTHKEKESAEKRRERQQQEQELAKHIAEEDDDEF

SEQ ID NO: 3186 - protein, 488 aa, Nicotiana tabacum
MTQDVEMKEQAAPPSNSLSSTAPSIFHHLKEIASLIETGAYAREVRRISRAVRLTMALRKKLKASSLSAFLNYVLVPGSEVHSRLSSFLPKEDEQDMEVDTATSGAQAPIKNPLPELEIYCYLLVLIFLIDQKKYNEAKACSSASIARLKTVNRRTVDVLASRLYFYYSLCYELTGDLAEIRGNLLALHRIATLRHDELGQETLLNLLLRNYLHYNLYDQAEKLRSKAPRFEAHSNQQFSRYLFYLGKIRTIQLEYTDAKESLLQAARKAPQAALGFRVQCNKWAIIVRLLLGEIPERTVFMQKGMEKALRPYFELTNAVRIGDLELFRKVAEKFSSTFSSDGTNNLIVRLRHNVIRTGLRNISISYSRISLVDVAKKLRLDSPNPVADAESIVSKAIRDGAIDATLDHANGWMVSKETGDIYSTNEPQIAFNSRIAFCLNMHNEAVRALRFPPNSHKEKESAEKRRERQQQEQELAKHIAEEDDDDF

SEQ ID NO: 3187 - protein, 488 aa, Populus trichocarpa
MTQDVEMKEQQQQPSNSTTSSSPSTLHHLKEIASLIETGAYAKEARRIVRAVRLTMTLRRKLKASVLSAFLNFALSAGSEPFNRLISYLPKEDAHEMEVDSVTSVTQAPAKYPLPELEIYCYLLVLIFLIDQKKYNEAKTCSSASIARLKNLNRRTVDVLASRLYSYYSLSYELTGDLAEIRGNLLALHRVATLRHDELGQETLLNLLLRNYLHYNLYDQAEKLRSKAPRFEAHSNQQFCRYLFYLGKIRTIQLEYTDAKESLLQAARKAPAAALGFRVLCNKWAVIVRLLLGEIPERTVFMQKGMENALRPYFELTNAVRIGDLELFKSIAEKFSSTFNADRTLNLIVRLRHNVIRTGLRNISISYSRISLADVAKKLRLDSANPVAEAESIVAKAIRDGAIDATLDHANGWMVSKETGDIYSTNEPQIAFNSRIAFCLNMHNEAVRALRFPPNSHKEKESAEKRRERQQQEQELAKHIAEEDDDEF

SEQ ID NO: 3188 - protein, 489 aa, Helianthus annuus
MTQDVEMKEQQVVAAAPSNSTSSATPVLQHLKEIAALIETGAYAREVRRILRAVRLTIALRRKLKASVISSFLGFALAPGSEAHSRLTSYLPKDDQSDMEVDTAASATQATVKHSSELEIYCYLLVLIFLIDQKKYSEAKACSSASIARLKNLNRRTIDVLASRLYFYYSLSYELTDDLAEIRGNLLALHRVATLRHDELGQETLLNLLLRNYLHYNLYDQAEKLRSKAPRFEAHSNQQFCRYLFYLGKIRTIQLEYTDAKESLLQAARKAPVAALGFRVQCNKWAVIVRLLLGEIPERTVFMQKGMEKALRPYFELTNAVRIGDLELFKTVAEKFSTTFSSDRTNNLIVRLRHNVIRTGLRNISISYSRISLADVAKKLRLDSPNPVADAESIVSKAIRDGAIDATLDHANGWMVSKETGDIYSTNEPQQAFNSRIAFCLNMHNEAVRALRFPPNSHKEKESAEKRRERQQQEQELAKHIAEEDEDDF

SEQ ID NO: 3189 - protein, 487 aa, Manihot esculenta
MTEDVEMKELPAPSNSTTTTSPSTLNHLKEIASLIETGAYAREVRRIVRAVRLTMALRRKLKAQVLSAFLNFALTPGSEPHNRLVSYLPKEDVHEMECDTASSVSQTPMKHPLPELEIYCYLLVLIYLIDQKKYNEAKACSSASVARLKNVNRRTVDVLASRLYFYYSLSYELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPVAALGFRVQCNKWAIIVRLLLGEIPERTVFMQKGMENALKPYFELTNAVRIGDLELFKSVAEKFSTIFSSDRTHNLIVRLRHNVIRTGLRNISISYSRISLADVAKKLRLDSANPVADAESIVAKAIRDGAIDATLDHANGWMVSKETGDIYSTNEPQIAFNSRIAFCLNMHNEAVRALRFPPNSHKEKESAEKRRERQQQEQELAKHIAEEDDDEF

SEQ ID NO: 3190 - protein, 492 aa, Artemisia annua
MTQDVEMKEQPQVPATAAAVSNSVSSPTPVLQHLKEIAALIETGAYAREVRRILRAVRLTIALRRKLKAGVVSTFLQFALVAGSEAHTRLSAYLPKDDENDMEVDTASSAPQATVKHSPELEIYCYLLVLIFLIDQKKYTEAKACSSASIARLKNLNRRTVDVLASRLYFYYSLSYELTDSLSEIRGNLLALHRVATLRHDELGQETLLNLLLRNYLHYNLYDQAEKLRSKAPRFEAHSNQQFCRYLFYLGKIRTIQLEYTDAKESLLQAARKAPVAALGFRVQCNKWAVIVRLLLGEIPERTVFMQKGMEKALRPYFELTNAVRIGDLELFKTKAEKFSSTFTSDRTNNLIVRLRHNVIRTGLRNISISYSRISLADVAKKLRLDSPNPVADAESIVSKAIRDGAIDATLDHANGWMVSKETGDIYSTNEPQLAFNSRIAFCLNMHNEAVRALRFPPNSHKEKESAEKRRERQQQEQELAKHIAEEDDDDF

SEQ ID NO: 3191 - protein, 487 aa, Vigna unguiculata
MTQDLEMKDRSTPSNSVSSPAPSTLQHLREIASLIETGSYSKEVRRIARAVRLTIALRRKLTSSIISSFLDHVLTPGSEAHAKLSAYLPKEDDHEMEVDAATSAIQTPAKHLLPELEIYCYLLVLLFLIDKKKYNEAKACSSASIVWLKNTNRRTVDVIASRLYFYYSYSYELTGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPVAARGFRIQCNKWAVIVRLLLGEIPERTVFMQKGMEKALRPYFELTNAVRIGDLELFRNIADKFATTFNADRTHNLIVRLRHNVIRTGLRNISISYSRISLADVAKKLRLNSPNPIADAESIVSKAIRDGAIDATLDHANGWMVSKETGDIYSTNEPQLAFNSRIAFCLNMHNEAVRALRFPPNTHKEKESAEKRRERQQQEQELAKHIAEEDDDDF

SEQ ID NO: 3192 - protein, 487 aa, Glycine max
MTQDLEMKDRSTPSNSVSSPAPSTLQHLKEIASLIETGSYSKEVRRIARAVRLTIALRRKLTASAISSFLDHVLTPGSEVHAKLSAYLPKDDDHEMEVDAATSAIQTPAKHLLPELEIYCYLLVLLFLIDQKKYSEAKACSSASIVWLKNINRRTVDVIASRLYFYYSYSYELMGDLAEIRGNLLALHRIATLRHDELGQETLLNLLLRNYLHYNLYDQAEKLRSKAPRFEAHSNQQFCRYLFYLGKIRTIQLEYTDAKESLLQAARKAPVAARGFRIQCNKWAVIVRLLLGEIPERTVFMQKGMEKALRPYFELTNAVRIGDLELFRNIADKFATTFNADRTHNLIVRLRHNVIRTGLRNISISYSRISLADVAKKLRLNSASPVADAESIVSKAIRDGAIDATLDHANGWMVSKETGDIYSTNEPQLAFNSRIAFCLNMHNEAVRALRFPPNTHKEKESAEKRRERQQQEQELAKHIAEEDDDDF

SEQ ID NO: 3193 - protein, 298 aa, Ricinus communis
MTQDVEMKEVPAAAAAPSNSTTSSSPSTLQHLKEIASLIETGAYAREVRRIVRAVRLTMALRRKLKAQLLSAFLNSILTPGSDPYTRLSSFLPKEDDHEMEVDTATSVTQAPAKHPLPELEMYCYLLVLIYLIDQKKYNEAKACSTACIARLKNLNRRTVDVLASRLYFYYSLSYELTGDLAEIRGNLLALHRIATLRHDELGQETLLNLLLRNYLHYNLYDQAEKLRSKAPRFEAHSNQQASLYSVGTSFTWERFGQFSWSTLTQRNPSYKLLGNPLLQHSVFEFSATSGQLLSDYC

SEQ ID NO: 3194 - protein, 284 aa, Triticum aestivum
MAAAIDLSGEDLVRALEPFIREASAPPPLHSHLSPTSPFSFPHAAYSGYPYGVQAQAQTELSPAQMHYIQARLHLQRQTGQPGHLGPRPQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPATTTAAEVPEMQQLDFSEAPWDEAACFALTKYPSYEIDWDSLLAAN

SEQ ID NO: 3195 - protein, 284 aa, Triticum aestivum
MAAAIDLSGEDLVRALEPFIREASAPPPLHSHLSPTSPFSFPHAAYSGYPYGVQAQAQTELSPAQMHYIQARLHLQRQTGQPGHLGPRPQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNGKKSASVSASTAAATSSTPTSNCSSPSSDEASSSLESAESSPSPATTTAAEVPEMQQLDFSEAPWDEAACFALTKYPSYEIDWDSLLATN

SEQ ID NO: 3196 - protein, 284 aa, Triticum aestivum
MAAAIDLSGEDLVRALEPFIREASAPLPLHSHLSPTSPFSFPHAAYSGYPYGVQAQAQTELSPAQMHYIQARLHLQRQTGQPGQLGPRSQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPAATTAADVPEMQQLDFSEAPWDEAACFALTKYPSYEIDWDSLLATN

SEQ ID NO: 3197 - protein, 282 aa, Avena sativa
MAAAIDLSGEDLLRALEPFIRDDSASPPLHSHLSPTSPFSFPHAAYSGYPYGVQAQAELSPAQMHYIQARLHLQRQTGQPGHLGPRAQPMKPASVAAATPPRPQKLYRGVRQRHWGKWVAEIRLPRNRTRLWLGTFDTAEEAALAYDQAAYRLRGDGARLNFPDNAASRGPLHASVDAKLQTLCQNITASKNAKKTASVSASTAAATSSTPTSNCSSPSSDDASSSLESAESSPSPTTTAAAEALEMQQLDFSEAPWDEAAGFALTKYPSYEIDWDSLLATN

SEQ ID NO: 3198 - protein, 282 aa, Brachypodium distachyon
MAAAIDLSGEELMRALEPFIRDASASPPPLNSHPSPTSPFSFPHAAYQGYPYGVQAQAQAELSPAEMHYIQARLHLQRQTGPPGHLGPRAQPMKPASTAAATPPRPQKLYRGVRQRHWGKWVAEIRLPRNRTRLWLGTFDTAEEAALAYDQAAYRLRGDAARLNFPDNAASRGPLDASVDAKLQTLCQNITASKNAKKSKSSSASAATSSTPTSNCSSPSSDEASSSLESAESSPSPATNAAEVPEMQQLDFSEAPWDEAAGFALTKYPSYEIDWDSLLATN

SEQ ID NO: 3199 - protein, 291 aa, Oryza sativa
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 3200 - protein, 69 aa, Brachypodium distachyon
MASVKAVKPTGPAAQAKEPAKLSATKEPAKLSATAKKPAAAKGGIKKAESKPREPKKRVKSSKPAAVKN

SEQ ID NO: 3201 - protein, 384 aa, Sorghum bicolor
MAAAAASSSPPAAITCRAAVAWGPGQPLVMEEVEVAPPGPMEIRVKVVSTSVCRSDVTAWQSKAQPDLFPRVFGHEASGVVESVGEGVTEFQVGDHVLTVFIGECKSCKHCVSGKSNMCQKLGLERKGVMHSDQKTRFSVKGKPAYHYCAVSSFSEYTVVHSGCAVKVGLTVPMDRVCLLSCGVSAGLGAVWNVANVSKGSSVAIFGLGTVGLSVAQGAKLRGASKIIGVDTNAEKQEKGKLFGVTDFINPDELSEPVQQVIKRITDGGVDYSFECVGDTGVVSTALQSCSDGWGVTVTLGVPKTKPEVSAHYAFLLSGRTLKGSLFGGWRPKSDLPSLVDKYADKEIQVDGLVTHDIPFSEINKALELMLENKCLRCVIHMPQ

SEQ ID NO: 3202 - protein, 194 aa, Setaria italica
MAADAASSSPPAAITCRAAVAWGPGQPLVMEEVEVAPPGAMEIRVKVVSTSVCRSDVTAWQSKAQPDLFPRIFGHEASGVVESVGEGVTEFQVGDHVLTVFIGECQSCKHCVSGKSNMCQKLGLERKGVMHSDQMTRFSVKGKPVYSVQLQRVHGCSFRMCCEGRPDSANGQGVPAELRCVCRTWCSLECCRCI

SEQ ID NO: 3203 - protein, 120 aa, Panicum virgatum
  misc_feature (42)..(42): Xaa can be any naturally occurring amino acid
  misc_feature (101)..(101): Xaa can be any naturally occurring amino acid
MTDGGADYSFECVGDTGVVSTALQSCSDGWGVTVTLGVPKAXPEVSAHYAFLLSGRTLKGSLFGGWRPKSDLPSLVDKYADKEIQVDGLVTHDIPFGDINXALELMLENKCLRCVIHMSQ

SEQ ID NO: 3204 - protein, 384 aa, Zea mays
MAAADASSLPPSAITCRAAVAWGPGQPLVMEEVEVAPPGPMEIRVKVVSTSVCRSDVTAWQSKAQLDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSSGLGAVWNVANVSKGSSVAIFGLGTVGLSVAQGAKLRGASKIIGVDTNPEKQEKGKSFGVTDFINPDELSEPVQQVIKRITDGGVDYSFECVGDSGVVSTALQSCSDGWGVTVTLGLPKGKLEVSTHYAFLLSGRTLKGSMFGGWKPKSDLPSLVDKYAAKEIQVDGLVTHDIPFNEINKALELMLENKCLRCVIHMPR

SEQ ID NO: 3205 - protein, 295 aa, Saccharum officinarum
MAAAAASSSPPAAITCRAAVAWGPGQPLVMEEVEVAPPGPMEIRVKVVSTSICRSDVTAWQSKAQPDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSAGLGAVWNVANVSKGSSVAIFGLGTVGLSVAQGAKLRGASKIIGVDTNSEKQEKGKSFGVTDFINPDELSEPVQQVIKRITDGGVDYSFECVGDTGVVSTALQSCSDAGE

SEQ ID NO: 3206 - protein, 366 aa, Pennisetum glaucum
AVAWGPGQPLVMEEVEVAPPGAMEIRVKVVSTSVCRSDVTAWQSKAQPDLFPRIFGHEASGVVESVGQGVAEFQVGDHVLTVFIGECQSCKHCVSGKSNMCQKLGLERKGVMHSDQKTRFSVKGKPVYHYCAVSSFSEYMVVHSGCAVKVGPTVPMDRVCLLSCGVSAGLGAAWNVADVSEGSSVVIFGLGTVGLSVAQGAKLRGASKIIGVDTNPEKQEKGKAFGVTDFINPNVLSEPVQQVIKRMTDGGADYSFECVGDTGVVSTALQSCSDGWGVTVTLGVPKAKPEVSAHYAFLLSGRTLKGSLFGGWRPKSDLPSLVNKYADKEIQVDGLVTHDIPFGDINRALDLMLESKCLRCVIHMSQ

SEQ ID NO: 3207 - protein, 344 aa, Setaria italica
MEIRVKVVSTSVCRSDVTAWQSKAQPDLFPRIFGHEASGVVESVGEGVTEFQVGDHVLTVFIGECQSCKHCVSGKSNMCQKLGLERKGVMHSDQMTRFSVKGKPVYHYCAVSSFSEYTVVHSGCAVKVGLTVPMDRVCLLSCGVSAGLGAAWNVADVSEGSSVVIFGLGTVGLSVAQGAKLRGASKIIGVDTNPEKQEKGKAFGVTDFINPNELSEPVQQVIKRMTDGGADYSFECVGDTGVVSTALQSCSDGWGVTVTLGVPKAKPEVSAHYAFLLSGRTLKGSLFGGWRPKSDLPSLVNKYADKEIQVDGLVTHDIPFGDINRALELMLESKCLRCVIHMSQ

SEQ ID NO: 3208 - protein, 175 aa, Triticum aestivum
MAPAVMASSATTVAPFQGLKSTTGLPISRRSGSAGLNNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 3209 - protein, 210 aa, Triticum aestivum
CPIFWGTSSPPSSNQKAKAVSRSRISPGNWSIHGIPQLGPEGPLPWTEVLDKKPGGLHPSQPIYLLSTGHGPHRDGLVGHLHRPFQGVKSTPGLPVSSRSKGANLGSVSNPGRIKCMQMWLIEGIKKFETLSYLPPLSTEALLKQVDYLIRSKWVPCLEFSKLRFIFREHNASPGYYDARYWTMWKLPMFGCSDATQVIHEVEEVTEGVP

SEQ ID NO: 3210 - protein, 171 aa, Triticum aestivum
LVPHPPLLQIIHYHGPRRDGFLGYHRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 3211 - protein, 151 aa, Hordeum vulgare
MAPTVMASSATSVAPFQGLKSTGGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFH

SEQ ID NO: 3212 - protein, 148 aa, Triticum aestivum
MAPAVMASSATTVAPFQGLKSTTGLPISRRSGSAGLNNVSNGGRIRCMQVWPIEGIKKFETLSYLPPLSTEALLKQVDYLIRSKWVPCLEFSKVGFVFREHNSSPGYYDGRYWTMWKLPMFGCTDATQVQCVSFIAFRPPGCEESGKA

SEQ ID NO: 3213 - protein, 152 aa, Triticum aestivum
TRVSRRSSSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 3214 - protein, 154 aa, Triticum aestivum
  misc_feature (5)..(5): Xaa can be any naturally occurring amino acid
  misc_feature (43)..(44): Xaa can be any naturally occurring amino acid
MAVEXITEGVRGLKVEDGEGAAGAAADAPAAAAGGEGQRRGAXXSSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 3215 - protein, 155 aa, Triticum aestivum
MAVEGITEGVRGLKVEDGEGAAGAAADAPAAAAAAGEGQRRGASGSSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 3216 - protein, 156 aa, Triticum aestivum
MAVEEITEGVRGLKVEDGEGAAGAAADAPAAAAAGGEGTQSRGASASSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 3217 - protein, 156 aa, Triticum aestivum
MAVEGITEGVRGLKVEDGEGAAGAAADAPAAAAAAGEGTQSRGASGSSNRIQVSNTKKPLFFYVNLAKRYMQQHGDVELSALGMAIATVVTVAEILKNNGLAVEKKIRTSTVEINDESRGRPFQKAKIEIELGKSEKFDELMASAAADAEEGEEEA

SEQ ID NO: 3218 - protein, 150 aa, Brachypodium distachyon
MAVEEITEGVRALAVQDGEAAAPPGGAAEGQQRRGTNSSSNRIQVSNTKKPLFFYVNLAKRYMQQHGDVELSALGMAIATVVTVAEILKNNGLAVEKKIRTSTVEINDESRGRPFQKAKIEIELGKSEKFDELMAAAAEDREAEEGEEHA

SEQ ID NO: 3219 - protein, 152 aa, Oryza sativa
MAVEEITEGVRNLAVEGEPAAAAAAAGGGGEGAQRRAAGSSSNRIQVSNTKKPLFFYVNLAKRYMQQHGDVELSALGMAIATVVTVAEILKNNGFAVEKKIRTSTVEINDESRVRPLQKAKIEIVLEKSEKFDELMAAAAEEREAAEAEEQA

SEQ ID NO: 3220 - protein, 335 aa, Leymus cinereus x Leymus triticoides
  misc_feature (5)..(6): Xaa can be any naturally occurring amino acid
GLRSXXLRAEAAKEAEVGELRSGVSVYKPRSYEVLVSDAARSLAAAIDDGRTRLEIEFPPLPSSISSYKGSSDEFIDANVQLALAVVRDLKKLKGTRSCIVFPDQPEKRRASQIFKTAIDQIEGISISSLDDLPTGPVDTFFKSIRSTLDFDFADDNEDRWKSDEPASLYIFINSSTRDLASIEKYVDQFAASVPAVLFNLELDTLRSDLGLLGFPPKDLHYRFLSQFTPVFYIRQRDYSKTIAVTPYIVNYSGAVFRQYPGPWQVMLKQADGSYACVAESASRFTLGQAKDELLRVLGLQEEVGSQLEFLRRGYKNATWWEENFDQEKSPAWRT

SEQ ID NO: 3221 - protein, 371 aa, Triticum aestivum
MAPLSTAVRLLRSPAAPATLPSPSARLAGAPARFRCRGRLRSVRAEAAKEAEVGELRAGVSVYKPRSYEVLVSDAARSLAAAIDDGRTRLEIEFPPLPSSISSYKGSSDEFIDANVQLALAVVRDLKKLKGTRSCIVFPDQPEKRRASQIFKTAIDQIEGISISSLDDLPTGPVDTFFKSIRSTLDFDFADDNEDQWKSDEPPSLYIFINSSTGDLSSIEKYVDQFAASVPAVLFNLELDTLRSDLGLLGFPPKDLHYRFLSQFTPVFYIRQRDYSKTIAVTPYIVNYSGAVFRQYPGPWQVMLKQGDGSYACVAESASRFTLGQAKDELLRVLGLQEEVGSQLEFLRRGYKNATWWEENFDQEKSPAWRT

SEQ ID NO: 3222 - protein, 404 aa, Triticum aestivum
CGLASPSLLAAGRQPPPEQSTPSSLPPPPPRPAMAPLSTAVRLLRSPAAPVTLPSPSARLAGAPARFRCRRRLRSVRAEAAKEAEVGELRAGVSVYKPRSYEVLVSDAARSLAAAIDDGRTRLEIEFPPLPSSISSYKGSSDEFIDANVQLALAVVRDLKKLKGTRSCIVFPDQPEKRRASQIFKTAIDQIEGISISSLDDLPTGPVDTFFKSIRSTLDFDFADDNEDQWKSDEPPSLYIFINSSTGDLSSIEKYVDQFAASVPAVLFNLELDTLRSDLGLLGFPPKDLHYRFLSQFTPVFYIRQRDYSKTIAVTPYIVNYSGAVFRQYPGPWQVMLKQGDGSYACVAESASRFTLGQAKDELLRVLGLQEEVGSQLEFLRRGYKNATWWEENFDQEKSPAWRT

SEQ ID NO: 3223 - protein, 375 aa, Avena sativa
MASLSTAARLPRCPGTPRRAPPPSPTGPAAPPLRFRGRRRRSLPSVRAEAAKEVEEAVELKSGVAVYKPRSYEVLVADAARSLAAAIGDGRTRLEIEFPPLPSSISSYKGSSDEFIDANVQLALAVVRSLKKLRETRACIVFPDQPEKRRASEIFKTAIDSIEGISISSLDDVPTGPVDTFFRSIRKTLDFDFNDENEDQWKSDEQTSLYIFINSSTQDLSSIEKYVEIFAASASVVLFNLELDTLRSDLGLLGFPPKDLHYRFLSQFTPVFYIRQRDYSKTIAVTPYIVNYSGAVFRQYPGPWQVMLKQADGSYACVAESASRFTLGQAKDELLRVLGLQEEEGSSLQFLRQGYKNATWWEENVDQEESTAWRT

SEQ ID NO: 3224 - protein, 379 aa, Zea mays
MAMAAPPPTALCARRFRPHHFAYSSPATLRLPTASSSSQLRRRRRLAVSPRADAATGTGDVEALRAGVSVYKPRSYDVLVTDAARSLACAIDDGKTRLEIEFPPLPSSISSYKGSSDEFIDANIQLALVVARKLKELKGTRSCIVFPDQPEKRRASELFKTAIDTIEGVTISSLDDVPTDPVNSFFKSIRNTLDFDFSDDNEGRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRQYPAPWQVMLKQADGSYACVAESEARFTLGQAKEELLRVIGLQEEEGSSLEFLRRGYKNATWWEENVDQETSSAWRT

SEQ ID NO: 3225 - protein, 385 aa, Sorghum bicolor
MAMAAPPPPTAVCARHFRLHLPCSSRLPMAAASASSSSPLRRRRRLAVSPRAEAGTGTGTGTGTGDVEALRAGVSVYKPRSYDVLVTDAARSLACAIDDGKTRLEIEFPPLPSSISSYKGSSDEFIDANIQLALVVARKLKELKGTKSCIVFPDQPEKRRASQLFRTAIDTIEGVTVSSLDDVPTDPVNSFFKSIRNTLDFDFSDDNEDRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRRYPGPWQVMLKQLDGSYACVAESEARFTLGQAKEELLRVIGLQEEEGSSLEFLRRGYKNATWWEENVDQETSAAWRT

SEQ ID NO: 3226 - protein, 377 aa, Oryza sativa
MATPAPLSGLRPRAPAPAPAARSRLCGQSPPVVAPRLGAFPRRRGGAARCSPRAEAGDVEALRAGVSVYKPRSYDVLVSDAARSLACAMDEGKTRLEIEFPPLPSNISSYKGSSDEFIDANIQLALAVARKLKELKGTRSCIVFPDLPEKRRASQLFGTALDSIETATISSLDEVSTGPVNTFFRSMRDTLDFDFADDVEDRWKSDEPPSLYIFINCSTRDLSTIEKYVEQFASSVPALLFNLELDTLRSDLGLLGFPPKDLHYRFLSQFTPVFYIRQRDYSKTIAVTPYIVNYSGAVFRQYPGPWQVMLKQADGSYACVAESAARFTLGQAKEELLRVLGLQEEQGSSLEFLRRGYKNATWWEENVDQEKSSAWRT

SEQ ID NO: 3227 - protein, 93 aa, Triticum aestivum
MAASVACAFFFEAEPVGEPGMPALDACALCAKRLVRDSDVFMYRGDTPFCSEECRHEQMQLDAVSARQAARRLQRFSAGAESGRARHGVSVSS

SEQ ID NO: 3228 - protein, 93 aa, Secale cereale
  misc_feature (51)..(51): Xaa can be any naturally occurring amino acid
MAASVACAFFFDAEPVGEHGMPALDACALCAKRLARDSDVFMYRGDTPFCXKECRHEQMQLDAVSARQAARRLQRFSAGAESGCAHHGVSVSS

SEQ ID NO: 3229 - protein, 96 aa, Triticum aestivum
MAASVACAFFFDAEPVGEPGMPALDACALCAKPLARDSDVFMYRGDTPFCSEECRHEQMHLDAVSARQAARRVQRFSAEAECHRGQRQSRKVSIAS

SEQ ID NO: 3230 - protein, 96 aa, Triticum aestivum
MAASVACAFFFDAEPVGEPGMPALDACALCAKPLARDSDVFMYRGDTPFCSEECRHEQMHLDAVCARQAARRLQRFTAEAECHRGQRQSRKVSIAS

SEQ ID NO: 3231 - protein, 120 aa, Triticum aestivum
MAASVACAFFFDAEPAGEPGKHALDACALCAKRLARDRDVFMYRGDTPFCSEECRHEQMHLDAVSARQAARRLQRFLAGDGVPVPPWAAAVQEGVHRQLAGESFVGIYNICILKKTTSVF

SEQ ID NO: 3232 - protein, 96 aa, Hordeum vulgare
MAASVACSFFFDAELLGEPGMPAMDACALCAKPLARDSDVFMYRGDTPFCSEECRQEQMHLDAVCARQAARRQQRFSAETESHRGQRRSRKVPVAS

SEQ ID NO: 3233 - protein, 96 aa, Pseudoroegneria spicata
MAASVACAFFFDAEPAGEPGKHALDACALCAKRLVRDSDVFMYRGDTPFCSEECRREQMHLDTVSARQAARRLQRFSAETESHCGQRQSRKVSIAS

SEQ ID NO: 3234 - protein, 100 aa, Triticum aestivum
MAASVACAFFFDAEPVGEPGVHALDACALCTKPLARDSDIFMYRGDTPFCSDECRHEQMQLDAACARQAARAAARRQKQFSSGTESGRARRESWEVSVAS

SEQ ID NO: 3235 - protein, 98 aa, Triticum aestivum
MSKPSRCRALRTQVALLLVLLVAASLLPAGDAASGFCAGKCAVRCGRSRAKRGACMKYCGLCCEECACVPTGRSGSRDECPCYRDMLTAGPRKRPKCP

SEQ ID NO: 3236 - protein, 98 aa, Pseudoroegneria spicata
MTKPSRCRALQMQVALLLVLLVAASLLQAGDAASGFCAGKCAVRCGRSRAKRGACMKYCGLCCEECACVPTGRSSNRDECPCYRDMLTAGPRKRPKCP

SEQ ID NO: 3237 - protein, 256 aa, Hordeum vulgare
GVPSVVARVSRPDWLRNAAGLADPSYWRGTLRPRPVLDWYLNRVEEAVSEARELGSPDGKLSLIGHSAGGWLARVYMEEFGTSDISLLLTLGTPHLPPPKGVSGVIDQTRGLLNYVEKNCAPAVYTPELRYVCIAGRYIQGAPLTGSSLAATTDELVAVDAPSEVAEAVMVSADNKTAPTGPTFRARFVGQGYKQVCGRADVWGDGVVPEVSAHLEGALNISFDGVYHSPVGSDDEERPWYGSPAILEQWVHHLLS

SEQ ID NO: 3238 - protein, 300 aa, Oryza sativa
MLSLLLPPARPRAAVSPDARVVVAQGLGNNTADYARLAAALRDDHGVPAVAVARVSRPDWLRNAAGLVDPSYWRCNLRPRPVLDWYLKRVDEAVSEARELSPNEGISLIGHSAGGWLARVYMEEFDASDISLLLTLGTPHLPPPKGTPGVIDQTRGLLTYVEKNCAPAVYTPELKYVCIAGRYIQGAPLTGNTIATTDDILAVDTPSDIAEAVMVSTNDKSTQSGPTLRARFIGQGYKQVCGRADVWGDGVVPEVSAHLEGALNISFDGVYHSPVGSDDEQRPWYGSPAILKQWVHHLLS

SEQ ID NO: 3239 - protein, 280 aa, Brachypodium distachyon
GAEQGLGNNTADYARLAGALRDDHGMPAAVVARVSRPDWLRNAAGLADLSYWRGTLRPRPVLDWYLGRVEEAVAEAKELCSPDGKLSLIGHSAGGWLARVYMEEFGTSDISLLLTLGTPHLPPPKGVSGVIDQTRGLLYYVEKNCAPAVYTPELRYVCIAGRYIKGARLTGNSITTADEIVAVDTTSEAAEAVMISADNISAPPGPTFRSRFVGQGYKQVCGRADVWGDGVVPEVSAHLEGALNISFDGVYHSPVGSDDEERPWYGSPAILQQWVHHLLS

SEQ ID NO: 3240 - protein, 416 aa, Triticum aestivum
MGCGLSTPDNDGGGGGARRKQGSVGDVVVFLPGLRAPMGVDLSQALAGRLDKSAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSMQALGQGVDMQLGLAIDSPKATLAVKRRLACEMVKYWHQVQESIPDLPVSDGWGKKHLLFVKWKYVEAKSAAYYFHGLILDEGNSEKSHGMAIAALEASEEFLKESKRASEVFHATPPTSRSPTPFGTAKYLFDKIPKEASSKVRINQDLYTPERVIGAPPPLPDFSLALTPEDYDLPPLDPLWNKEDGHQ

SEQ ID NO: 3241 - protein, 416 aa, Triticum aestivum
MGCGLSTPDSDGGGGGARRKQGNVGDVVVFLPGLRAPMGVDLSQALAGRLDKGAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSLQALGQGVDMQLGLAIDSPKATQAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERVIGAPPPLPDFSLALTPEDYDLPPLDPLWNKEDGHQ

SEQ ID NO: 3242 - protein, 416 aa, Triticum aestivum
MGCGLSTPDSDGGGGGARRKQGSVGDVVVFLPGLRAPMGVDLSQALAGRLDKSAVERLSALRARVVDMAMQESAVALKPRRKAAARHGSSTANLLQALEDYLPLLLGLVKEGSELRHSVQFVWTNQEDKAEETAMADAWYEVLSVLHLMAMVCLLQANSLLLPRAYGDGYGPRVSEESRRATVDVFLKASGYLDCAIRQVLPQIPSELRRQLPVDLAEGNLKALSLQALGQGVDMQLGLAIDSPKATQAVKRRLACEMVKYWHQVQESIPDLPVSDGWGKKHLLFVKWKYVEAKSAAYYFHGLILDEGNSEKSHGMAIAALEASEEFLKESKRASEAFHATPPTSRSPTPFGTAKYLFDKIPKEASSKVRINQDLYTPERVIGAPPPLPDFSLALTPEDYDLPPLDPLWNKEDGHQ

SEQ ID NO: 3243 - protein, 412 aa, Brachypodium distachyon
MGCGSSRQVDGDGPRRKPGSVGDVVVFLPGLRAPRSVDFSQALAGRLDKSAVERLSALRARVVELAMQESAAALKPKRKTAARHGSTTANLLQALEDYLPVLLGLVKEGSELRHIVQFVWANQEDNAEETAMEDAWYEVLSVLQLMAMVCLLQANSLLLPRAYGDGYGPRVSEESRRATVDVFLKAAGYLDCAIRQVLPHMPSELRRQLPVDLAEGNLKALSLQALGQGVDMQLGLAIDSPKATLAVKRRLACEMVKYWHQVQESIPELPVSDGWGKKHLLFVKWKYVEAKAAAYYFHGLILDEGNSEKFHGMAIAALQASEEFLKESKRASEAFHATPPASRSPTPFGTAKYMFDKIPKDASSKVRINQDLYTQERVIGAPPPLPDFSLALTPEDYDLPPLDSVWNKDNHQ

SEQ ID NO: 3244 - protein, 413 aa, Oryza sativa
MGCGLSREKDAGGGPRRRPGSVGDVVVFLPGLRVPRSVDFSQALAGRLDEASSRLSSLRARVVDMAMQESAAALKPKRRAAARHGSSTANLLQALEDYLPVLLGLVKEGSELRHGVHFVWTNQEDNAEETAMADAWYEVLSVLHLMAMVCLLQANSLLLPRSYGDGYAPRVSEESRRATVDVFLKASGYLDCAIRQVLPQISSELRRQLPVDLAEGNLKALSLQALGQGVDMQLGLAIDSPKATLAVKRRLACEMVKYWHQIQESIPEIPVSDGWGKKHLLFVKWKYVEAKAAAYYFHGLILDEGNTEKSHGMAVAALQASEEFLKESKRASEAFHATPPTSRSPTPFGTAKYMLDKIPKDASSKVKINQDLYTQERVIGTPPPLPDFALALKPDDYDLPPLDPLWNKEDSRQ

SEQ ID NO: 3245 - protein, 414 aa, Setaria italica
MGCGASSQKDAAGGPRRRPGSVGDVVVFLPGLRVPRSVDLAQALGGRLDRSIVERLSALRARVVEMAMQESAVALKPRRRAAARHGSSTANLLQALEEYLPVLLGLVKEGSMLRHAVQFTWTNQEDNAEETAMADAWYEVLSVLHLMAMVCLLQANTLLLPRSYGDGYAPRVSEESRRVTVDVFLKAAGYLDCAIRHVLPQIPPELRRQLPVDLVEGNLKALSLQALGQGVDMQLGLAIDSPKATLAVKRRLACEMIKYWQHVQESIPDLPGSDGWGKKHRLFVKWKYVEAKAAAYYFHGLILDEGNTEKSHGMAIAALQASEEFLKESKRVSEAFHATPPTSRSPTPFGTAKYMFDKIPKDASSKVRINQDLYTQEKVIGTPPPLPDFALALTPEDYDLPPLDPLWNKEDRRH

SEQ ID NO: 3246 - protein, 414 aa, Pennisetum glaucum
MGCGASSQKDAAGGPRRRPGSVGDVVVFLPGLRVPRSVDLAQALGGGLDGSIVERLSALRARVVEMAMQESAAALKPKRKTAARHGSSTANLLQALEDYLPVLLGLVKEGSTLRHAVQFTWTNQEDKAEETAMADAWYEVLSVLHLMAMVCLLQANTLLLPRSYGDGYAPRVSEESRRATVDVFLKAAGYLDCAIRHVLPQIPPELRRQLPVDLVEGNLKALSLQALGQGVDMQLGLAIDSPKATLAVKRRLACEMVKYWQQVQESIPELPGSDGWGKKHRLFIKWKYVEAKAAAYYFHGLILDEGNTEKSHGMAIAALQASEEFLKESKRVSEAFHASPPTSRSPTPFGTAKYMFDKIPKDASSKVRINQDLYTQEKVIGTPPPLPDFALALTPEDYDLPSLDPLWNKEDRRH

SEQ ID NO: 3247 - protein, 413 aa, Zea mays
MGCGASSQKDAGAPRRRPVSVGDVVVFLPGLRVPRAVDLAQALGGCLARSAVDRLSALRSRVVDMAMRESAAALKPRRRAAARHGSSTANLLQALEDYLPALLGLVKEGSVLRNKVHFTWSNQEDNAEETAMPDAWYEVLSMLHLMAMVCLLQANALLLPRSYGDGYAPRVSEESRRATVDVFLKAAGYLDCAVRHVLPKMPLELRRQLPVDLAEGNLKALSLQALGQGVDMQLGLAIDSPKATLAVKRRLACEMVKYWQQVQESIPELPISDGWGKKHRLFIKWKYVEAKAAAYYFHGLILDEGNTEKSHGMAIAALQASEEFLKESKRVSEAFHATPPTSRSPNPFGTAKYLFDKIPRDASSKVRINQDLYTQEKVIGAPPPLPDFALALTPEEYDLPPLDPLWNKEDTSH

SEQ ID NO: 3248 - protein, 230 aa, Zea mays
MGCGASSHKDAGARRRRPGSVGDVVVFLPGLRVPRAVDFAQALGGCLARAIVERLSALRSRVVEMAMQESAAALKPRRKAAARHGSSTANLLQALEDYLPVLLGLAQQGSVLRHKVQFTWSNQEDNAEETAISDVWYEVLSVLHLMAMVCLLQANTLLLPRSYGDGYAPRVSEESRRATVDVFLKAAGYLDCAIRHVLPKMPLELRRQLPVDLAEGNLKALSLQAFGSGG

SEQ ID NO: 3249 - protein, 413 aa, Zea mays
MGCGASSHKDAGARRRRPGSVGDVVVFLPGLRVPRAVDFAQALGGCLARAIVERLSALRSRVVEMAMQESAAALKPRRKAAARHGSSTANLLQALEDYLPVLLGLAQQGSVLRHKVQFTWSNQEDNAEETAISDVWYEVLSVLHLMAMVCLLQANTLLLPRSYGDGYAPRVSEESRRATVDVFLKAAGYLDCAIRHVLPKMPLELRRQLPVDLAEGNLKALSLQALGQGVDMQLGLAIDSPKATLAVKRRLACEMVKYWQQVQESIPELPVSDGWGKKHRLFVKWKYVEAKAAAYYFHGLILDEGNTEKSHGMAIAALQASEEFLKESKMVSEAFHATPPTSRSPNAFGTAKYLFDKIPRDASSKVRIKQDLYTQEKVIGAPPPLPDFALALTPEDYDLPPLDPLWNKEDTHH

SEQ ID NO: 3250 - protein, 414 aa, Sorghum bicolor
MGCGASSQKDAGPPRRRLGSVGDVVVFLPGLRAPRTVDFAHALAGCGVARSVVDRLSALRSRVVEMAMQESAAALKPRRRTAARHGSSTANLLQTLEDYLPVLLGLVKDGSILRHKVQFTWSNQEDSAEETAISDAWYEVLSVLHLMAMVCLLQANTLLLPRSYGDGYAPRVSEESRRATVDVFLKAAGYLDCAIRHVLPKMPLELRRQLPVDLAEGNLKALCLQALGQGVDMQLGLAIDSPKATLAVKRRLACEMVKYWQQVQESIPELPVSDGWGKKHRLFVKWKYVEAKAAAYYFHGLILDEGNTEKSHGMAIAALQASEEFLKESKRVSEAFHATPPTSRSPNPFGTAKYLFDKIPRDASSKVRINQDLYTQEKVIGAPPPLPDFALALTPEDYDLPPLDPLWNKEDTHH

SEQ ID NO: 3251 - protein, 282 aa, Triticum aestivum
SPGGWEGATVDEASMERSKSFVKALQELKNLRPQLYSASEYCEKSYLNTHQKQMVLDNLKDYAVRAVVNAVDHLGTVAYKLTDLFEQQASEISTFELKLARLNQQIFTCQIYVDKEGSRQQQMMGASMKHHKHYILPSTGYKRTQAVAHLGTDTNQESQPRPYPSAKTLSWHLASDNSPSANRAHKPTFILDDTIPSKLASDGPHLLGKELPASPVRRPLQLNRNTKSDVAQKVGAKDLSAFSSFDRPTGREIQKAPASTKSVLASLFIKHKSAKMKSISAR

SEQ ID NO: 3252 - protein, 301 aa, Triticum aestivum
  misc_feature (125)..(125): Xaa can be any naturally occurring amino acid
ERMQQQQEQEQQAARRRRRSPGGWEGATVDEASMERSKSFVKALQELKNLRPQLYSASEYCEKSYLNTHQKQMVLDNLKDYAVRAVVNAVDHLGTVAYKLTDLFEQQASEISTFELKLARLNQQXFTCQIYVDKEGSRQQQMMGASMKHHKHYILPSTGYKRTQAVAYLGTDTNQESQPRPYPSAKTLSWHLASDNSPSANRAHKPTFILDDTIPSKLASDGPHLLGKELPASPVRRPLQLNRNIKSDVAQKVGAKDLSAFSSFDRPTGREIQKAPASTKSVLASLFIKHKSAKMKSISAR

SEQ ID NO: 3253 - protein, 272 aa, Triticum aestivum
MRPTAAAAAKPSFFLARHQPFPTSSRAAAAAADPCKSPNKLRRIGRSWRAASAGSNRGDERGQSVSTVATTPSGRRARLSARRRESIRLLDVLPGQGGIGEFLRHPAGVESLLNTRALQSFAPVEPESESGPAGAFRCTLHPMGFLGFQVAPVLDLRVTPTRDDCTVEMLSCRFEGSDSIEQQNELFSAVMRNRITWGDNGDQEPCLDIDVNLEVTLEVYTKPFSLLPLSAVEKPGNLLMQGLLDRLVPMLGEQLLRDYHSWVQQQAQSSSS

SEQ ID NO: 3254 - protein, 272 aa, Triticum aestivum
  misc_feature (92)..(92): Xaa can be any naturally occurring amino acid
  misc_feature (126)..(126): Xaa can be any naturally occurring amino acid
  misc_feature (194)..(194): Xaa can be any naturally occurring amino acid
  misc_feature (212)..(212): Xaa can be any naturally occurring amino acid
  misc_feature (217)..(217): Xaa can be any naturally occurring amino acid
MRPTAAAAAKPSFFLARHQPFPTSSRAAAAAADPCKSPNKLRRIGRSWRAASAGSNRGDERGQSVSTVATTPSGRRARLSARRRESIRLLDXLPGQGGIGEFLRHPAGVESLLNTRALQSFAPVEXESESGPAGAFRCTLHPMGFLGFQVAPVLDLRVTPTRDDCTVEMLSCRFEGSDSIEQQNELFSAVMTNXITWGDNGDQEPCLDIDVXLEVTXEVYTKPFSLLPLSAVEKPGNLLMQGLLDRLVPMLGEQLLRDYHSWVQQQAQSSSS

SEQ ID NO: 3255 - protein, 276 aa, Avena sativa
MRPTAATRPSVFLARHQKPIPTSSRAAGLVAADPCKQIKNTNKRTGRSWRAASAGSKDGTDTDGGQSVSTTVVTPARRQARLSARRRETIRLLDVLPDLGGAARDGSIGEFLRHPAGVESLLNTRALQSFAPVESGPAGTFRCTLHPMGFLGFQVAPVLDLRVAPTHDDCTVEMLSCRFEGSDSIEQQNELFSAVMRNHITWGDNGDREPCLDIDVNLEVTLEVYTKPFSLLPLSAVEKPGNLLMQGLLDRLVPLLGEQLLKDYHSWVQQQPGSSS

SEQ ID NO: 3256 - protein, 158 aa, Triticum aestivum
MASYRLLVILVFSALLLDVAVADTYPADCPYPCLLPPPTPPASSADCPPPPSSPSGSGSGYAYPPPSSSGNSPPTPSSWSYPPPSGGYIPGFYQPPAGGGGGGGGNFGPAPPPPNPILPWYPWYYRSPPSSSATRGSASAVALCLVAAVTATAALVGY

SEQ ID NO: 3257 - protein, 419 aa, Hordeum vulgare
MEARRRAALVALAVLAMAAAAAEGYNITKILGEYPEYSQFNKLLTQTRLAQDINKRRTITVLVVANGDMGSLAGGGRTLQTIRHMLQIHVLVDYYGGKKLHQLAHGVTACSSMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADAEAYSTINATKDNGLTLFCPVDAAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKVAKDKDLAPAPAPEGPKKKKTTKKKPSAAASPSDDDDDDSAADSPDDDSSSDDATADKDGAAPSAVAGWVTAAVAVASALALAA

SEQ ID NO: 3258 - protein, 419 aa, Hordeum vulgare
MEARRRAALVALAVLAMAAAAAEGYNITKILGEYPEYSQFNKLLTQTRLAQDINKRRTITVLVVANSDMGSLAGGGRTLQTIRHMLQIHVLVDYYGGKKLHQLAHGVTACSSMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADAEAYSTINATKDNGLTLFCPVDAAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKVAKDKDLAPAPAPEGPKKKKTTKKKPSAAASPSDDDDDDSAADSPDDDSSSDDATADKDGAAPSAVAGWVTAAVAVASALALAA

SEQ ID NO: 3259 - protein, 414 aa, Triticum aestivum
MEARRRTLLVALAVLALAAAAEGYNITKILAAYPEYSQFNKLLTQTRLAQDINKRRTITVLVVANGDMGSLAGGGRTLQTIRHMLQIHVLVDYYGGKKLHQLAHGVTACSSMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADADAYSTINATKDNGLTLFCPVDSAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKIAKDIAPAPAPEAPKKKKTTKKKPSAAASPSDDDDDSTADSPDDSSSDDATADKDGAAPSAVAGWVTAAVAVASALALAA

SEQ ID NO: 3260 - protein, 417 aa, Triticum aestivum
MEARRRALLVALAVLALAAAAAEGYNITKILAAYPEYSQFNKLLTQTRLAQDINKRRTITVLVVANGDMGSLAGGGRTLQTIRHMLQIHVLVDYYGGKKLHQLAHGVTACSSMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADADAYSTINATKDNGLTLFCPVDSAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKIAKDIAPAPAPEAPKKKKTTKKKPSAAASPSDDDDDDDSTADSPDDSSSDDATADKDGAAPSAVAGWVTAAVAVASALALAA

SEQ ID NO: 3261 - protein, 510 aa, Brachypodium distachyon
MVAAARSTARWLLLLALVAAYHGGGASVRAAAGAGAHWLGGLSRASFPKGFVFGTATSAYQVEGMAASGGRGPSIWDAFSHIPGNVVGNTNADVTTDQYHRYKEDVNLMKGLNFDAYRFSISWSRIFPDGEGKVNEEGVAYYNNLINYLLQKGITPYINLYHADLPLALEKKYGGWLSAKTVELFADYADFCFKTFGNRVKHWFTLNEPRIACLLGYDVGSTPPQRCTKCAAGGNSATEPYIVAHNFLLAHGYAVARYRNKYQAAQQGKIGIVLDFNWYEALTNSAEDEAAAQRARDFHVGWFVDPLINGHYPQIMQDLVKERLPRFTSDEVKIVKGSADYIGINQYTASYIKGQKLVQQAPTSYSADWQVTYASLRNGKPIGPKANSDWLYIVPTGMYGCVNYLRVKYGNPAIVITENGMDQPGNLTRDEYLRDVTRVRFYRSYLAELKKAIDGGANVLGYFAWSLLDNFEWGSGYTSKFGIVYVDFNSTKLERHPKASAYWFRDMLKG

SEQ ID NO: 3262 - protein, 483 aa, Quercus alba
MGKQSAWVAIQKKRWPLLILALLSLFTAMLFFTRTSFDSCATNSTSSATSNSIVINNNRFREEEKDKFTNVQIQSKAAPNPLDFMKSKLVLLVSHELSLSGGPLLLMELAFLLRGVGAEVVWITNQKPVELDDVVYSLEHKMLDRGVKVLSAKGQKAIDTALKADLVILNTAVAGKWLDAVLKEKVPHVLPKVLWWIHEMRGHYFKVEYVKHLPFVAGAMIDSHTTAEYWKNRTRERLGIKMPETYVVHLGNSKELMEVAEDSVCKRILREHVRESLGVRNEDLIFAIINSVSRGKGQDLFLRSFHESLQLIKEKKLQVPPIHAVIVGSDMNAQTKFETELRNFVLEKKIQDRVHFVNKTLTVAPYLASIDVLVQNSQARGECFGRITIEAMAFQLPVLGTAAGGTMEIVVNGTTGLLHPAAKEGVTPLANNIVKLATHVERRLTMGKKGYERVKERFLEPHMSHRIALVLKDVLQKAKSHST

SEQ ID NO: 3263 - protein, 979 aa, Gossypium hirsutum
MDLHRCCFPLLCCVFPNVFAGSVMDKSQGSFLDDKDSVFGELSYLKEMGALDFGEDIRLEPCKLLEKFQRENKLVNLDSSSGFNRSQHRFHYRKPQLALVFADLLVHPQQLLMVTIATALKEIGYELQVYSLEDGLARNAWQSVGVPVTILKVERNEIAVDWLNYDGILVSSLEAKSVFSSFIQEPFKSIPLIWTIHERALAIRSREYTSSGQIELVNDWKKVFCRATVVVFPNYALPMIYSTFDSGNYYVIPGSPAVVWKGENAMNLLKDSQRIKMGYGPDEVLIAIVGSQFMYKGLWLEHALILQALLPLFADNNSNSHPKIIILSNDSTSNYSMAVERIALNLRYPSGVVKHVAVEEEVDNVLSMTDIVIYGSFLDEPSFPEVLTKAMSLGKPIIAPELSNIRKYVDDRVNGYIFPKENIKVLTQIILQVISNGKLSPLARNIASIGRETVKNLMVQETVEGYAFLLENILKLPSEVAPLKAVAELPSKLKEEWQWNLFGDFLNSTLGDRSANFLNKLEEQWNHSRREKFGSLIAVDDSFSYEIWEEEKRTHILDTKRRREEQELKDRTDQPRGTWEDVYRNAKKADRMRNDLHERDERELERIGQPLCIYEPYFGEGTWPFLHQNSLYRGIGLSTKGRRPGMDDVDGPSRLQLLNNPYYRDTLDEYGAFFAIANRIDRLHRNAWIGFQSWRATARKASLSGIAETSLLDAIEKRKYGDALYFWVRMDTDPRNNMQRDFWSFCDAINAGKCKLAFSETLKRMYGLGQDFNSLPPMPEGEGTWSVMQSWALPTKSFLEFVMFSRMFVDALDAQMYDEHYQSGHCYLSFSKDKHCYSRVLELLINVWAYHSARRIVYVNPETGAMQEYHKFKDRRGKMWIKWFSFNTLKVMDEDLAEEADSDHPKRRWLWPSTGEVVWQGVLDRERNLRNRQKETRKQKSKDKLERMRHKHRQKALGKYVKPLPEDIEISNSTTVTSV

SEQ ID NO: 3264 - protein, 1026 aa, Theobroma cacao
MGSLESGISLKRAGSRNERNPFLNRPRSRFSRFLLFKKLDYLQWICTVVVFLFFVVFFQMYLPGSVMDKSQDSFLEDKDLVYGELRYLKEMGGLDFGEDIRLEPRKLLEKFQRENKVLNLESSSGFNRSQHRFQYRKPQLALVFADLLVDPQQLLMVTIATALREIGYAIQVYSLEDGPVHNVWQSIGVPVSVLQVNSNEIGVDWLNYDGILVSSLEAKGVFSSFMQEPFKSIPLIWTIHERTLAVRSRQFTSSGQIELVNNWKKVFSRATVVVFPNYALPMIYSAFDTGNYYVIPGSPAEAWKGENAMNLYKDNQRVKMGYGPDEVLIAIVGSQFMYRGLWLEHAIVLQALLPLFTDFSSDTNSNSHPKIIILSGDSTSNYSMAVERITHNLKYPSGVVKHVAVDGDVDSVLSMTDIVIYGSFLEEPSFPEILIKAMCLGKPIIAPDLSNIRKYVDDRVNSYLFPKENIKVLTQIILQVISKGKLSPLARNIASIGSGTVKNLMVRETVEGYALLLENVLKLPSEVAPPKAVMELPSKLKEEWQWNLFEGFLNSTFEDRSSKFLNKLEEQWNHSQKERSGSLLDTNDSFSYEIWEEEKKMQIINIKRRREEQELKDRTDQPRGTWEDVYRSAKRADRLRNDLHERDERELERTGQPLCIYEPYFGEGTWPFLHHNSLYRGIGLSTKGRRPRMDDVDGPSRLQLLNNPYYRDTLGEYGAFFAIAKRIDRLHRNAWIGFQSWRATARKAFLSKIAETSLLDATEKHKYGDALYFWVRMDMDPRNSMQGDFWSFCDAINAGNCKFAFSEALNRMYGIKHDLISLPPMPEDGGTWSVMQSWALPTKSFLEFVMFSRMFVDALDAQMYDEHHQSGHCYLSFAKDKHCYSRVLELLINVWAYHSARRMVYVNPETGVMQEYHKLKGRRGIMWVKWFSFNTLKGMDEDLAEEADSDHPKRRWLWPSTGEVVWQGVLERERNLRNRQKEKRKQKSKDKQERMRHKYHQKALGKYVKPLPEEMQNSNSTIVTSE

SEQ ID NO: 3265 - protein, 183 aa, Zea mays
MTRGENQESQTGNVSAASAAAPGPKPASAGAGKGAEGQSVVRRLQSELMALMMGGDPGVSAFPEGDNMLHWVGTIAGSAGTAYEGTSYRLALAFTAEYPYKPPKVRFDTPCFHPNVDVHGNICLDILQDKWSSAYDVRTILLSIQSLLGEPNNDSPLNTQAAALWANQEEFRKMVEKLYKAAA

SEQ ID NO: 3266 - protein, 184 aa, Saccharum officinarum
MARGENQESQTGNVPAASAAAAPGAKPASAGAGKGAEGQSVVRRLQSELMALMMGGDPGVSAFPEGDNMLHWVGTIAGSAGTAYEGTSYRLALAFTAEYPYKPPKVRFDTPCFHPNVDVHGNICLDILQDKWSSAYDVRTILLSIQSLLGEPNNESPLNTQAAALWANQEEFRKMVEKLYKPAA

SEQ ID NO: 3267 - protein, 184 aa, Sorghum bicolor
MARGENQESQTGNVPAASAASATGAKPASAGTGKGAEGQSVVRRLQSELMALMMGGDPGVSAFPEGDNMLHWVGTIEGSAGTAYEGTSYRLALAFTAEYPYKPPKVRFDTPCFHPNVDVHGNICLDILQDKWSSAYDVRTILLSIQSLLGEPNNDSPLNTQAAALWANQEEFRKMVEKLYKPAA

SEQ ID NO: 3268 - protein, 183 aa, Panicum virgatum
MARGENQESQTGNVPAASASAAGPKPAAAGAGKAAEGQSVVRRLQSELMALMMGGDPGVSAFPEGDNIFHWVGTIAGSAGTAYEGTSYRLALAFTAEYPYKPPKVRFDTPCFHPNVDAHGNICLDILQDKWSSAYDVRTILLSIQSLLGEPNNDSPLNTQAAALWANQEEFRKMVEKLYKAAA

SEQ ID NO: 3269 - protein, 187 aa, Saccharum officinarum
MARGENQEAQTGNVPAASASASAPKPSASAAGAGKGLEGQSVVRRLQSELMALMMGTDPGVSAFPDPEGDSMLHWVGTIAGSAGTPYEGTSYRLALAFTAEYPYKPPQVRFDTPCFHPNIDAHGNICLDILQDKWSSAYDVRTVLLSIQSLLGEPNNDSPLNTQAAALWANQEEFRKIVQKLYKPRA

SEQ ID NO: 3270 - protein, 181 aa, Avena sativa
MARGENSESHGSGNVPASPAASSVKQAPAAARGAEGQSVVRRLQSELMALMMGGDPGVSAFPEGDNIFQWIGTIDGSAATAYEGTSYRLALAFPSDYPYKPPKVRFETPCFHPNVDTHGNICLDILQDKWSSAYDVRTILLSIQSLLGEPNNDSPLNTQAAALWANQEEFRKMVEKLYKPA

SEQ ID NO: 3271 - protein, 181 aa, Brachypodium distachyon
MARGENSESHGSGNVPAAAPAAVGKQAPAAARGADGQSVVRRLQSELMALMMGGDPGVSAFPEGDNIFQWVGTIDGSAATAYEGTSYRLALSFPSDYPYKPPKVKFETPCFHPNVDTHGNICLDILQDKWSSAYDVRTILLSIQSLLGEPNNDSPLNTQAAALWANQEEFRKMVEKLYKPA

SEQ ID NO: 3272 - protein, 541 aa, Sorghum bicolor
MPPPLQAHRLLISHRRLPSPARRRFTAASSLQSAPATTLAPGPATSSILSIRESLLSGERTAADITSEYLSRLRRTEPSLRSFIHVADAAAEREAEELDRRIASGEKDAVGPLAGVLVGVKDNLCTANMPSTGGSRILDGYRPAYDATAVRRLQEAGAIVVGKTNLDEFGMGSTTEGSAFQVTTNPWDDSRVPGGSSGGSASAVSARQCVVSLGSDTGGSVRQPASFCGVVGLKPTYGRVSRFGLMAYASSLDVVGCFGSSVFDTATILSVVAGHDKMDSTSSSQVVPDYASELVSLDLLESKPLAGLRIGIIQETLGEGVANGVISSIKGAASHLEQLGSVVEEVSLPSFSLGLPAYYILASSEASSNLSRYDGIRYGRQFSADDLNELYGESRANGLGHEVKMRILMGTYALSAGYYDAYYKRAQQVRTLVKESFKDALERYDILISPAAPSAAYKIGEKINDPLAMYAGDILTVNVNLAGLPALVVPCGFVEGGPAGLPVGLQLIGSPFCEGNLLRVGHIFEQTLQNLSFVPPLLAES

SEQ ID NO: 3273 - protein, 529 aa, Setaria italica
SHRRLPTPARRRFTAVSSVQSAPATTLAPGPATSSILSIRESLLSGERTAVDITSEYLSRLRRTEPSVRSFIHVADAAAEREAEELDRRIASGEKDAVGPLAGVLVGVKDNLCTANMPSTGGSRILDGYRPAYDATAVRRLREAGAIVVGKTNLDEFGMGSTTEGSAFQVTTNPWDDARVPGGSSGGSASAVSARQCVVSLGSDTGGSVRQPASFCGVVGLKPTYGRVSRFGLMAYASSLDVVGCFGSSVFDTATILSVVAGHDKMDSTSSSQDVPDYASELVSLDSLESKPLNGVRIGIIQETLGEGVDTGVVSSIKGAASHLERLGSVVEEVSLPSFSLGLPAYYILASSEASSNLSRYDGIRYGRQVSADDLNEVYGESRANGLGHEVKMRILMGTYALSAGYYDAYYKRAQQVRTLVKESFKDALERYDILISPAAPSAAYKIGEKINDPLAMYAGDIMTVNVNLAGLPALVVPCGFVEGGAAGLPVGLQMIGSPFSEGNLLRVGHIFEQTLQNFSFVPPLLAEH

SEQ ID NO: 3274 - protein, 541 aa, Hordeum vulgare
MPPPLQAHRMLLSHRRTSPIPRRRFTAVSSLSSPPAKTLAPGPTPSSILSIRESLLSGERTAADITSEYLSRLRRTEPSLRSFIHVADAAAEREAEELDRRIASGGQDAVGPLAGVLVGVKDNLCTASMPSTGGSRILDGFQPAYDATAVRRLREAGAIVVGKTNLDEFGMGSTTEGSGFQVTTNPWDDSRVPGGSSGGSASAVSARQCVVSLGSDTGGSVRQPASFCGVVGLKPTYGRVSRFGLMAYASSLDVVGCFGSSVFDTATILSVIAGHDKMDSTSSSHDVPDYRSDLASLSLLESKPLNNVRIGIIQETLGEGVDAGVISSIRAAASHLEQLGSVVEEVSMPSFSLGLPAYYILASSEASSNLSRYDGIRYGRQVSADDLNELYGNSRASGLGHEVKMRILMGTYALSAGYYDAYYKRAQQVRTLVKKSFEEALGKYDILISPAAPSAAYKIGEKTNDPLAMYAGDIMTVNVNMAGLPALVVPCGFVEGGSAGLPVGLQMIGSPFSEGNLLRVGHIFEQTLQDLSFVPPLAADN

SEQ ID NO: 3275 - protein, 236 aa, Triticum aestivum
  misc_feature (26)..(26): Xaa can be any naturally occurring amino acid
  misc_feature (55)..(55): Xaa can be any naturally occurring amino acid
  misc_feature (75)..(75): Xaa can be any naturally occurring amino acid
  misc_feature (123)..(123): Xaa can be any naturally occurring amino acid
  misc_feature (223)..(223): Xaa can be any naturally occurring amino acid
  misc_feature (229)..(229): Xaa can be any naturally occurring amino acid
PTRTGVRRRTSPPAAAMPPPLQAHRXLLSHRRASPIPRRRFTAVSSLSSAPAKTXAPGPPASSILSIRESLLSGXRTAADITSEYLSRLRRTEPSLRSFIHVADAAAEREAEELDRRIASGGXDAVGPLAGVLVGVKDNLCTASMPSTGGSRILDGFQPAYDATAVRRLREAGAIVVGKTNLDEFGMGSTTEGSGFQVTTNPWDDSRVPGGSSGGSASAVSAXQCVVSXGVIQVEV

SEQ ID NO: 3276 - protein, 494 aa, Panicum virgatum
ILSIRESLLSGERTAADITSEYLSRLRRTEPSLRSFIHVADAAAEREAEELDRRIASGEKDAVGPLAGVLVGVKDNLCTANMPSTGGSRILDGYQPAYDATAVRRLRDAGAIVVGKTNLDEFGMGSTTEGSAFQVTTNPWDDSRVPGGSSGGSASAVSARQCVVSLGSDTGGSVRQPASFCGVVGLKPTYGRVSRFGLMAYASSLDVVGCLGSSVFDTATILSVVAGHDKMDSTSSSQDVPDYVSELVSLDLLESKPLNGLRIGIIQETLGEGVDTGVISSIKDAASHLEHLGSVVEEVSLPSFSLGLPAYYILASSEASSNLSRYDGIRYGRQVSADDLNEIYGESRADGLGHEVKMRILMGTYALSAGYYDAYYKRAQQVRTLVKESFKGALERYDILISPAAPSAAYKIGEKINDPLAMYAGDIMTVNVNLAGLPALVVPCGFVEGGAAGLPVGLQIIGSPFSEGNLLRVGHIFEQTLQNFSFVPPLLAER

SEQ ID NO: 3277 - protein, 536 aa, Oryza sativa
MPPPLQAQRLLLSHRRLPSPHLRCFTAVSSLPSAPAKTVAAAAAHAPSSILSIRESLLSGERTAAEITAEYLSRLRRTEPSVRSFIHVADAAAEREAEELDRRIATEGLDAVGPLAGVLVGVKDNLCTANMPSTGGSRILDGYQPAYDATAVRRLREAGAIVVGKTNLDEFGMGSTTEGSGFQVTTNPWDDSRVPGGSSGGSASAVSARQCVVSLGSDTGGSVRQPASFCGVVGLKPTYGRVSRFGLMAYASSLDVVGCFGSSVVDTATILSVIAGHDKMDSTSSSHDVSDYKSELVPLDLLESKPLNGMRIGIIQETLGEGVETGVISSIKDAASHLEQLGSVVEEVSLPSFSLGLPAYYILASSEASSNLSRYDGIRYGRQVSGDDLNELYGGSRANGLGHEVKMRILMGTYALSAGYYDAYYKRAQQVRTLVKKSFKEALERYDILVSPAAPSAAYKIGEKINDPLAMYAGDTMTVNVNLAGLPALVVPCGFVEGGSAGLPVGLQMIGSPFSELHQWTVVMENGLGFDKFELS

SEQ ID NO: 3278 - protein, 536 aa, Brachypodium distachyon
MKLADINEAYLSQVTPIDTKCYVSSLPSAPAKTLAPGPGPSSILSIRESLLSGERTAADITAEYLSRLRRTEPIVRSFIHVADAAAEREAQELDRRIASGGQDAVGPLAGVLVGVKDNLCTANMPSTGGSRILDGYQPAYDATAVRRLREAGAIVVGKTNLDEFGMGSTTEGSGFQVTTNPWDDSRVPGGSSGGSASAVSARQCVVSLGSDTGGSVRQPASFCGVVGLKPTYGRVSRYGLMAYASSLDVVGCFGSSVVDTATMLSVIAGHDKMDSTSSSHDVPDYRSDLVSLNLLESKPLNNLRIGIIQETLGDGVDTGVISSIKAAASHLEQLGSVVEEVSLPSFSLGLPAYYILASSEASSNLSRYDGIRYGRQVSADDLNELYGDSRSNGLGHEVKMRILMGTYALSAGYYDAYYKRAQQVRTLVKKSFEEALRRYDILVSPAAPSAAYKIGEKANDPLAMYAGDIMTVNVNLAGLPALVVPCGFVDGGSAGLPVGLQMIGSPFSEGNLLRVGHIFEQTLQDFSFVPPLLADS

SEQ ID NO: 3279 - protein, 487 aa, Sorghum bicolor
MAEANTGKEKKEVVRLERESVIPIMKPKLIMKLAYLIEHQSDKEEFLKLCKRVEYTIRAWYHLQFDDMMELFALFDPVHGAKKLQQQNFSSEEIDMLEQNFLSYFFRVMEKSNFNIVNEDEVELAHSGQYLLNLPIKVDESKLDNKLLSKYFKEHHHENLPDFADKYVIFRRGIGLDRTSNFFFMEKVDMIIARAWRGFLEKTRLQKLFSRKKNTKPKIDSKKNDDLASEVEDKELYVERIRLETMKLSFQNLIGKVTIQEPTFEEVIVLYRRKTPKGQDDRAIHVKHFKNIPMADMELVLPEKKNPSLTPMDWVQFIVSVVIGLVTLISSLEMPKADFWVVVAILSALAGYCAKIYFSFQQNMATYQNLITQSMYDKQLDSGKGTLLHLCDDVIQQEVKEVIIAYYILMENGKATSDDLDLQCEELIQEEFGLQCNFEVMDAVQKLERLGIITRDSIGRICCVPLKRANEIIGATTEELVMKARQS

SEQ ID NO: 3280 - protein, 488 aa, Oryza sativa
MAEAEAGRKEKKEVVRLERESVIPIMKPKLIMKLAYLIEQQSDREEFLKLCKRIEYTIRAWYHLQFDDMMELFALFDPVHGAQKLQQQNFSTEEVDTLEQNFLTYFFQVMQKSNFNILSDDEVELAHSGQYLLNLPIKVDEAKLDNKLLSKYFKEHHHDNLPEFSDKYVIFRRGIGLDRTSNFFFMEKVDMIIARAWRWFLEKTRLQKLFSRKKSVRPKTDSKKNDDLVGEEEDKELYVERIRLETMNLSLRNLIGKVTIQEPTFEEVIVLYRRKSPKGQNDRSIHVKHFKNIPMADMELVLPEKKNPSLTPMDWVQFIVSVVIGLVTLVSSLEMPKADFWVVVAVLSALAGYCAKIYLSFQQNMATYQNLITQSMYDKQLDSGKGTLLHLCDDVIQQEVKEIIISYYILMENGKATIEDLDLQCEELIQEEFGLQCNFEVMDAVQKLERLGIITRDSIGRICCLSLKRANEIIGATTEELVMKARQS

SEQ ID NO: 3281 - protein, 480 aa, Brachypodium distachyon
MGRDKEVVRLERESVIPVMKPKLIMKLAYLIERESDREEFLKLCKRVEYTIRAWYHLQFDDMMELFALFDPVHGAKKLQQQNFSSDEVDILEQNFLTYFFQVMQKSNFNIVSDDEVELAHSGQYLLNLPIKVDEAKLDNKLLTKYFKEHHHDNLPEFSDKYVIFRRGIGLDRTSDFFFMEKVDMIITRTWRWLLEKTRLQKLFLRKKKDRPVIESKKDDDLVGEEDKELYVERIRMETMKLSLRNLIGKITIQEPTFEEVIVLYRKKSPKGQDDRAIHVKHFKNIPMADMELVLPEKKNPSLTPMDWVQFIVSVVIGLVTLIGSLEMPKADFWVVIAILSALAGYCAKIYFSFQQNMATYQNLITQSMYDKQLDSGKGTLLHLCDDVIQQEVKEVIISYYILMENGKATIEDLDLQCEELIQEEFGLQCNFEVIDALQKLERLGIVTRDSIGRICCLPLKRSNEIIGATTEELVMKARQS

SEQ ID NO: 3282 - protein, 285 aa, Sorghum bicolor
MATAFESPTSSPAAAPFHDDPFLHFDGSAPAADGFPASPDAYAPSPFGMPHSNGDLHDDPFAAPADSNGGPILPPPTEMGREEGFLLREWRRQNAIHLEKKEKNEKELRSQIIVDAEEFKKAFVEKRKLNVETSKGQNRDREKLFLANQEKFHAGADKQYWKAISELIPHEIANIEKRGARKDKEKEKKPGIVVIQGPKPGKPTDMARMRQILLKLKHTPPPHMKPPPPPAAATGKDGAPAAAGKDGAKPAAPANGSVPEMEKAAAVAPVPAAAPPAATEPIAAA

SEQ ID NO: 3283 - protein, 286 aa, Saccharum officinarum
MATAFESPTSSPAAAPFHDDPFLHFDGSAPAPADVFPASPDAYAPSPFGMPHSNGDLHDDPFAAPADSNGGPILPPPTEMGREEGFLLREWRRQNAIHLEEKEKKEKELRSQIIVDAEEFKKAFVEKRKLDAETSKGQNRDREKLFLANQEKFHAGADKQYWKAISELIPHEIANIEKRGARKDKEKEKKPGIVVIQGPKPGKPTDMARMRQILLKLKHTPPSHMKPPPPPAAATGKDGAPAAAGKDGAKPAAPANGSVPEMEKAAVAAPAPAAAPPTATESIAAA

SEQ ID NO: 3284 - protein, 276 aa, Panicum virgatum
MATAFDSPTSSPAAAPFHDDAFLHLDGSAAAADAFPASPDPYAPSPFGMPQANGGLHDDPFADSDGGPILPPPTEMGREEGFLLREWRRQNAILLEEKEKKEKELRSQIILDAEEFKKAFVEKRKLNVETSKGQNRDREKLFLANQEKFHAGADKQYWKAISELIPHEIANIEKRGARKDKEKEKKPGIVVIQGPKPGKPTDMSRMRQILLKLKHTPPPHMKPPPPPAAAAGKDGAPAAAAKDGAKPAAPANGSVPEMEKAAAAAPAPATEPIAAA

SEQ ID NO: 3285 - protein, 291 aa, Panicum virgatum
MATAFDSPTSSPAAAPFHDDAFLHVDGSAASADGFPASPDPYAFSSDAPSPFGMPQANGGLHDDPFADSDGGPVLPPPTEMGREEGFLLREWRRQNAILLEEKEKKEKELRSQIILDAEEFKKAFVEKQKLNVETSKGQNRDREKLFLANQEKFHAGADKQYWKAISELIPHEIANIEKRGARKDKEKEKKPGIVVIQGPKPGKPTDMSRMRQILLKLKHTPPPHMKPPPPPAAAAGKDGAPAAAGKDGAPAAAAKDGAKPAAPANGSVPEMEKAAAAAAPAPAAEPIAAA

SEQ ID NO: 3286 - protein, 299 aa, Setaria italica
MATAFDSPTSSPAAAAPFHGGDAFLHFDGSADVHASADGFPASPDPYAFRSDAPPSPFGMPQANGGAVHDDDPFAPDSNGGPILPPPTEMGRDEGFLLREWRRQNAILLEEKEKKEKELRSQIILDAEEFKKAFVEKRKLNLETSKGQNRDREKLFLANQEKFHAGADKQYWKAISELIPHEIANIEKRGARKDKEKEKKPGIVVIQGPKPGKPTDMARMRQILLKLKHTPPPHMKPPPPPAAAAGKDGAPAAAGKDGAPAAAAKDGAKPAAPANGSVPEMEKAAGAAPAPATEPIAAA

SEQ ID NO: 3287 - protein, 87 aa, Pennisetum glaucum
MCGGGVCFSFSNICRIRAMSVGFPGFGPWTTTIPGFFSFSLSFLAPLFSMLAISCGISSDIAFQYCLSAPAWNFSWFARKSFSLSRF

SEQ ID NO: 3288 - protein, 281 aa, Sorghum bicolor
MRRRAMARLAVAARAFSASASGAGAGGVSMVQGASRGIGLEFVRQLLRRSGEGRVVATCRAPGSAAELQKLKEEHAPGRLTVLPLDVTDENTIEAAAASITETHGSLDLLINSTGILSIPNVIQPETTLSKVQKSSLMLAYEVNAVGPILVIKHMWPLLKIGGRSETGRGFALVANMSARVSSIGDNALGGWHAYRASKTALNQLTKTVSVEFGRKDNIACILLHPGTVDTDLSRPFQRNVPKDKLFTREFSVQKLLSIIDNVKKSDNGKFFAWDGQEIPW

SEQ ID NO: 3289 - protein, 90 aa, Panicum virgatum
MRGGGGAATARLAVAARAFSSAGGGVAMVQGASRGIGLEFVRQLLRRRDQGRVVATCRAPGSAAELQKLKEEHAPGRLTVLPLDVTTRPP

SEQ ID NO: 3290 - protein, 280 aa, Pennisetum glaucum
MRGGAAMARLAVAARAFSASPSAGAGVAMVQGASRGIGLEFVRQLLRRSDQGRVVATCRAPASAAELQKLRDEHAPGRLTVLPLDVTDEATIEAAAASIRETHGAIDLLINSTGILSIPNVIQPETTLSKVQKPSLMLAYEVNAVGPILVIKHMWPLLKAGGRSETGRGFSLVANMSARVSSIGDNGLGGWHSYRASKTALNQLTKTVSVEFGRKDSIACILLHPGTVDTDLSRPFQRNVPKDKLFTREFSVQKLLSVIDNVKKSDNGKFFAWDGQEIPW

SEQ ID NO: 3291 - protein, 279 aa, Oryza sativa
MATARTLAAAAAAARAFSLTATSGGGVSMVQGASRGIGLEFVRQLLKRSDEGRVVATCRAPDSAVELQKLRQEHEQRLAVLPLDVTDESTIEAAAASIGETHGSLNLLINATGILSIPNVIHPETTFSKVQKSSLLLAYEVNAVGPILVIKHMWPFLKAGGCSETGRGFSLVANMSARVGSIGDNGLGGWHSYRASKTALNQLTKTVSVELGKKDNIACILLHPGTVDTDLSRPFQKNVPKDKLFTREFSVQKLLSIIDNVKKSDNGKFFAWDGQEIPW

SEQ ID NO: 3292 - protein, 290 aa, Hordeum vulgare
MRANTLRAAMATARMAMSLPSPARALSSAAAAPPASGVSMVQGASRGIGLEFVRQLLRRSDQGRVVATCRAPDSAAELQELRREHAGRLTVLPLDVTDESTIEAAAAAVGETHGSLDLLINAAGILSIPNVIQPETSLSKVQKSSLLLAYEVNAVGPILVIKHMRPFLKIGASLETGKGFSLVANMSARVGSIGDNALGGWHSYRASKTALNQLTKTASVELGKKDNIACILLHPGTVDTDLSRPFQRNVAKDKLFTREFSVQKLLSIIDNAKKTDNGKFFAWDGQEIPW

SEQ ID NO: 3293 - protein, 281 aa, Brachypodium distachyon
MRANPLLRSAMATAARAFSSSTGPVGGGVSMVQGASRGIGLEFVRQLLRRSNHGRVVATCRAPESAAELQELRREHARRLTVLPLDVTDETTIQAAAASIGETHGSLELLINAAGILSIPDVIHPETSLSKVEKSSLLLAYEVNAVGPILVIKHMRPFLKIGASSETGRGFSLVANMSARVGSIGDNGLGGWHSYRASKTALNQLTKTASVELGKKDNIACILLHPGTVDTDLSRPFQRNVAKDKLFTREFSVQKLLSIMDNAKKSDNGKFFAWDGQEIPW

SEQ ID NO: 3294 - protein, 280 aa, Triticum aestivum
LSSPARALSSAAAHPPASGVAMVQGASRGIGLEFVRQLLRRSDQGRVVATCRAPDSAAELQELRREHAGRLTVLPLDVTDESTIEAAAAAVGETHGSLDLLINAAGILSIQNVIQPETSLSKVQKSSLLLAYEVNAVGPILVIKHMRPFLKIGASLETGKGFSLVANMSARVGSIGDNALGGWHSYRASKTALNQLTKTASVELGKKDNIACILLHPGTVDTDLSRPFQRNVAKDKLFTREFSVQKLLSIIDNAKKTGQREFFRLGMAKKSLVTTVFQVK

SEQ ID NO: 3295 - protein, 123 aa, Zea mays
MSKSTEIADKAIILMQDHAKHIYRICNEKLILGKGLTAFEVKELREALEFAAEGLDQGSLFCQEELDATVKEEQLEHDEKVASQMIESPLPSPDSDCFLSLEEHIEKFWGVDYNSDQMPSYSD

SEQ ID NO: 3296 - protein, 855 aa, Zea mays
MEPVHDAELTVFNQGNDGSLTAHTGVLDGHPIFDVELVFDEEPLIEIDCSIFNTNAPFMCLTDCLSYVDDMVSATFKEGPIFDKETVVEAVQKESDRDYYTVHGEKAMFIARTYYHTISALRHLGSNSGGISSVGVSKAMFETIVRKILLDRTDCTLELYEGSGSDWRLTKSGKPGNIGGFEDILFINNDMQESPVMTNRKLGLAEFREDNRFTNVGSALLALCLTADCEKSINSHSLQDAITKCSILLTERKKSNFKSKDLVQDLEEIKGSVKLVCDLISQFDYSLGALGALLSYAELLANDTNYGNYTIEKYNLDCYMRLDSAVVLALTIHEEKTDVNKNFYLFGLVNRTCTVEMGKRLLNQWLKQPLLDVNEITSRLYMVQAAISTFDTKTTIRTVVQIHMCEPAGASQNVEHMGQLQKPWDPGGFHIGLVSGAQRVGFNFGEYIELLERYNKAPFSLKTWDPDIQHSLFKEASHDYLHIFIRQSKFIMSKYTWHDVAWGQATFWLGGSVTHGLFLAWCHMAQPTAQLGRWVQEQHQRNEDGEKKRIRSYSLLSPSSVRRRDSARQRSTAALRFIIENAENKDNRDQGDMFRICDEDEMYAFLRLGDEDEEMNRIHPEQNELRRRKLSHNSAEVPLPELGHFRQTIQFKADPQFSSGCQTDNSVQMKSENKDYSSHNHNFSSPELHPHIQNFIPSPVPSQVLGLGFRGLVFICSGKFLSAPRRVLMDAEMSKSTEIADKAIILMQDHAKHIYRICNEKLPLGKGLTAFEVKEHREALEFAAEGLDQDSLFCQEELDATVKEEQLEHDEKVTLERIESPLPSPDSDCFLSLEEHIEKFWGVDYNSDQMPSYSD

SEQ ID NO: 3297 - protein, 552 aa, Saccharum officinarum
MALPVPLVRLALLLLVALPFCAAHPGPGAFPAPRHFQSPALHSDGFGLLARRSIAEAPTDINVTTNSSFVLAADRTYRKDPLNGFRKYTGGWNISEVHYFASVGYTAIPLFAIALAWFVIFFLVMLGICCRHCCCPRHTYKYSRTAYALSLILLILFTCAAIAGCAMLYDGQAKFHKSTTTTLKFVVSQANYTVDNLRNLSDSLSAAKRIDIAQSFLLPPNVQTEINEIQGKLNSSATDLAIKTTDNAAKIKKLLNRVRLALIVIAAVMLLLAFIGFLLSIFGLEFLVSVLVVIGWILVTGTFILCGVFLLLHNVVSDTCVAMEEWVAHPTEHTALDEVIPCVEPATANESLYRSRQVTFELVNVVNQVITNVSNRNFPPQLTPFYYNQSGPLMPLLCNPFTPDLRDRNCTRGEVTLDNATQVWKNYECQSKTVSGAEICATVGRVTPSIYSQMAAGVNVSQGLYQYGPFLIQLEDCTFVRDTFTTINQGYCPGLERYSKWVYVGLVMVSSAVMLSLVFWVIYARERRHRVYSKQHQPYPVEDKPAPMVPGA

SEQ ID NO: 3298 - protein, 552 aa, Saccharum officinarum
  misc_feature (237)..(237): Xaa can be any naturally occurring amino acid
  misc_feature (300)..(300): Xaa can be any naturally occurring amino acid
MALPVPLVRLALLLLVALPFCAAHPGPGAFPAPRHFQSPALHSDGFGLLARRSIAEAPTDINVTTNSSFVLAADRTYRKDPLNGFRKYTGGWNISEVHYFASVGYTAIPLFAIALAWFVIFFLVMLGICCRHCCCPRHTYKYSRTAYALSLILLILFTCAAIAGCAMLYDGQAKFHKSTTTTLKFVVSQANYTVDNLRNLSDSLSAAKRIDIAQSFLLPPNVQTEINEIQGKLNSSXTDLAIKTTDNAAKIKKLLNRVRLALIVIAAVMLLLAFIGFLLSIFGLEFLVSVLVVIGWILVXGTFILCGVFLLLHNVVSDTCVAMEEWVAHPTEHTALDEVIPCVEPATANESLYRSRQVTFELVNVVNQVITNVSNRNFPPQLTPFYYNQSGPLMPLLCNPFTPDLRDRNCTRGEVTLDNATQVWKNYECQSKTVSGAEICATVGRVTPSIYSQMAAGVNVSQGLYQYGPFLIQLEDCTFVRDTFTTINQGYCPGLERYSNWVYVGLVMVSSAVMLSLVFWVIYARERRHRVYSKQHQPYPVEDKPAPMVPGA

SEQ ID NO: 3299 - protein, 557 aa, Panicum virgatum
MALPVPFVRLTLLLLVALPFCAAHPGPGFHTHREFQRPALDSDGFGLVARRSIAEAPADINITTNSSFVLAADRTYRRDPLNGFRKYPGGWNISEVHYFASVGYTAIPLFAIALVWFVFFFLVMLGICCHHCCCPHRSYKYSRTAYALSLILLILFTCAAIVGCVMLYDGQGKFHKSTTTTLKFVVSQANYTVDNLRNLSDSLSAAKKVDIGRFLLPPNVQNQINEIQGKLDSSANDLAVKTTDNAAKIKKLLNQVRMALIVIAAVMLLLAFIGFLLSIFGLEFLVSVLVVIGWILVTGTFILCGVFLLLHNVTSDTCVAMEEWVAHPTEHTALDEIIPCVEPATANETLYRSRQVTFQLVNLVNQVITNVSNQNFPSPPPVATPFYYNQSGPLMPLLCNPFTPDLSNRTCTRGEVTLDNATQVYRSFECQTTTVSGAEICTTVGRVTPRIYGQMAAGVTVSQGLYQYGPFLIQLEDCTFVRDTFTTINQEYCPGLQRYSKWVYVGLVMVSAAVMLSLIFWVIYARERRHRVYNKQFIAQHQPYPVEEKPAPTAPHA

SEQ ID NO: 3300 - protein, 555 aa, Setaria italica
MALPVPFVRLSLLLLVALPFCAAHPAPGFHAPREFQTPALDSDGFGLVARRSIAEAPADINITTNSSFVLAADRTYRKDPLNGFRKYPGGWNISEIHYFASVGYTPLFAIALVWFVVFFLVMLGICCHHCCCPHRSYKYSRAAYALSLILLILFTCAAITGCIMLYDGQGKFHKSTTHTLKFVVSQANYTVDNLRNLSDSLSAAKKVDIGRFLLPSDMQSQIDEIQAKLNSSATDLAIKTTDNAAKIKKLLNQVRLALIIIAAVMLLLAFIGFVLSIFGLEFLVSVLVVIGWILVTGTFILCGVFLLLHNVTSDTCVAMEEWVAHPIEHTALDEIIPCVEPATANESLYRNRQVTFQLVNLVNQVITNVSNQNFPSPPPVATPFYYNQSGPLMPLLCNPFTPDLSNRTCTRGEVTLDNATQVYKSFECQTTTVSGAEICTTVGRVTPRIYGQMAAGVTVSQGLYQYGPFLIQLEDCTFVRDTFTTINQDYCPGLQRYSKWVYIGLVMVSAAVMLSLIFWVIYARERRHRVYNKQFIAQHQQYPVEDKPAPTAPHA

SEQ ID NO: 3301 - protein, 546 aa, Oryza sativa
MALPVSLLRIAAVLLAILPFCATHPSPGFHAPREFHKALVPDRYGFVARRSIAEAPVDVNVTTNSSFVLAQERTYRKDPLNGFRKYTGGWNISEVHYMASVGYTAFPLFIIALVWFVLFFLVMLGICCKHCCCPHRSYTYSRVAYALSLILLILFTCAAIVGCVMLYDGQGKFHKSTTTTLNFVVSQANFTVENLNNLSDSLSAAKKVDIGRSFLPNDVQNQINEIQGKLNSSATELATRTTDNSEKIQKLLNQVRIALIIIAAVMLLLAFIGFLLSIFGLEFIVSILVIIGWILVTGTFILCGVFLLLHNVVADTCVSMEEWVAHPTEHTALDDIIPCVEPATANESLYRSRQVTYQLVNLVNQVITNVSNGNFPPQTPFFYFNQSGPLMPTLCNPFTADLNNRTCTRGEVTLDNATRVWKNFECQTTTVSGTEICTTVGRVTPTILGQMAAGVNVSQGLYQYGPFLIQLEDCTFVRDTFTNINQNHCPGLERYSKWVYVGLVMVSSAVMLSLVFWVIYARERRHRAYSKQHNYADKPHPTGPDA

SEQ ID NO: 3302 - protein, 130 aa, Sorghum bicolor
MWWEWEGGGGEAPREETPVDFDFISLLSKPKDYYKILEVDYNASEETIRSSYIRLALKWHPDKKQGEESSTSKFQEINEAYQVLSNPAKRQEYDKKGILYVQDQNVVDYLNRHKGLILTCNGLGIRYSVW

SEQ ID NO: 3303 - protein, 130 aa, Saccharum officinarum
MWWEWEGGGGEAEREETPVDFDFISLLAKPKDYYKILEVDYNASEETIRSSYIRLALKWHPDKKQGEENSTSKFQEINEAYQVLSNPAKRQEYDKKGIVYVQDQNAVDYLNRHKGLILTCNGLGIRYSVW

SEQ ID NO: 3304 - protein, 130 aa, Panicum virgatum
MWWEWEGGGEEAAREETPVDFDFISLLAKPKDYYKILEVDYDASEETIRSSYVRLALKWHPDKKQGEENATSRFQEINEAYQVLSNPAKRQEYDKKGILYVQDQNVVDYLNRHKGLILTCNGLGIRYSVW

SEQ ID NO: 3305 - protein, 132 aa, Pennisetum glaucum
MWWEWEGDGEEAAREDEETPVDFDFISLLAKPKDYYKILEVDYDASEETIRSSYIRLALKWHPDKKQGEENATSRFQEINEAYQVLSNPAKRQEYDKAGIIYVQDQNVADYLNRHKGLILTCNGLGIRYSVW

SEQ ID NO: 3306 - protein, 132 aa, Oryza sativa
MWWEWEEDGEEAARPGEEVPVDFDFISLLCKPKDYYKILEVGYDASEEAIRSSYIRLALKWHPDKKQGEENATSRFQEINEAYQVLSNPAKRREYDKKGILYVQDHNVVDYLNRHKGLILTCNGLGIRHSVW

SEQ ID NO: 3307 - protein, 132 aa, Brachypodium distachyon
MWWEWWDGEEAAAGPREEVPVDFDFISLLCKPKDYYKILEVDYDASEETIRSSYIRLALKWHPDKKKGEENSTSIFQDINEAYQVLSNPVKRQEYDKKGILYVQDQNAADYLNRHKGLILTCNGLGVRYSVW

SEQ ID NO: 3308 - protein, 131 aa, Avena sativa
MLWEWEDGEEAGRQSEEVPVDFDFISLLSKPKDYYKILEVDYDASEETIRSSYIRLALKWHPDKKQGEEKATSKFQDINEAYQVLSNPVKRQEYDKKGVLYVQDQNAADYLNRHKGLILTCNGLGVRYSVW

SEQ ID NO: 3309 - protein, 131 aa, Triticum aestivum
MLWEWEDGDEAARTGEEVPVDFDFFSFFAKPKDYYKILEVDYDASEETIRSSYIRLALKWHPDKKQDEEKATSRFQDINEAYQVLSNPVKRQEYDKKGVLYVQDQNAADYLNRHKGLILTCNGLGVRYSVW

SEQ ID NO: 3310 - protein, 114 aa, Setaria italica
TPVDFDFISLLAKPKDYYKILEVDYNASEETIRSSYIRLALKWHPDKKQGEENATSRFQEINEAYQVLSNPAKRQEYDKAGIIYVQDQNVVDYLNRHKGLILTCNGLGIRYSVW

SEQ ID NO: 3311 - protein, 131 aa, Hordeum vulgare
MLWEWDDGDEAARTGDEVPVDFDFFSFFAKPKDYYKILEVDYDASEETIRSSYIRLALKWHPDKKQDEEKATSRFQDINEAYQVLSNPAKRQEYDKKGVLYVQDQNAADYLNRHKGLILTCNGLGVRYSVW

SEQ ID NO: 3312 - protein, 148 aa, Saccharum officinarum
  misc_feature (28)..(28): Xaa can be any naturally occurring amino acid
  misc_feature (131)..(131): Xaa can be any naturally occurring amino acid
MWWEWEGGGGDAEREETPVDFDFISLLXKPKDYYKILEVDYNASEETIRSSYIRLALKWHPDKKQGEENSTSKFQEINEAYQVLSNPAKRQEYDKKGIVYVQDQNAVDYLNRHKGLILTCNGLGIRYSVWXTRSGIHSLHPSAVLENL

SEQ ID NO: 3313 - protein, 262 aa, Sorghum bicolor
MEKSSSENATPLKLFGSWASSYTHRVQLALRLKGLEFDYVEEDLGNKSDELLRHNPVHKKVPVLVHGGRALPESVIILQYLDDAWPETRPLLPADAFDRALARFWCHFADDKLGPAVGAVFASTGEDQEAAVRQVHENLALLETELRDGAFRGRRFFGGDEVGLLDVVLGCGSYWLAVFEDVTGLRLVDADAFPRFHAWLRDFEALDEVRDTIPAVDRLLDYARGLRHMLLGLAGAGAAAAPSAPDAPTTAAAPAADIAVDI

SEQ ID NO: 3314 - protein, 267 aa, Panicum virgatum
MEKAADNASQAAAPLKLFGSWASSYTHRVQLALRLKGLDFEYAEEDLGSKSAELLRHNPVYKKVPVLVHGGRALPESVIILQYLDDAWPETRPLLPADAFDRALARFWCHFADDKLGPAVGAVFASTGEDQEAAVRQVHENLALIEAELRDGAFKGRRFFGGDEVGLLDVVLGCGSYWLAVFEEVTGVRLVDADAFPLFHAWLRDFEALEEVRETIPAVDRLLEYARGVRHMLLGLAGAGAAAATPAEAPAAAAPAPAPAADIAVDI

SEQ ID NO: 3315 - protein, 260 aa, Setaria italica
MEKTPKNVSQAAAAPLKLLGSWASSYTHRVQLALRLKGLEFEYAEEDLGNKSVELLRLNPVYKKVPVLVHGGRALPESVIILQYLDDAWPETRPLLPADAFDRALARFWCHFADDKLGPAVGAVFASTGEDQEAAVRQVHENLALIEAELRDGAFKGRRFFGGDEVGLLDVVLGCGSYWLAVFEEVTGVRLVDADAFPLFHAWLRNFEALDEVRETIPAVDRLLEYARGVRHMLLGLAGAGSAAASAATPSEAPAAPAPA

SEQ ID NO: 3316 - protein, 268 aa, Leymus cinereus x Leymus triticoides
MEKAAENVDAGAAAQLKLFGSWASSYTHRVQLAMRLKGLGFEYAEEDLGNKSDALLHHNPVYKKVPVLVHHGRPLAESVIILQYLDDAFPATRQLLPADAFDRAVARFWCHFGDDKLGPAVGAVFASTGEDQEAAVRQVHENLALIEAELREGAFKGRRFFGGDEVGFLDVVLGCGSYWLAVFEEVTGVQLVDAEAFPLFHAWLRDFEAQDEVRETIPSIDRLLEYARGLRQMLVAMAAGAASADAPTAAPPAAAPPAATTADIAVDI

SEQ ID NO: 3317 - protein, 276 aa, Triticum aestivum
MEKAAENVDAGAAAQLQLQLKLFGSWASSYTHRVQLAMRLKGLAFEYAEEDLGNKSDALLRHNPVYKKVPVLVHDGRSLAESVIILQYLDDAFPASRQLLPADAFDRAVARFWCHFGDDKLGPAVGAVFASTGEEQEAAVRQVHENLALIEAELREGAFKGRRFFGGDEVGFLDVVLGCGSYWLAVFEEVTGVQLVDAQAFPLFHAWLRDFEAQDEVRETIPSIDRLLEYARGLRQMLVAMAAGAGAGAASADAPTAAPPAAAPPAATTADIAVDI

SEQ ID NO: 3318 - protein, 1120 aa, Sorghum bicolor
MALAYASAMFPPSSSSHKTWEDPSFFKWRKREAHVPLRSQDTLEGALKYWHERRNVNYLNSDTAVWNDDAVRGALESAVFWSKGLPYAKSLSGYWKFLLSPSVESVPERFYDTHFDDSNWAALPGTSYLLAVPSNWQMHGFDRPIYTNMTYPFPLNPPFVPADNPTGCYRTVFHIPKEWKGRRILLHFEAVDSAFFAWVNGVPIGYSQDSRLPAEFEVTDCCHPCDSDKENVLAVQVMRWSDGSYLEDQDHWRLSGIHRDVLLLSKPQIFITDYFFKATLDDNFSLADIEVDVEIDSHKKDREHVPTLSIEATLFDNSGLSISIDAGLSYANAVNLKPKPNPTGSPCRGFHGYVLGGKIENPKLWSSEHPNLYTLVVLLKDANGKLIDCESCQVGIRNVVLAHKQMLVNGCPVVLRGVNRHEHHPRLGKTNLEACMIEDVILMKQNNINAVRNSHYPQHPRWYELCDIFGLYVIDEANIETHGFDDSSTFKHPTLEPIWANAMLDRVVSMVERDKNHACIIVWSLGNESSYGPNHVSMSGWIRGRDPTRLLHYEGGGSRTSSTDIVCPMYMRVWDIVKIAKDPSETRPLILCEYSHAMGNSNGNIDAYWMAIDNTFGLQGGFIWDWVDEGLLKEDSDGSKFWAYGGDFGDTPNDSNFCLNGIVWPDRTIHPAVHEVKYLHQPIKISSAENMLKIENGHFFETTESLDFSWVLHGDGCILGSGPLNVPTLAPQTSHLINMELSPWFALWSACAAKEVFLSVNVKQRHETRWAKAGHLLASAQLCLPQKNVFVPNVIAFSSSPLVCERIGDSVTICKNNAWKIKVNSQLGTIDSWKVNDVELMSKGILPCFWRAPTDNDKGGFFTKPYASRWREAFLDNVSFHSSQFSIKESPDNTVEFSTVYYGVPGHLPKPDDEASESILFRVKMVCRIHESGDVVLDYEVNPKADLPPLPRVGVVFSAERSLSHVTWYGRGPFECYPDRKAAAHVGVYESSVEELHVPYIAPVECGGRADVRWVALRDGGGLGLYASAHGGSPPMQVSASYYGAAELDRATHVHRLVKGDDIEVHLDHRHMGLGGDDSWSPCVHEQYLLPPTRYAFSLRLCPLLPTSLCHDIYRSQLPS

SEQ ID NO: 3319 - protein, 1117 aa, Oryza sativa
MAVASASALFSAKNLPHKPWEDPSFFRWRKREAHVPLRSHDTPEGALKYWHERRNVNYLNSDSAVWNDDAVRGALESAAFWSKGLPYVQTLSGYWKFLLASSPESVPEKFYDAYFNDSDWEALPVPSNWQMHGFDRPIYTNVTYPFTMNPPFVPNDNPTGCYRTVFRIPKEWKGRRILLHFEAVDSAFFAWVNGVPVGYSQDSRLPAEFEITDFCHPCDSEKENVLAVQVMRWSDGSYLEDQDHWWLSGIHRDVLLVSKPQIFITDYFFKATLDEGFRVADIEVEVEIDSQKQDREHVSTLSIEATLYDNYGPADVLTSDMSAASVANLKLKPASRPKHCYGFHGYVLGGKVENPKLWSSEHPNLYTLVVVLKDSNGKLIECESCQVGIRNVVLAHKQMLVNGCPVVIRGVNRHEHHPRVGKTNLEACMIKDLVLMRQNNINAVRNSHYPQHPRWYELCDIFGLYVIDEANIETHGFDESSHFKHPTLEPFWASAMLDRVVGMVERDKNHACIIVWSLGNESSYGPNHSAMSGWIRGKDPTRPIHYEGGGSRTSSTDIVCPMYMRVWDILKIAQDPSENRPLILCEYSHAMGNSNGNIDAYWMAIDNTVGLQGGFIWDWVDQGLLKEDADGSKNWAYGGDFGDTPNDLNFCLNGIVWPDRTIHPAVHEVKYLYQPIKITMMDNMLKIENVHFFETTEALDFSWLLQGDGCALGSGSLNVPSIAPQSTHLINMKSSPWFTIWSTCVVKEIFLSINVKLRYQTQWAKDGHILASAQICLPPKKGFVPHAIALPRSSLVSERVGDHVLISKSNAWQIKVNSISGTIDSWKVNNIELMSKGIHPCFWRTPTDNDKGGFYTKPYVSRWREASLDNISFYSSQFSLKELPDQTVEISTIYYGLPGNQPKPDETSLSDESESVLFRVQMRGRIYDSGDVILDYEVSPKNDLPPLPRVGVVFNADKSLSRAKWYGRGPFECYPDRKAAAHVGVYESGVDELHVPYIVPGECGGRADVRWVALQDADGFGLFASAYGESPPMQVSASYYGAAELDRATHNHKLVKGDDIEVHLDHKHMGLGGDDSWSPCVHEQYLLPPARYAFSVRLCPLLPSSSCHDIYHSQLPC

SEQ ID NO: 3320 - protein, 145 aa, Panicum virgatum
MPKIKTSRVSYPEGWELIEPTIRELDAKMREAENDPHDGKRKCEALWPIFRISHQRSRYIYDLYYRRKEISQKLYEFCLDQGYADRNLIAKWKKPGYERLCCLRCIQTRDHNFATTCVCRVPKHLREEQVIECVHCGCRGCASGD

SEQ ID NO: 3321 - protein, 145 aa, Zea mays
MPKIKTSRVKYPEGWELIEPTIRELDAKMREAENDPHDGKRKCEALWPIFRISHQRSRYIYDLYYRRKEISRELYEFCLDQSYADRNLIAKWKKPGYERLCCLRCIQTRDHNFATTCVCRVPKHLREEQVIECVHCGCRGCASGD

SEQ ID NO: 3322 - protein, 145 aa, Sorghum bicolor
MPKIKTSRGQYPEGWELIEPTIRELDAKMREAENDPHDGKRKCEALWPIFRISHQRSRYIYDLYYRRKEISQELYEFCLDQGYADRNLIAKWKKPGYERLCCLRCIQTRDHNFATTCVCRVPKHLREEQVIECVHCGCRGCASGD

SEQ ID NO: 3323 - protein, 145 aa, Unknown
  Sequence found in Organisms: Pennisetum glaucum, Setaria italica
MPKIKTSRVSYPEGWELIEPTIRELDAKMREAENDPHDGKRKCEALWPIFRISHQRSRYIYDLYYRRKEISQKLYEFCLDQGYADRNLIAKWKKPGYERLCCLRCIQTRDHNFATTCVCRVPKHLREEQVIECVHCGCKGCASGD

SEQ ID NO: 3324 - protein, 145 aa, Cynodon dactylon
MPKIKTSRVEYPAGWELIEPTIRELDAKMREAENDPHDGKRKCEALWPIFRISHQRSRYIYDLYYRRKEISKELYEFCLNQGYADRNLIAKWKKPGYERLCCLRCIQTRDHNFATTCVCRVPKHLREEQVIECVHCGCRGCASGD

SEQ ID NO: 3325 - protein, 145 aa, Oryza sativa
MPKIKTSRVKYPGGWELIEPTIRELDAKMREAENDTHDGKRKCEALWPIFRISHQRSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 3326 - protein, 145 aa, Unknown
  Sequence found in Organisms: Sorghum bicolor, Saccharum officinarum, Panicum virgatum
MPKIKTSRVKYPEGWELIEPTLRDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 3327 - protein, 145 aa, Hordeum vulgare
MPKIKTSRVEYPEGWALIEPTIRELDAKMREAENDTHDGKRKCEALWPIFRISHQRSRYIYDLFYRRKEISKELYEFCLDQGYADRNLIAKWKKPGYERLCCLRCIQTRDHNFATTCVCRVPKHLREEQVIECVHCGCKGCASGD

SEQ ID NO: 3328 - protein, 145 aa, Setaria italica
MPKIKTSRVKYPEGWELIEPTLRDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCKGCASGD

SEQ ID NO: 3329 - protein, 145 aa, Avena sativa
MPKIKTSRIAYPEGWVLIEPTIRELDAKMREAENDTHDGKRKCEALWPIFRISHQRSRYIYDLFYRRKEISKELYEFCLDQGYADRNLIAKWKKPGYERLCCLRCIQTRDHNFATTCVCRVPKHLREEQVIECVHCGCKGCASGD

SEQ ID NO: 3330 - protein, 144 aa, Festuca arundinacea
  misc_feature (16)..(16): Xaa can be any naturally occurring amino acid
MPKIKTSRVEYPEGWXLIEPTIRELDAKMREAENDTHDGKRKCEALWPIFRISHQRSRYIYDLFYRRKEISKELYEFCLDQGYADRNLIAKWKKPGYERLCCLRCIQTRDHNFATTCVCRVPKHLREEQVIECVHCGCKGCASG

SEQ ID NO: 3331 - protein, 145 aa, Triticum aestivum
MPKIKTSRVEYPEGWVLIEPTIRELDAKMREAENDTHDGKRKCEALWPIFRISHQRSRYIYDLFYKRKEISKELYEFCLDQGYADRNLIAKWKKPGYERLCCLRCIQTRDHNFATTCVCRVPKHLREEQVIECVHCGCKGCASGD

SEQ ID NO: 3332 - protein, 145 aa, Panicum virgatum
MPKIKTSRVKYPEGWELIEPTLHDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 3333 - protein, 145 aa, Cynodon dactylon
MPKIKTSRVKYPEGWELIEPTLRDLEAKMREAENDPHDGKRKCEALWPIFRISHQKSRYIYDLYYRRKEISKELYEFCLNQGYADKNLIAKWKKPGYERLCCLRCIQTRDHNFATTCVCRVPKHLREEKVIECVHCGCRGCASGD

SEQ ID NO: 3334 - protein, 145 aa, Oryza sativa
MPKIKTSRVKYPEGWELIEPTLRDLEAKMREAENDPHDGKRKCEALWPIFRISHQKSRYIYDLYYRRKEISKELYEFCLDQGHADKNLIAKWKKPGYERLCCLRCIQTRDHNFATTCVCRVPKHLREEKVIECVHCGCRGCASGD

SEQ ID NO: 3335 - protein, 145 aa, Musa acuminata
MPKIKTSRVKYPEGWELIEPTPRELEAKMREAENDPHDGKRKCEALWPIFRIAHQKSRYIYDLYHRRKEISKELYEFCLDQGYADRNLIAKWKKPGYERLCCLRCMQTRDHNFATTCVCRVPKHLREEKVIECVHCGCRGCASGD

SEQ ID NO: 3336 - protein, 145 aa, Musa acuminata
  misc_feature (22)..(22): Xaa can be any naturally occurring amino acid
MPKIKTSRVKYPEGWELIEPTXRELEAKMREAENDPHDGKRKCEALWPIFRIAHQKSRYIYDLYHRRKEISKELYEFCLDQGYADRNLIAKWKKPGYERLCCLRCMQTRDHNFATTCVCRVPKHLREEKVIECVHCGCRGCASGD

SEQ ID NO: 3337 - protein, 145 aa, Pennisetum glaucum
MPKIKTSRVKYPDGWELIEPTLRDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCKGCASGD

SEQ ID NO: 3338 - protein, 145 aa, Brachypodium distachyon
MPKIKTSRVKYPEGWELIEPTLRDLEAKMREAENDTHDGKRKCEALWPIFRISHQKSRYIYDLYYRRKEISKELYEFCLDQGYADKNLIAKWKKPGYERLCCLRCIQTRDHNFATTCVCRVPKHLREEKVIECVHCGCKGCASGD

SEQ ID NO: 3339 - protein, 145 aa, Aristolochia fimbriata
MPKIKTNRIKYPNGWELIEPTLRELEAKMREAENDPHDGKRKCEALWPIFRIAHQKSRYIYDLYYRRKEISKELYEFCLDQGYADRNLIAKWKKPGYERLCCLRCIQPRDHNFATTCVCRVPKHLREEKVIECVHCGCRGCASGD

SEQ ID NO: 3340 - protein, 145 aa, Avena sativa
MPKIKTSRVKYPEGWELIEPTLRDLEGKMREAENDTHDGKRKCEALWPIFRISHQKSRYIYDLYYRRKEISKELYEFCLDQGYADKNLIAKWKKPGYERLCCLRCIQTRDHNFATTCVCRVPKHLREEKVIECVHCGCKGCASGD

SEQ ID NO: 3341 - protein, 145 aa, Triticum aestivum
MPKIKTSRVKYPEGWELIEPTLRDLEAKMREAENDTHDGKRKCEALWPIFRISHQKSRYIYDLYYRRKEIKRELYEFCLDQGYADKNLIAKWKKPGYERLCCLRCIQTRDHNFATTCVCRVPKHLREETVIECVHCGCKGCASGD

SEQ ID NO: 3342 - protein, 145 aa, Elaeis guineensis
MPKIKTSRVKYPEGWELIEPTLRELEAKMREAENDPHDGKRKCEALWPIFKIAHQKSRYIYDLYYRRKEISKELYEFCLDQGHADRNLIAKWKKPGYERLCCLRCMQTRDHNFATTCVCRVPRHLREEKVIECVHCGCRGCASGD

SEQ ID NO: 3343 - protein, 145 aa, Unknown
  Sequence found in Organisms: Hordeum vulgare, Triticum aestivum
MPKIKTSRVKYPEGWELIEPTLRDLEAKMREAENDTHDGKRKCEALWPIFRISHQKSRYIYDLYYRRKEIKKELYEFCLDQGYADKNLIAKWKKPGYERLCCLRCIQTRDHNFATTCVCRVPKHLREETVIECVHCGCKGCASGD

SEQ ID NO: 3344 - protein, 145 aa, Ananas comosus
MPKIKTSRVKYPEGWELIEPTLHELEAKMREAENDPHDGKRKCEALWPIFRIAHQKSRYIYDLYHRRKEISKELYEFCLDQGYADRNLIAKWKKPGYERLCCLRCMQTRDHNFTTTCVCRVPKHLREEKVIECVHCGCGGCASGD

SEQ ID NO: 3345 - protein, 145 aa, Eucalyptus gunnii
MPKVKTNRVKYPEGWELIEPTLRELQAKMREAENDPHDGKRKCEALWPIFKIAHQKSRYIYDLYYRRKEISKELYEFCLDQGYADKNLIAKWKKPGYERLCCLRCIQPRDHNFATTCVCRVPKHLREEKVIECVHCGCRGCASGD

SEQ ID NO: 3346 - protein, 145 aa, Amborella trichopoda
MPKIKTNRVQYPGGWELIEPTLRELEAKMREAENDTHDGKRKCEALWPIFRIAHQKSRYIYDLYYRRKEISKELYEFCLEQGYADRNLIAKWKKPGYERLCCLRCIQPRDHNFNTTCVCRVPKHLREEKVIECVHCGCRGCASGD

SEQ ID NO: 3347 - protein, 145 aa, Aquilegia formosa
MPKIKTNRVKYPTGWELIEPTLRELEAKMREAENDPHDGKRKCEGLWPIFRIAHQKSRYIYDLYYRRKEISKELYEFCLEQGYGDRNLIAKWKKSGYERLCCLRCIQPRDHNFATTCVCRVPKHLREEKVIECVHCGCGGCASGD

SEQ ID NO: 3348 - protein, 145 aa, Aristolochia fimbriata
MPKITTSRTKYPQGWELIEPTLRELEAKMREAENDPHDGKRKCETLWPIFRISHQRSRYIFDLYYRQQEISKELYEFCLDQGYADRNLIAKWKKPGYERLCCLRCIQPRDHNFATTCICRVPKHLREEKVIECVHCGCHGCASGD

SEQ ID NO: 3349 - protein, 145 aa, Unknown
  Sequence found in Organisms: Cucumis sativus, Cucumis melo, Momordica charantia
MPKIKTNRVKYPEGWELIEPTLRELQAKMREAENDPHDGKRKCETLWPIFKIAHQKSRYIFDLYHRRKEISKELFEFCLDQGYADRNLIAKWKKPGYERLCCLRCMQPRDHNFATTCVCRVPKHLREEKVIECVHCGCRGCASGD

SEQ ID NO: 3350 - protein, 145 aa, Oryza sativa
MPKIKTSGVKYPDGWELIEPTLSELHSKMREAENDPHDGRRKCEALWPIFKINHQRSRYLYDLYYNRKEISQELYEFCLDQGHADRNLIAKWKKQGYERLCCLRCIQTRDHNFATTCVCRVPKHLREEQVIECVHCGCKGCASGD

SEQ ID NO: 3351 - protein, 145 aa, Acacia harpophylla
MPKVKTNRVKYPEGWELIEPTLRELQAKMREAENDPHDGKRKCETLWPIFKIAHQKSRYIFDLYHRRKEISKELYEFCLDQGYADHNLIAKWKKPGYERLCCLRCIQPRDHNFATTCVCRVPKQLREEKVIECVHCGCRGCASGD

SEQ ID NO: 3352 - protein, 145 aa, Unknown
  Sequence found in Organisms: Castanea mollissima, Quercus alba
MPKVKTNRVKYPEGWELIEPTLRDLQGKMREAENDPHDGKRKCEALWPIFKLAHQKSRYIFDLYHRRKEISKELYEFCLDQGYADRNLIAKWKKPGYERLCCLRCIQPRDHNFATTCVCRVPKHLREEKVIECVHCGCRGCASGD

SEQ ID NO: 3353 - protein, 145 aa, Helianthus annuus
MPKVKTNRVKYPEGWELIEPTLRELQGKMREAENDPHDGKRKCEALWPIFKIAHQKSRYIYDLYYRRKEISKELFEFCLDQGYADRNIIAKWKKPGYERLCCLRCIQPRDHNFQTTCVCRVPKHLREEKVIECVHCGCKGCASGD

SEQ ID NO: 3354 - protein, 145 aa, Vitis vinifera
MPKVKTNRVKYPEGWELIEPTLRELQGKMREAENDPHDGKRKCEALWPIFKIAHQKSRYIFDLYHRRKEISKELYEFCMDQGYADRNLIAKWKKPGYERLCCLRCMQPRDHNFATTCVCRVPKHLREEKVIECVHCGCRGCASGD

SEQ ID NO: 3355 - protein, 145 aa, Unknown
  Sequence found in Organisms: Brassica napus, Brassica oleracea, Brassica rapa
MPKIKTNRVKYPEGWELIEPTLRELDAKMREAEMDEHDGKRKCEALWPIFKLSHQRSRYVYDLYYRRKEISKELYEFCLDQGYADRNLIAKWKKSGYERLCCLRCIQPRDHNYGTTCVCRVPKHLREEKAIECVHCGCQGCASGD

SEQ ID NO: 3356 - protein, 145 aa, Gossypium hirsutum
MPKVKTNRVKYPEGWELIEPTLRELQAKMREAENDPHDGKRKCETLWPIFKIAHQKSRYIFDLYHRRKEISKELYEFCLDQGYADRNLIAKWKKPGYERLCCLRCMQPRDHNFATTCVCRVPKHLREEKVIECVHCGCKGCASGD

SEQ ID NO: 3357 - protein, 145 aa, Malus domestica
MPKVKTNRVKYPEGWELIEPTLRELQAKMREAENDTHDGKRKCETLWPIFKIAHQKSRYIFDLYHRRKEISKELYEFCLDQGYADRNLIAKWKKPGYERLCCLRCMQPRDHNFATTCVCRVPKHLREEKVIECVHCGCRGCASGD

SEQ ID NO: 3358 - protein, 145 aa, Manihot esculenta
MPKVKTNRVKYPEGWELIEPTLRELQAKMREAENDTHDGKRKCEALWPIFKIAHQKSRYIFDLYHRRKEISKELYEFCLDQGYADRNLIAKWKKPGYERLCCLRCMQPRDHNFATTCVCRVPKNLREEKVIECVHCGCRGCASGD

SEQ ID NO: 3359 - protein, 145 aa, Lotus japonicus
MPKVKTNRVKYPEGWELIEPTIRELQAKMREAENDPHDGKRKCETLWPIFKIAHQKSRYIFDLYHRRKEISKELYEFCLDQGYADRNLIAKWKKPGYERLCCLRCMQPRDHNFATTCVCRVPKQLREEKVIECVHCGCKGCASGD

SEQ ID NO: 3360 - protein, 145 aa, Ricinus communis
MPKVKTNRVNYPEGWELIEPTLRELQAKMREAENDPHDGKRKCEALWPIFKIAHQKSRYIFDLYHRRKEISKELYEFCLDQGYADRNLIAKWKKPGYERLCCLRCMQPRDHNFATTCVCRVPKNLREEKVIECVHCGCRGCASGD

SEQ ID NO: 3361 - protein, 145 aa, Unknown
  Sequence found in Organisms: Brassica juncea, Raphanus sativus
MPKVKTNRVKYPEGWELIEPTLRELDAKMREAEMDTHDGKRKCEALWPIFKLSHQRSRYVYDLYYRRKEISKELYEFCLDQGYADRNLIAKWKKSGYERLCCLRCIQPRDHNYGTTCVCRVPKHLREEKAIECVHCGCQGCASGD

SEQ ID NO: 3362 - protein, 145 aa, Hevea brasiliensis
MPKVKTNRVKYPEGWELIEPTLRELQAKMREAENDTHDGKRKCEALWPIFKIAHQKSRYIFDLYHRQKEISKELYEFCLDQGYADRNLIAKWKKPGYERLCCLRCMQPRDHNFATTCVCRVPKNLREEKVIECVHCGCRGCASGD

SEQ ID NO: 3363 - protein, 145 aa, Unknown
  Sequence found in Organisms: Ipomoea nil, Ipomoea nil
MPKVKTNRVKYPEGWELIEPTLNELQAKMREAENDPHDGKRKCEALWPIFKICHQKSRYIFDLYHRRKEISKELYEFCLDQGYADRNLIAKWKKPGYERLCCLRCMQPRDHNFQTTCVCRVPKHLREEKVIECVHCGCKGCASGD

SEQ ID NO: 3364 - protein, 145 aa, Tropaeolum majus
MPKVKTSRVKYPEGWELIEPTLRELGAKMREAENDPNDGKRKCESLWPIFKIAHQKSRYIFDLYYKRNEISKELYEFCLDQGYADRNLIAKWKKPGYERLCCLRCIQPRDHNFATTCVCRVPKHLREEKVVECVHCGCGGCASGD

SEQ ID NO: 3365 - protein, 145 aa, Fragaria vesca
MPKVKTNRVTYPEGWELIEPTLRELQAKMREAENDTHDGKRKCETLWPIFKIAHQKSRYIFDLYHRRKEISKELYEFCLDQGYADRNLIAKWKKPGYERLCCLRCMQPRDHNFATTCVCRVPKHLREEKVIECVHCGCRGCASGD

SEQ ID NO: 3366 - protein, 145 aa, Rosa hybrid cultivar
MPKVKTNRVNYPEGWELIEPTLRELQAKMREAENDTHDGKRKCETLWPIFKIAHQKSRYIFDLYHRRKEISKELYEFCLDQGYADRNLIAKWKKPGYERLCCLRCMQPRDHNFATTCVCRVPKHLREEKVIECVHCGCRGCASGD

SEQ ID NO: 3367 - protein, 145 aa, Theobroma cacao
MPKVKTNRVKYPEGWELIEPTLRELQAKMREAENDPHDGKRKCETLWPIFKIAHQKSRYIFDLYHRRKEISKELYEFCLDQAYADRNLIAKWKKPGYERLCCLRCMQPRDHNFATTCVCRVPKHLREEKVIECVHCGCKGCASGD

SEQ ID NO: 3368 - protein, 145 aa, Prunus persica
MPKVKTNRVKYPEGWELIEPTIRELQAKMREAENDTHDGKRKCETLWPIFKIAHQKSRYIFDLYHRRNEISKELYEFCLDQGYADRNLIAKWKKPGYERLCCLRCMQPRDHNFATTCVCRVPKHLREEKVIECVHCGCKGCASGD

SEQ ID NO: 3369 - protein, 145 aa, Citrus sinensis
MPKVKTNRVKIPEGWELIEPTLRELQAKMREAENDPHDGKRKCETLWPIFKIAHQKSRYIFDLYYRRKEISKELYEFCLDQGYADRNLIAKWKKPGYERLCCLRCMQPRDHNFQTTCVCRVPKNLREEKVIECVHCGCRGCASGD

SEQ ID NO: 3370 - protein, 145 aa, Senecio madagascariensis
MPKVKTNRVKYPEGWELVEPTLNELQAKMREAENDPHDGKRKCETLWPIFKIAHQKSRYIFDLYYRRKEISQELYEFCLDQGYADRNIIAKWKKPGYERLCCLRCIQPRDHNFQTTCVCRVPKHLREEKVIECVHCGCKGCASGD

SEQ ID NO: 3371 - protein, 145 aa, Unknown
  Sequence found in Organisms: Glycine max, Vigna unguiculata, Glycyrrhiza uralensis, Arachis hypogaea
MPKVKTNRVKYPEGWELIEPTLRELQAKMREAENDPHDGKRKCETLWPIFKIAHQKSRYIFDLYHRRKEISKELYEFCLDQGYADRNLIAKWKKPGYERLCCLRCMQPRDHNFATTCVCRVPKQLREEKVIECVHCGCKGCASGD

SEQ ID NO: 3372 - protein, 756 aa, Brachypodium distachyon
MPKIKTSRVKYPEGWELIEPTIRDLDAKMREAENDTHDGKRKCEALWPIFRISHQRSRYIYDLYYRRKEISKDLYEFCLDQGYADRNLIAKWKKPGYERLCCLRCIQTRDHNFATTCVCRVPKHLREEQVAELEEQVLAVTAQRQQAERETDEVLAILESRGFSGSQLSEVLDSGSDNDEEELRDTKANGDVASSHGEVEPEQEPAAQREAEEDAQPEPEPGGLSWKGRSVSPRKARQLKQRHRRSYFYLLASEPDPSRCKYRMGQSCRKNKRTELRSPAPVVVEDGTGLAVSAESRKGKQQQDDERDDDLDGEVGGDERSSGDGRGQYVIRCRKDGEMERVLEKQAELIGQFEAEEKAQRDWEKQFNDNRRSPKDLKPWQHGYCRPMFLFSKFQGDVKAAAYRLDSGRGQSNRRSSKVEEQEASSQVQANSSGKSLPCSKQPESTATRRNQDEQGDANSDACSSYSINARPSRHRAMVKSSSESTDTRISKVSDWSSSRFHDHSHTDGRQLMDTRLDRQPSNNDIDVESVLQALQRAKISLTKKLLSKPLPPSQVTLALPAPGDEYRTEEDFYDGNDSYRGEEHSGSSPSRQEILALPAPEDHRTDFSSFAEKSISSSPPRQEILALPAPGDDCSGEREDVSDLKILMSSPGLLRLPTDSFPPDEMLSTSNGHDSELGLRETARYDPHGSATLALPNSGKCNVPSSAFSVGSAASFLSGVPELPEDLRRGRKPLADVNSFMQRGCDYTVSNKWML

SEQ ID NO: 3373 - protein, 145 aa, Aquilegia formosa
MPKIKTNRVTYPVGWELIEPTLRELEAKMREAENDPHDGKRKCEGLWPIFRIAHQKSRYIYDLYYRRNEISRELYEFCLEQGYGDRNLIAKWKKSGYERLCCLQCIQPRDHNFATTCVCRVPKHLREEKVIECVHCGCGGCASGD

SEQ ID NO: 3374 - protein, 145 aa, Artemisia annua
MPKVKTNRVKYPEGWELVEPTLRELQAKMREAENDPHDGKRKCEALWPIFKIAHQQSRYVFDLYHRRKEISAELFEFCLDQGYADRNLIAKWKKPGYERLCCLRCIQPRDHNFQTTCVCRVPKHLREESVIECVHCGCKGCASGD

SEQ ID NO: 3375 - protein, 143 aa, Brassica juncea
KIKTNRVKYPEGWELIEPTLRELDAKMREAEMDTHDGKRKCEALWPIFKLSHQRSRYVYDLYYRRKEISKELYEFCLDQGYADRNLIAKWKKSGYERLCCLRCIQPRDHNYGTTCVCRVPKHLREEKAIECVHCGCQGCASGD

SEQ ID NO: 3376 - protein, 145 aa, Brassica napus
MPKVKTNRVKYPEGWELIEPTLRELDAKMREAEMDEHDGKRKCEALWPIFKLSHQRSRYVYDLYYRREEISKELYEFCLDQGYADRNLIAKWKKSGYERLCCLRCIQPRDHNYGTTCVCRVPKHLREEKVVECVHCGCQGCASGD

SEQ ID NO: 3377 - protein, 145 aa, Cleome spinosa
MPKIRTNRVKYPEGWELIEPTLRELDAKMREAETDPHDGKRKCEGLWPIFKISHQRSRYLYDLYYRRNEISQELYEFCLDQGYGDRSLIAKWKKSGYERLCCLRCIQPRDHNFGTTCVCRVPKHLREEKAVECVHCGCQGCASGD

SEQ ID NO: 3378 - protein, 145 aa, Cyamopsis tetragonoloba
  misc_feature (139)..(139): Xaa can be any naturally occurring amino acid
  misc_feature (145)..(145): Xaa can be any naturally occurring amino acid
MPKVKTNRVKYPEGWELIEPTLRELQAKMREAENDPHDGKRKCETLWPIFKIAHQKSRYIFDLYHRRKEISKELYEFCLDQGYADRNLIAKWKKPGYERLCCLRCMQPRDHNFATTCVCRVPKQLREEKVIECVHCGCXGCASGX

SEQ ID NO: 3379 - protein, 145 aa, Solanum melongena
MPKVKTNRVKYPEGWELIEPTLSELQAKMREAENDPHDGKRKCEALWPIFKIAHQKSRYIFDLYHRRKEISKELYEFCMDQGYADRNLIAKWKKPGYERLCCLRCIQPRDHNFQTTCVCRVPQHLREEKVIECVHCGCKGCASGD

SEQ ID NO: 3380 - protein, 145 aa, Cajanus cajan
MPKVKTNRVKYPEGWELIEPTLRELQGKMREAENDPHDGKRKCETLWPIFKIAHQKSRYIFDLYHRRKEISKELYEFCLDQGYADRNLIAKWKKPGYERLCCLRCMQPRDHNFATTCVCRVPKQLREEKVIECVHCGCKGCASGD

SEQ ID NO: 3381 - protein, 145 aa, Salvia sclarea
MPKVKTNRVKIPEGWELIEPTLRELQAKMREAENDPHDGKRKCEALWPIFKIAHQKSRYIFDLFHRRKEISKELYEFCLDQGYADRNLIAKWKKPGYERLCCLRCMQPRDHNFQTTCVCRVPKHLREEKVIECVHCGCNGCASGD

SEQ ID NO: 3382 - protein, 145 aa, Helianthus annuus
MPKVKTNRVKYPEGWELVEPTLNELQAKMREAENDPHDGKRKCEALWPIFKIAHQKSRYIFDLYHRRKEISAELYEFCLDQGYADRNIIAKWKKPGYERLCCLRCIQPRDHNFNTTCVCRVPKHLREEKVIECVHCGCKGCASGD

SEQ ID NO: 3383 - protein, 145 aa, Papaver somniferum
MPKIKTNRVRYPEGWELIEPTLRELEAKMREAENDPHDGKRKCEALWPIFNIAHQKSRYIYDLFYRRKDISKELYEFCLDQGYADRNLIAKWKKSGYERLCCLQCIQPRDHNFGTTCVCRVPKHLRDEKVIECVHCGCNGCASGD

SEQ ID NO: 3384 - protein, 145 aa, Mimulus guttatus
MPKVKTNRVKYPEGWELIEPTLRELQAKMREAENDPHDGQRKCEALWPIFKIAHQQSRYVFDLYHRRHEISRELYEFCLDQGYADRNLIAKWKKPGYERLCCLRCIQPRDHNFQTTCVCRVPKHLREEKVIECVHCGCGGCASGD

SEQ ID NO: 3385 - protein, 145 aa, Raphanus sativus
  misc_feature (22)..(22): Xaa can be any naturally occurring amino acid
  misc_feature (86)..(86): Xaa can be any naturally occurring amino acid
MPKVKTNRVKYPEGWELIEPTXRELDAKMREAEMDTHDGKRKCEALWPIFKLSHQRSRYVYDLYYRRKEISKELYEFCLDQGYADXNLIAKWKKSGYERLCCLRCIQPRDHNYGTTCVCRVPKHLREEKAIECVHCGCQGCASGD

SEQ ID NO: 3386 - protein, 145 aa, Antirrhinum majus
MPKVKTNRVKYPEGWELIEPTLRELQAKMREAENDPHDGKRKCEGMWPIFKIAHQKSRYIFDLYHRRKEISKELYEFCLDQGYADRNLIAKWKKPGYERLCCLRCMQPRDHNFQTTCVCRVPKHLREEKVIECVHCGCGGCASGD

SEQ ID NO: 3387 - protein, 145 aa, Unknown
  Sequence found in Organisms: Brassica napus, Brassica rapa
MPKIKTNRVKYPEGWELIEPTLRELDAKMREAEMDEHDGKRKCEALWPIFKLSHQRSRYVYDLYYRREEISKELYEFCLDQGYADRSLIAKWKKSGYERLCCLRCIQPRDHNYGTTCVCRVPKHLREEKVVECVHCGCQGCASGD

SEQ ID NO: 3388 - protein, 145 aa, Nuphar advena
MPKIKTNRVKYPSGWELIEPTLRDLEGQMREAENDPHDGKRKCEGLWPIFRIAHQKSRYIFDLYHRRKEISKELYEFCLDQGYADRNLIAKWKKPGYERLCCLRCIQPRDHNFSTTCVCRVPKHLREEKVIECVHCGCGGCASGD

SEQ ID NO: 3389 - protein, 145 aa, Petunia hybrida
MPKVKTNRVKIPEGWELIEPTLSELQAKMREAENDPHDGKRKCEALWPIFKIAHQKSRYIFDLYHRRKEISKELYEFCLDQGYADRNLIAKWKKPGYERLCCLRCMQPRDHNFQTTCVCRVPKHLREEKVIECVHCGCKGCASGD

SEQ ID NO: 3390 - protein, 145 aa, Coffea canephora
MPKVKTNRVRYPEGWELIEPTLNELQAKMREAENDPNDNKRKCEALWPIFKIAHQKSRYIFDLYYRRKEISKELYEFCLDQGYADRNLIAKWKKPGYERLCCLRCMQPRDHNFQTTCVCRVPKHLREEKVIECVHCGCRGCASGD

SEQ ID NO: 3391 - protein, 145 aa, Raphanus sativus
MPKVKTNRVKYPEGWELIEPTLRELDAKMIEAEMDTHDGKRKCEALWPIFKLSHQRSRYVYDLYYRRKEISKELYEFCLDQGYADRNLIAKWKKSGYERLCCLRCIQPRDHNYGTTCVCRVPKHLREEKAIECVHCGCQGCASGD

SEQ ID NO: 3392 - protein, 145 aa, Brachypodium distachyon
MPKVKTSGVKYPDGWEVIEPTLSELHSKMREAENDPHDGKRKCEALWPIFKINHQRSRYLYDLYYNRKEISRELYEFCLDQGHADRNLIAKWKKPGYERLCCLHCIQTRDHNFATTCACRVPKHLREEQVIECVHCGCKGCASGD

SEQ ID NO: 3393 - protein, 145 aa, Taraxacum officinale
MPKVKTNRVKYPEGWELIEPTLRELQGKMREAENDPHDGKRKCEALWPIFKIAHQKSRYIFDLYHRRKEISPELYEFCLDQGYADRNIIAKWKKAGYERLCCLRCIQPRDHNFQTTCVCRVPKHLREEKVIECVHCGCKGCASGD

SEQ ID NO: 3394 - protein, 145 aa, Malus domestica
MPKVKTNRVKYPQGWELIEPTLRELQAKMREAENDTHDGKRKCETLWPIFKIAHQKSRYIFDLYHRRKEISKELYDFCLDQGYADRNLIAKWKKPGYERLCCLRCMQPRDHNFATTCVCRVPKHLREEKVIECVHCGCRGCASGD

SEQ ID NO: 3395 - protein, 145 aa, Brassica juncea
MPKVKTNRVKYPEGWELIEPTLRELDAKMREAEMDTHDGKRKCEALWPIFKLSHQRSRYVYDLYYRREEISKELYEFCLDQGYADRSLIAKWKKSGYERLCCLRCIQPRDHNYGTTCVCRVPKHLREEKVVECVHCGCQGCASGD

SEQ ID NO: 3396 - protein, 145 aa, Taraxacum officinale
MPKVKTNRVKYPEGWELIEPTLRELQGKMREAENDPHDGKRKCEALWPIFKIAHQKSRYIFDLYHRRREISKELFEFCLDQGYADRNIIAKWKKPGYERLCCLRCIQPRDHNFQTTCVCRVPKHLREEKVIECVHCGCKGCASGD

SEQ ID NO: 3397 - protein, 145 aa, Guizotia abyssinica
MPKVKTNRAKYPEGWELVEPTLNELQAKMREAENDPHDGKRKCEALWPIFKIAHQKSRYIFDLYHRRKEISAELYEFCLDQGYADRNIIAKWKKPGYERLCCLRCIQPRDHNFNTTCVCRVPKHLREEKVIECVHCGCKGCASGD

SEQ ID NO: 3398 - protein, 141 aa, Lolium multiflorum
AWSRPRYPEGWELIEPTLRDLEAKMREAENDTHDGKRKCEALWPIFRISHQKSRYIYDLYYRRKEIKKELYEFCLDQGYADKNLIAKWKKPGYERLCCLRCIQTRDHNFATTCVCRVPKHLREEKVIECVHCGCKGCASGD

SEQ ID NO: 3399 - protein, 145 aa, Unknown
  Sequence found in Organisms: Centaurea maculosa, Cynara scolymus, Gerbera hybrid cultivar, Carthamus tinctorius, Tragopogon dubius
MPKVKTNRVKYPEGWELIEPTLRELQGKMREAENDPHDGKRKCETLWPIFKIAHQKSRYIFDLYHRRREISKELYEFCLDQGYADRNIIAKWKKPGYERLCCLRCIQPRDHNFQTTCVCRVPKHLREEKVIECVHCGCKGCASGD

SEQ ID NO: 3400 - protein, 145 aa, Brassica napus
MPKVKTNRVKYPEGWELIEPTLRDLDAKMREAEMDEHDGKRKCEALWPIFKLSHQRSRYVYDLYYRREEISKELYEFCLDQGYADRNLIAKWKKSGYERLCCLRCIQPRDHNYGTTCVCRVPKHLREEKVVECVHCGCQGCASGD

SEQ ID NO: 3401 - protein, 145 aa, Medicago truncatula
MPKVKTNRVKYPEGWELIEPTLRELQGKMREAENDPHDGKRKCETLWPIFKIAHQKSRYVFDLYHRRKEISKELYEFCLDQGYADRNLIAKWKKPGYERLCCLRCMQPRDHNFATTCVCRVPKQLREEKVIECVHCGCKGCASGD

SEQ ID NO: 3402 - protein, 145 aa, Populus trichocarpa
MPKVRTNRVKYPEGWELIEPTLRELDGKMREAELDPHDGKRKCEALWPIFKITHQKSRYVYDLYYRRSEISKELYEFCLDQGYGDRNLIAKWKKPGYERLCCLRCIQPRDHNFGTTCVCRVPKHLREEKVVECVHCGCGGCASGD

SEQ ID NO: 3403 - protein, 145 aa, Populus trichocarpa
MPKVRRSRIKYPEGWELIEPTLRELDGKMREAELDPHDGKRKCEALWPIFKITHQKSRYIYDLYYRRNEISKELYEFCLDQGYGDRNLIAKWKKPGYERLCCLRCIQPRDHNFGTTCVCRVPKHLREEKVVECVHCGCGGCASGD

SEQ ID NO: 3404 - protein, 145 aa, Ocimum basilicum
MPKVKTNRVKYPEGWELIEPTLRELQAKMREAENDPHDGKRKCEGLWPIFKIAHQKSRYVFDLYHRRKEISKELYEFCLDQGYADRNLIAKWKKPGYERLCCLRCMQPRDHNFQTTCVCRVPRHLREEKVIECVHCGCNGCASGD

SEQ ID NO: 3405 - protein, 145 aa, Catharanthus roseus
  misc_feature (82)..(82): Xaa can be any naturally occurring amino acid
  misc_feature (104)..(104): Xaa can be any naturally occurring amino acid
MPKVKTNRVKYPEGWELIEPTLRELQAKMREAENDPHDGKRKCETLWPIFKIAHQKSRYVFDLYHRRKEISKELYEFCMDQXYADRNLIAKWKKPGYERLCCLXCMQPRDHNFQTTCVCRVPKHLREEQVIECVHCGCRGCASGD

SEQ ID NO: 3406 - protein, 145 aa, Brassica napus
MPKIKTNRVKYPEGWELIEPTLRELDAKMRQAEMDEHDGKRKCEALWPIFKLSHQRSRYVYDLYYRRDEISKELYEFCLDQGYADRSLIAKWKKSGYERLCCLRCIQPRDHNYGTTCVCRVPKHLREEKVVECVHCGCQGCASGD

SEQ ID NO: 3407 - protein, 145 aa, Cucumis sativus
MPKVKTSKIKYPNGWELIEPTLRELDAKMREAENDPQDGKRKCEALWPIFKISHQRSRYIFDLFYKRSEISRELYEFCLEQGYADANLIAKWKKPGYERLCCLRCIQPRDHNFGTTCVCRVPKHLREEKVVECVHCGCRGCASGD

SEQ ID NO: 3408 - protein, 181 aa, Raphanus sativus
MPKVKTNRVKYPEGWELIEPTLRELDAKMREAEMDTHDGKRKCEALWPIFKLSHQRSRYVYDLYYRRKEISKELYEFCLDQGYADRNLIAKWKKSGYERLCCLRCIQPRDHNYGTTCVCRVPNTCVKRKRLSAFTAVVKDAPVAINLSRLFSSPLSLSWMYFYIFVKSGLCTLTNLPLQNF

SEQ ID NO: 3409 - protein, 143 aa, Brassica juncea
MPKIKTNRVKYPEGWELIEPTLRELDAKMREAEMDEHDGKRKCEALWPIFKLSHQRSRYVYDLYYRREEISKELYEFCLDQGYADRSLIAKWKKSGYERLCCLRCIQPRDHNYGTTCVCRVPKHLREEKVVECVHCGCQGCAS

SEQ ID NO: 3410 - protein, 145 aa, Unknown
  Sequence found in Organisms: Artemisia annua, Lactuca sativa
MPKVKTNRVKYPEGWELIEPTLRELQGKMREAENDPHDGKRKCETLWPIFKIAHQKSRYIFDLYHRRREISKELFEFCLDQGYADRNIIAKWKKPGYERLCCLRCIQPRDHNFQTTCVCRVPKHLREEKVIECVHCGCKGCASGD

SEQ ID NO: 3411 - protein, 145 aa, Cucumis melo
MPKVKTSKIKYPNGWELIEPTLRELDAKMREAENDPQDGKRKCEALWPIFKISHQRSRYIFDLFHKRSEISRELYEFCLEQGYADANLIAKWKKPGYERLCCLRCIQPRDHNFGTTCVCRVPKHLREEKVVECVHCGCRGCASGD

SEQ ID NO: 3412 - protein, 145 aa, Brassica napus
MPKVKTNRVKYPEGWELMEPTLRDLDAKMREAEMDEHDGKRKCEALWPIFKLSHQRSRYVYDLYYRREEISKELYEFCLDQGYADRNLIAKWKKSGYERLCCLRCIQPRDHNYGTTCVCRVPKHLREEKVVECVHCGCQGCASGD

SEQ ID NO: 3413 - protein, 145 aa, Brassica oleracea
MPKIKTNRVKYPEGWELIEPTLRELDAKMRQAEMDEHDGKRKCEALWPIFKLSHQRSRYVYDLYHRRDEISKELYEFCLDQGYADRSLIAKWKKSGYERLCCLRCIQPRDHNYGTTCVCRVPKHLREEKVVECVHCGCQGCASGD

SEQ ID NO: 3414 - protein, 145 aa, Lactuca sativa
MPKVKTNRVKYPEGWELIEPTLLELQAKMREAENDPHDGKRKCETLWPIFKIAHQKSRYVFDLYHRRKEISPELYEFCLDQGYADRNIIAKWKKAGYERLCCLRCIQPRDHNFQTTCVCRVPKHLREEKVIECVHCGCKGCASGD

SEQ ID NO: 3415 - protein, 145 aa, Unknown
  Sequence found in Organisms: Solanum lycopersicum, Capsicum annuum, Solanum tuberosum, Solanum phureja
MPKVKTNRVKYPEGWELIEPTLSELQAKMREAENDPHDGKRKCEALWPIFKIAHQKSRYIFDLFHRRKEISKELYEFCMDQGYADRNLIAKWKKPGYERLCCLRCMQPRDHNFQTTCVCRVPQHLREEKVIECVHCGCKGCASGD

SEQ ID NO: 3416 - protein, 145 aa, Cichorium intybus
MPKVKTNGVKYPEGWELIEPTLRELQGKMREAENDPHDGKRKCETLWPIFKIAHQKSRYIFDLYHRRREISKELYEFCLDQGYADRNIIAKWKKPGYERLCCLRCIQPRDHNFQTTCVCRVPKHLREEKVIECVHCGCKGCASGD

SEQ ID NO: 3417 - protein, 145 aa, Triphysaria pusilla
MPKVKTNRVNYPEGWELIEPTLRDLQAKMREAENDPHDDKRKCEALWPIFKIAHQRSRYVFDLYHRRKEISKELYEFCLDQGYADRNLIAKWKKPGYERLCCLRCMQPRDHNFQTTCVCRVPKHLREEKVVECVHCGCGGCASGD

SEQ ID NO: 3418 - protein, 143 aa, Gerbera hybrid cultivar
KVKTNRVKYPEGWELIEPTLRELQGKMREAENDPHDGKRKCETLWPIFKIAHQKSRYIFDLYHRRKEISVELYEFCLDQGYADRNIIAKWKKPGYERLCCLRCIQPRDHNFQTTCVCRVPKHLREEKVIECVHCGCKGCASGD

SEQ ID NO: 3419 - protein, 145 aa, Unknown
  Sequence found in Organisms: Arabidopsis thaliana, Arabidopsis lyrata
MPKVKTNRVKYPEGWELIEPTLRELDAKMREAETDSHDGKRKCETLWPIFKVSHQRSRYVYDLYYRREEISKELYEFCLDQGYADRSLIAKWKKSGYERLCCLRCIQPRDHNYGTTCVCRVPKHLREEKVVECVHCGCQGCASGD

SEQ ID NO: 3420 - protein, 97 aa, Medicago truncatula
MPKVKTSRVKYPEGWELIEPTLRELQGKMREAENDPHDGKRKCETLWPIFKIAHQKSRYVFELYHKRKEISKELYEFCLDQGYADRNLIDKMEEAWL

SEQ ID NO: 3421 - protein, 783 aa, Oryza sativa
MPKIKTSRVKYPGGWELIEPTIRELDAKMREAENDTHDGKRKCEALWPIFRISHQRSRYIYDLYYRRKEISKELYEFCLDQGYADRNLIAKWKKPGYERLCCLRCIQTRDHNFATTCVCRVPKHLREEKVAELEEQVQAVTAQRRQAERAATEVLGILESHGFGGNLSDVLDSGSEHDGEEDDDPRDGRSDGDTAGSRGEEQPPAQCEAAEDALSGTAEPGGGLSWKGRSTAPEEQRGDVEELAWSQKGQQDGSDCTDDGQADMDGEDTGGQYVIRYEKDGEMERVLERQAELIGQYEAEEEAQRQWEKQFNENRSSAKVHVEAENKACQIENGWEQSKEHARLADQAVHCNEEAKPGVKNHPSASNNRSAGLLLNDSLPESHASGQEAAADQRDAHEEHHDHCHAQSQGSSNVAGTMTGKNQEQGNENPDGCSSYCDIKAPSDGSPSMSDATLNSKVSDWSSSSFHDHGDNQVDAGPDQQPTSNMDIESVLQALQLARISLSQKLSKPVPPSQVTLALPAPGDDEHSEDDGYSPVDDEFTSARDELCSSSQSPEQEILALPAPEDYHDRENLPVNDDATISLTEEQTSSSPHRQEILALPAPVDDYHREIVDDIKIPICIAGLFRLPTDSFPKDETLSTCSICLISLHKPEEDRIIHVLLDSIPLEYSVGEVLHRYIRALVDFICDCKKYQQRPTRRRSRSLRTHHPMPQLPPPPPTCPGAVPVAWSGWGMTLENDPSSVLWWPCRHPPRHPCHCSWSLRTCHPVSRPTPPPPPCPSIASSR

SEQ ID NO: 3422 - protein, 124 aa, Guizotia abyssinica
MPKVKTNRVKYPEGWELVEPTLNELQAKMREAENDPHDGKRKCEALWPIFKIAHQKSRYIFDLYHRRKEISAELYEFYLDQGYADRNLIAKWKKPGYERLCCLRCIQPRDHNFQKHVFVECRNT

SEQ ID NO: 3423 - protein, 117 aa, Cichorium intybus
MREAENDPHDGKRKCETLWPIFKIAHQKSRYVFDLYHRRKEISPELYEFCLDQGYADRNIIAKWKKAGYERLCCLRCIQPRDHNFQTTCVCRVPKHLREEKVIECVHCGCKGCASGD

SEQ ID NO: 3424 - protein, 167 aa, Euphorbia esula
  misc_feature (146)..(147): Xaa can be any naturally occurring amino acid
MPKVKTSRVRYPDGWELIEPTLTELGAKMSEAENDPHDGKRKCEGLWPIFKIAHQRSRYIFDLYYKRKEISRELYEFCLDQGYGDSNLIAKWKKPGYERLCCLRCIQPRDHNFGTTCVCRVPNHLREEKVIECVHCGCKGCASGDXXLLLCLIPLFKVPCLLLSIYY

SEQ ID NO: 3425 - protein, 142 aa, Brassica juncea
MPKIKTNRVKYPEGWELIEPTLRELDAKMREAEMDEHDGKRKCEALWPIFKLSHQRSRYVYDLYYRREEISKELYEFCLDQGYADRSLIAKWKKSGYERLCCLRCIQPRDHNYGTTCVCRVPKHLREEKVFECVHCGCQGCA

SEQ ID NO: 3426 - protein, 145 aa, Solanum melongena
MPKVKTNRIKYPEGWELIEPTLIELDAKMREAGNDSNDGKRKCEALWPIFKIAHQRSRYVYDLYYGRNEISKELYEFCLDQGYADRNLVAKWKKPGYERLCCLHCIQPRDHNFATTCVCRVPKHLREVAVIECVHCGCQGCASGD

SEQ ID NO: 3427 - protein, 145 aa, Podocarpus macrophillus
MPKIRTNRVKYPNGWELIEPTLRELETKMREAENESHEGKRKCETLWPIFKIAHQKSRYIYDLYFRRKEISKELYEFCLDQGYGDRNLIAKWRKPGYERLCCLRCMQPRDHNFATTCVCRVPKHLREEKVIECVHCGCRGCASGD

SEQ ID NO: 3428 - protein, 145 aa, Tragopogon dubius
MPKVKTNRVKYPEGWELIEPTLRELQGKMREAENDPHDGKRKCETLWPIFKIAHQKSRYVFDLYHRRKEISPELYEFCLDQGYADRNIIAKWKKAGYERLCCLRCIQPRDHNYQTTCVCRVPKHLREEKVIECVHCGCKGCASGD

SEQ ID NO: 3429 - protein, 145 aa, Lactuca sativa
MPKVKTNRVKYPEGWELIEPTLLELQAKMREAENDQHDGKRKCETLWPIFKIAHQKSRYIFDLYHRRKEISPELYEFCLDQGYADRNIIAKWKKAGYERLCCLRCIQPRDHNYQTTCVCRVPKHLREEKVIECVHCGCKGCASGD

SEQ ID NO: 3430 - protein, 145 aa, Lotus japonicus
MPKVKTNRVKYPEGWELIEPTLCELQAKMREAENDPHDGKRKCETLWPIFKIAHQKSRYIFDLYHRRNEISKELYEFCLDQGYADRNLIAKWKKPGYERLCCLTCMQPRDHNFATTCVCRVPKQLREEKVIECVHCGCKGCASGN

SEQ ID NO: 3431 - protein, 145 aa, Actinidia deliciosa
MPKVKTNRVKYPEGWELIEPTLRDLQTKMREAENDPHDGKRKCEALWPIFKIAHQKSRYVFDLYHRRREISKELYEFCLEQGYADRNLIAKWKKPGYERLCCLKCIQPRDHNFQTTCVCRVPKHLREEKVIECVHCGCKGCASGD

SEQ ID NO: 3432 - protein, 145 aa, Castanea mollissima
MPKVKTNRIKYPAGWELIEPTLRELDAKMREAELDPHDGKRKCEALWPIFKIAHQKSRYIFDLYHKRTDISKELYEFCLDQGYADRNLIAKWKKPGYERLCCLRCIQPRDHNFATTCVCRVPKHLREEKDVECVHCGCMGCASGD

SEQ ID NO: 3433 - protein, 145 aa, Arachis hypogaea
MPKVKTNRVKYPEGWELIEPTLSELQVKMREAENDPHDGKRKCETLWPIFKIAYQKSRYIFDLYHQRKEISRELYEFCLDQGYADRNLIAKWKKPGYERLCCLRCMQTRDHNFATACVCRVPKQLREEKVIECVHCGCKGCASGD

SEQ ID NO: 3434 - protein, 145 aa, Raphanus sativus
  misc_feature (25)..(25): Xaa can be any naturally occurring amino acid
MPKVKTNRVKYPEGWELIEPTLREXEAKMREAEVDTHDGKRKCEALWPIFKLSHQRSRYVYDLYYRREEISKELYEFCLDQNYADRNLIAKWKKSGYERLCCLRCIQPRDHNYGTTCVCRVPKHLREEKVVECVHCGCQGCASGD

SEQ ID NO: 3435 - protein, 145 aa, Raphanus sativus
MPKVKTNRVKYPEGWELIEPTLRELEAKMREAEVDTHDGKRKCEALWPIFKLSHQRSRYVYDLYYRREEISKELYEFCLDQNYADRNLIAKWKKSGYERLCCLQCIQPRDHNYGTTCVCRVPKHLREEKVVECVHCGCQGCASGD

SEQ ID NO: 3436 - protein, 145 aa, Triphysaria pusilla
MPKVKTNRVNYPEGWELIEPTLRDLQAKMREAENDPHDDKRKCEALWPIFKIAHQRSRYVFDLYHRRKDISKELYEFCLDQGYADRNLIAKWKKPGYERLCCLRCMQPRDHNFQTTCVCRVPKHLREEKVVECVHCGCGGCASGD

SEQ ID NO: 3437 - protein, 145 aa, Quercus alba
MPKVKTNRIKYPAGWELIEPTLRELDAKMREAELDPHDGKRKCEALWPIFKIAHQKSRYVFDLYHKRTDISKELYEFCLDQGYADRNLIAKWKKPGYERLCCLRCIQPRDHNFATTCVCRVPKHLREEKDVECVHCGCMGCASGD

SEQ ID NO: 3438 - protein, 145 aa, Cajanus cajan
MPKVKTNRVTYPEGWELIEPTLRELQAKMREAENDPHDGKRKCETLWPIFKIAHQKSRYIFDIYHQRKEISKELYEFCLDQGYADRNLIAKWKKPGYERLCCLGCMQPRNHNFGTTCVCRVPKQLREEKVIECVHCGCRGCASGD

SEQ ID NO: 3439 - protein, 145 aa, Lactuca sativa
  misc_feature (120)..(120): Xaa can be any naturally occurring amino acid
  misc_feature (126)..(126): Xaa can be any naturally occurring amino acid
MPKVKTNRVKYPEGWELIEPTLRELQGKMREAENDPHDGKRKCETLWPIFKIAHQKSRYIFDLYHRRREISKELFEFCLDQGYADRNIIAKWKKPGYERLCCLRCIQPRDHNFQTTCVCXVPKHLXEEKVIECVHCGCKGCASGD

SEQ ID NO: 3440 - protein, 145 aa, Raphanus sativus
MPKIKTNRVKYPEGWELIEPTLLEIEAKMREAEIDTHDGKRKCEALWPIFKLSHQRSRYVYDLYYRREEISKDLYEFCLDQNYADRNLIAKWKKSGYERLCCLRCIQPRDHNYGTTCVCRVPKHLREEKVVECVHCGCQGCASGD

SEQ ID NO: 3441 - protein, 145 aa, Manihot esculenta
MPKVKTNRIKYPDGWELIEPTLRELDAKMREAENDSHDGKRKCETLWPIFRIAHQRSRYIFDIYYKTNEISKELYEFCLEQGYGDRNLIAKWKKPGYERLCCLRCIQPRDHNFGTTCVCRVPKHLREEKVVECVHCGCKGCASGD

SEQ ID NO: 3442 - protein, 141 aa, Brassica rapa
  misc_feature (20)..(20): Xaa can be any naturally occurring amino acid
KTNRVKYPEGWELIEPTLRXLDAKMREAEMDEHDGKRKCEALWPIFKLSHQRSRYVYDLYYRREEISKELYEFCLDQGYADRNLIAKWKKSGYERLCCLRCIQPRDHNYGTTCVCRVPKHLREEKVVECVHCGCQGCASGD

SEQ ID NO: 3443 - protein, 145 aa, Liriodendron tulipifera
  misc_feature (16)..(16): Xaa can be any naturally occurring amino acid
  misc_feature (28)..(28): Xaa can be any naturally occurring amino acid
  misc_feature (30)..(30): Xaa can be any naturally occurring amino acid
MPKIKTNHVQYPNGWXLIEPTLRELEAXMXEAENDPHDGKRKCEALWPIFRIAHQKSRYIYDLYYRRNEISKELYEFCLDQGYADRNLIAKWKKTGYERLCCLRCMQPQDHNFQTTCVCRVPKHLREEKVIECGHCGCKGCASGD

SEQ ID NO: 3444 - protein, 139 aa, Brassica juncea
KRVKYPEGWELIEPTLRELDAKMREAEMDTHDGKRKCEALWPIFKLSHQRSRYVYDLYYRREEISKELYEFCLDQGYADRNLIAKWKKSGYERLCCLRCIQPRDHNYGTTCVCRVPKHLREEKVVECVHCGCQGCASGD

SEQ ID NO: 3445 - protein, 145 aa, Gnetum gnemon
MPKVRTNRIKYPSGWELIEPTLRDLDNKMREAEQESHEGKRKCESLWPIFKIAHQRSRYIYDLYYRRKDISKELYEFCLDQGYADRNLIAKWRKPGYERLCCLRCMQPRDHNFATTCVCRVPKHLREEKVIECVHCGCKGCASGD

SEQ ID NO: 3446 - protein, 145 aa, Sequoia sempervirens
MPKVRTNRVKYPNGWELIEPTLRDLETKMREAENETHEGKRKCETLWPIFKIAHQKSRYIFDLYYRRKEISKELYEFCLDQGYADRNLIAKWRKSGYERLCCLRCMQPRDHNFATTCVCRVPKHLREEKVIECVHCGCRGCASGD

SEQ ID NO: 3447 - protein, 145 aa, Taxus baccata
MPKVRTNRVKYPNGWELIEPTLRDLETKMREAENETHESKRKCETLWPIFKIAHQKSRYIFDLYYRRKEISKELYEFCLEQGYADRNLIAKWRKPGYERLCCLRCIQPRDHNFATTCVCRVPKHLREEKVIECVHCGCRGCASGD

SEQ ID NO: 3448 - protein, 145 aa, Pinus taeda
MPKVRTNRVKYPNGWELIEPTLRDLETKMREAEQETHEGKRKCETLWPIFRAAHQKSRYVYDLYYRRKEISKELYEFCLDQGYADRNLIAKWRKPGYERLCCLRCMQPRDHNFATTCVCRVPKHLREEKVIECVHCGCRGCASGD

SEQ ID NO: 3449 - protein, 145 aa, Capsicum annuum
MPRVKTSRIKYPEGWELIEPTLAELDAKMREAGNDSNDGKRKCEALWPIFKIAHQRSRYLYDLYYVRSEISKELYEFCLEQGHADRNLIAKWKKPGYERLCCLHCIQPRDHNFATTCACRVPKHLREAAVIECVHCGCQGCASGD

SEQ ID NO: 3450 - protein, 145 aa, Carthamus tinctorius
MPKVKTNRVKYPEGWELIEPTLRELQGKMREAENDPHDGKRKCETMWPIFKIAHQKSRYIFDLYHRREEISNELYEFSLDQGYADRNIIAKWKKPGYERLCCLRCIQPRDHNFQTTCVCRVPKHLREEKVIECVHCGCKGCSRGD

SEQ ID NO: 3451 - protein, 145 aa, Thellungiella halophila
  misc_feature (96)..(96): Xaa can be any naturally occurring amino acid
MPKVKTNRVKYPEGWELIEPTLRELDAQMREAEMDSHDGKRKCETLWPIFKVSHQRSRYVYDLYYRREEISKELYEFCLDQGYADRNLIAKWKKSXYERLCCLRCIQPRDHNYGTTCVCRVPKNLREEKAVECVHCGCQGCASGD

SEQ ID NO: 3452 - protein, 145 aa, Petunia hybrida
MPRVKTNRIKYPEGWELIEPTLLELDAKMREAGNDPHDGKRKCEGLWPIFKIAHQRSRYVYDLYYGRNEISKELYEFCLEQGYADRNLIAKWKKPGYERLCCLHCIQPRDHNFATTCARRVPKHLREAAVIECVHCGCQGCASGD

SEQ ID NO: 3453 - protein, 145 aa, Theobroma cacao
MPKVRTNWVKYPDGWELIEPTLRELDAKMREAEIDPHDGKRKCEGLWPIFKIAHQRSRYIFDLHYKRNEISKELYEFCLEQGYADRNLIAKWKKLGYERLCCLRCIQPRDHNFSTTCVCRVPQHLREEKVVECVHCGCRGCASGD

SEQ ID NO: 3454 - protein, 151 aa, Salvia sclarea
LLDLGCHSKVKTNRVKIPEGWELIEPTLRELQAKMREAENDPHDGKRKCEALWPIFKIAHQKSRYIFDLYHRRKEISKELYEFCLDQGYADRNLIAKWKKPGYERLCCLRCMQPRDHNFQTTCVCRVPKHLREEKVIECVHCGCNGCASGD

SEQ ID NO: 3455 - protein, 145 aa, Glycine max
MPKVKTNRVTYPEGWELIEPTLHELQAKMREAENDPHDGKRNCETLWPIFKIAHQKSRYIFDLYHQRKEISKELYEFCLDQGYADHNLIAKWKKPGYERLCCLGCMQPRNHNFATTCVCRVPKNLREEKVIECVHCGCKGCASGD

SEQ ID NO: 3456 - protein, 145 aa, Mesembryanthemum crystallinum
MPKVRTNRVKYPQGWELIEPTLQELESKMREAQLDSHDGKRKCETLWPIFRIAHQKSRYVFDLYHRRKEISKELYEFCLDQGYADRNLIAKWKKPGYERLCCLRCIQPRDHNFGTTCVCRVPKHLREEKVVECVHCGCKGCASGD

SEQ ID NO: 3457 - protein, 145 aa, Adiantum capillus-veneris
MPKVRTSRVKYPSGWELIEPTLRDLENKMREAETETHEGKRICESLWPIFKISHQKSRYIYDLYYRREAISKELYEFCLDQGYADRNLIAKWKKPGYERLCCLRCIQPRDHNYGTTCVCRVPKHLREEKVIECVHCGCGGCASGD

SEQ ID NO: 3458 - protein, 145 aa, Cryptomeria japonica
MPKVRTNRVKYPNGWELIEPTLRDLETKMREAENETHEGKRKCETLWPIFKIAHQKSRYIFDLYYRRKEISKELYEFCLDQGYADRNLIAKWRKSGYERLCCLRCMQPRDHNFSTTCVCRVPKHLREEKVIECVHCGCRGCASGD

SEQ ID NO: 3459 - protein, 145 aa, Solanum phureja
MPRVKTNRIKYPEGWELIEPTLAELDAKMREAGNDSNDGKRKCEALWPIFKVAHQRSRYVYDLYYGRNEISKELYEFCLEQGYADRNLIAKWKKPGYERLCCLHCIQPRDHNFATTCACRVPKHLREASVIECVHCGCQGCASGD

SEQ ID NO: 3460 - protein, 145 aa, Solanum tuberosum
MPRVKTNRIKYPEGWELIEPTLAELDAKMREAGNDSNDGKRKCEALWPIFKVAHQRSRYVYDLYYGRNEISKELYEFCLEQGYADRNLIAKWKKPGYERLCCLHCIQPRDHNFATTCACRVPKHLREAAVIECVHCGCQGCASGD

SEQ ID NO: 3461 - protein, 145 aa, Pinus taeda
MPKVRTNRVKYPNGWELIEPTLRDLETKMREAEQETHEGKRKCETLWPIFRAAHQKSRYVFDLYYRRKEISKELYEFCLDQGYADRNLIAKWRKSGYERLCCLRCMQPRDHNFATTCVCRVPKHLREEKVIECVHCGCRGCASGD

SEQ ID NO: 3462 - protein, 145 aa, Solanum lycopersicum
MPRVKTNRIKYPEGWELIEPTLAELDVKMREAGNDSNDGKRKCEALWPIFKVAHQRSRYVYDLYYGRNEISKELYEFCLEQGYADRNLIAKWKKPGYERLCCLHCIQPRDHNFATTCACRVPKHLRETAVIECVHCGCQGCASGD

SEQ ID NO: 3463 - protein, 145 aa, Solanum tuberosum
MPRVKTNRIKYPEGWELIEPTLAELDAKMREAGNDSNDGKRKCEALWPIFKVAHQRSRYVYDLYYGRNEISKELYEFCLEQGYADRNLIAKWKKPGYDRLCCLHCIQPRDHNFATTCACRVPKHLREAAVIECVHCGCQGCASGD

SEQ ID NO: 3464 - protein, 142 aa, Actinidia deliciosa
MPKVKTNRIKYPEGWELIEPTLRDLQAKMREAENDPHDGKRKCEALWPILKIAHQKSRYIFDLYHRRKEISKELYEFCLDQGYADRNLIAKWKKPGYERLCCLKCIQPRGHNLQTTCVCGVPKHLREEKVIECVHCGCKGCA

SEQ ID NO: 3465 - protein, 145 aa, Panax ginseng
MPKVRTNRVKVPEGFELIEPTLCELQGKMREAENDTHDGKRKYETLWPIFKIAHQKSRYVFDLYHRRKEISKELYEFCLDQGYADRNLIAKWKKPGYERLCCLRCMQPRDHNFQTTCVCTVPKHLREEKVIECVHCGCGGCASGD

SEQ ID NO: 3466 - protein, 145 aa, Pinus taeda
MPKVRTNRIKYPNGWELIEPTLRDLETKMREAEQETHEGKRKCETLWPIFRAAHQKSRYVFDLYYRRKEISKELYEFCLDQGYADRNLIAKWRKSGYERLCCLRCMQPRDHNFATTCVCRVPKHLREEKVIECVHCGCRGCASGD

SEQ ID NO: 3467 - protein, 145 aa, Marchantia polymorpha
MPKVRTNRTRYPQGWELIEPTLRDLDMKMREAENESHEGKRKCEALWPIFKISHQKTRYIYDLYYRRKAISKELFEFCLDQGYADKSLIAKWKKAGYEKLCCLRCIQPRDHNFNTTCVCRVPKHLREEKVIECVHCGCRGCASGD

SEQ ID NO: 3468 - protein, 145 aa, Citrus sinensis
MPKVRTNRTKYPDGWELIAPTLREMEAKMREAENDPHDGKRKCETLWPIFKIAHQRSQYIFDLYYKRNEISKELYEFCLDQGYGDSNLIAKWKKPGYERLCCLRCIQPRDHNFGTTCVCRVPKHLREEKHVECVHCGCKGCASGD

SEQ ID NO: 3469 - protein, 97 aa, Sciadopitys verticillata
MPKVRTNRIKYPEGWELIEPTLRDLESKMREAENETHEGKRKCETLWPIFKVAHQKSRYLFDLYYRQKEISKELYEFCLDQGYADRNLIAKMEKVWI

SEQ ID NO: 3470 - protein, 145 aa, Pseudotsuga menziesii
MPKVRTNRVKYPNGWELIEPTLRDLETKMREAEQETHEGKRKCETLWPIFKAAHQKSRYVFDLYYRRKEISKELFEFCLDQGYADRNLIAKWRKSGYERLCCLRCMQPRDHNFATTCVCRVPKHLREEKVIECVHCGCRGCASGD

SEQ ID NO: 3471 - protein, 124 aa, Leymus cinereus x Leymus triticoides
MPKIKTSRVEYPEGWMLIEPTIRELDAKMREAENDTHDGKRKCEALWPIFRISHQRSRYIYDLFYRRKEISKELYEFCLDQGYADRNLIAKWKKPGYERLCCLRCIQTRDHNFATTCVCRVPKH

SEQ ID NO: 3472 - protein, 124 aa, Lolium multiflorum
MPKIKTSRVEYPEGWALIEPTIRELDAKMREAENDTHDGKRKCEALWPIFRISHQRSRYIYDLFYRRKEISKELYEFCLDQGYADRNLIAKWKKPGYERLCCLRCIQTRDHNFATTCVCRVPKH

SEQ ID NO: 3473 - protein, 145 aa, Adiantum capillus-veneris
MPKVRRSRLKYPSGWELIEPTLRDLDSKMREAETETHEGKRKCESLWPIFKILHQKSRYLFDLYYRRKAISKELYEFCLEQGYADRNLIAKWKKPGYERLCCLCCIQPRDHNYGTTCVCRVPKHLREEKVIECVHCGCRGCASGD

SEQ ID NO: 3474 - protein, 139 aa, Cleome spinosa
MPKVRTNRVKYPEGWELIEPTLRELDAKMREAETDPHDGKRKCETLWPIFKISHQRSRYLYDLYYRRNEISKELYEFCLDQGYGDRSLIAKWKKSGYERLCCLRCIQPRDHNFGRLAYAEFPNTCEKRKPWNAFTVDVK

SEQ ID NO: 3475 - protein, 145 aa, Ceratodon purpureus
MPKVRTNRTVYPEGWELIEPTLRDLETKMREAENETHEGKRKCEALWPIFKISHQKSRYIYDLFYRRKAISRELFDFCLDQGHADKNLIAKWKKSGYERLCCLRCIQPRDHNYGTTCVCRVPKHLREEKVIECVHCGCHGCASGD

SEQ ID NO: 3476 - protein, 144 aa, Ricinus communis
MPKVRTNRIKYPDGWQLIVPTLRDLDAKMREAENDPHDGKRKCEALWPIFKIAHQRSRYIFDLYKTNQISKELYEFCLEQGYGDHNLIAKWKKPGYERLCCLRCIQPRDHNFGTTCVCRVPKELREEKVVECVHCGCKGCASGD

SEQ ID NO: 3477 - protein, 145 aa, Physcomitrella patens
MPKVRTNRTVYPEGWELIEPTLRELETKMREAENETHEGKRKCEALWPIFKISHQKSRYIYDLFYRRKAISRALFDFCLEQGHADKNLIAKWKKSGYERLCCLRCIQPRDHNFGTTCVCRVPKHLREEKVIECVHCGCHGCASGD

SEQ ID NO: 3478 - protein, 137 aa, Orobanche aegyptiaca
MPKVKTNRVKYPEGWELMEPTLLELQAKMREAENDPHDNRRKCEALWPIFKIAHQRSRYVFDLYHRRKEISKELYDFCLDQGHADRNLIAKWKKPGYERLCCLRCIQPRDHNFQTTCVCRVPKHLREEKVVECVHCG

SEQ ID NO: 3479 - protein, 92 aa, Saccharum officinarum
MKRVIYLLKMYYRRKEISKELYEFCLDQGYADRNLIAKWKKPGYERLCCLRCIQTRDHNFATTCVCRVPKHLREEKVIECIHCGCRGCANGD

SEQ ID NO: 3480 - protein, 149 aa, Mesembryanthemum crystallinum
MPKVRTNRVKYPEGWELIEPTLQELESKMREAQMDSHDGKRKCETLWPIFKIAHQKSRYIFDLYHRRNEISKELYEFCLDQGYADRNLIAKWKKPGYERLCCLRCIQPRDHNFGTTCVCRVPKHSERGEGRRMCSLWMHTLCHAGNDVP

SEQ ID NO: 3481 - protein, 145 aa, Fragaria vesca
MPKVKTNRIKHPEGWELIEPTLHELEAKMKEADNDTHDGKRICETLWPIFKITHQKSRYIFDLYHRRKEIPKELYEFCLDQRHADSKLIAKWKKPGYERLCCLGCMQPGDHNFATTCVCRVPKHLREEKVIECVHCGCKGCASGD

SEQ ID NO: 3482 - protein, 145 aa, Physcomitrella patens
MPKVRTNRTVYPEGWELIEPTLRELETKMREAENETHEGKRKCEALWPIFKISHQKSRYIYDLFYRRKAITRKLFDFCLEQGHADKNLIAKWKKSGYERLCCLRCIQPRDHNYGTTCVCRVPKHLREEKVIECVHCGCHGCASGD

SEQ ID NO: 3483 - protein, 649 aa, Sorghum bicolor
MPRKSHKPRGAAAHAPVGLTAGPRPPLKAAAPNPSPASELPQAGVAEAEGLKAPDAGASAAAEALERLHVGPASDGDPPSLPPSEPVDEASAPPQPPPVEASSSGRSAAGGSWEEEAVRKLHELAEVGGDEVELTEEEVRANDQRQEDEICALEAIFGDAVVILDRKGGQRSFQVLVHIEIPDSIDVSTKLNYGDGTLNYGATCDDDDDLFYKFRVEHLPPILLTCLLPTSYPSHRPPFFTISTYWLDKRMISLLCRMLDMLWEEQQGMEVAYQWVQWLQSSSLSHLGFDNGVILSKSDVTCDADGEDKRACPDNAPPDVIIPRLMRYNDNKHHEAFLHAIHDCMICFSECPGVDFIKLPCHHFFCWKCMQTYCKMNVKEGNVVKLLCPDTKCEGAVPPNVLKRLLEEDEYERWEGLLLQRTLDAMKDVVYCPRCQTACLEDVGNEAVCSSCLFSFCTLCRNRRHVGEQCMSPEERLMILEKRQESGNVQGDQMKILEELRSLKEIMKDSKQCPKCRMAISKTEGCNKMHCGNCGEYFCYQCNRAITGYEHFRGSCVLFPQEELDRWELQMNQRVRRQVVAHAHAEMHGRDGQAHPCPTCRQPSPKIGNNNHLFCWACQKHFCALCHKTVQKPAQHYGPKGCKQHSADP

SEQ ID NO: 3484 - protein, 415 aa, Saccharum officinarum
MASSWALLALVLALSVCASVARGSEPWWNETQQVYATTASSGGSNGVFVGLTLIQSAAAKGAVCLDGSLPGYHLHRGFGSGANSWLVNLEGGGWCNDVSSCVFRKGSRRGSSNHMERQLQFTGIMSNRPEENPDFYNWNRVKVRYCDGGSFTGDGSDAAAGLYFRGQRIWQATMDDLMVQGMRYANQALLSGCSAGGVSTILHCDEFCGLFPSNTRVKCLADAGMFLDTVDVSGRREMRSFFNGIVRLQGSGRSLPRSCTSRMDKTSCFFPQNVLPTIQTPTFVLNTAYDVWQLQQSVAPRTADPQGLWSKCRTNHAFCNSNQLQFLQGFRNQMLDAVRGFSASRQNGLFINSCFAHCQSERQDTWYANNSPRLGNKKIADAVGDWFFERGDAKYTDCPYPCDGTCHHLVFRGDH

SEQ ID NO: 3485 - protein, 415 aa, Saccharum officinarum
  misc_feature (184)..(184): Xaa can be any naturally occurring amino acid
  misc_feature (257)..(257): Xaa can be any naturally occurring amino acid
  misc_feature (322)..(322): Xaa can be any naturally occurring amino acid
MASSWALLALVLALSVCASVARGSEPWWNETQQVYATTASSGGSNGVFVGLTLIQSAAAKGAVCLDGSLPGYHLHRGFGSGANSWLVNLEGGGWCNDVSSCVFRKGSRRGSSNHMERQLQFTGIMSNRPEENPDFYNWNRVKVRYCDGGSFTGDGSDAAAGLYFRGQRIWQAAMDDLMVQGMRXANQALLSGCSAGGVSTILHCDEFCGLFPSNTRVKCLADAGMFLDTVDVSGRREMRSFFNGIVRLQGSGRSLPXSCTSRMDKTSCFFPQNVLPTIQTPTFVLNTAYDVWQLQQSVAPRTADPQGLWSKCRTNHAFCNSXQLQFLQGFRNQMLDAVRGFSASRQNGLFINSCFAHCQSERQDTWYANNSPRLGNKKIADAVGDWFFERGDAKYTDCPYPCDGTCHHLVFRGDH

SEQ ID NO: 3486 - protein, 415 aa, Hordeum vulgare
MAMGSWPLLALLLGFLAGAARGSEPWANDTRVYSTNANSGSGSNGAFVALTLIQSAAAKGAVCLDGSLPGYHLHRGSGSGSNNWLVNLEGGGWCNDVKSCVFRKGSRRGSSNHMERQLQFTGIMSNRPEENPDFYNWNRVKVRYCDGGSFTGDGADAASGLYFRGQRIWQAAMDDLMAQGMRSASQALLSGCSAGGASAILHCDEFNGMFPSNTRVKCLADAGMFLDSVDIAGRREMRELFNGIVRLQGSGRSLPRSCTSRMDKTSCFFPQNVLPNIQTPTFIVNTAYDVWQLQESLAPKTADPQGLWQRCKQNYASCNSNQLQFLNGFRNEMLNAVKGFSASGQNGVFINSCFAHCQSERQDTWYSSNSPRLGNKRIAEAVGDWFFERGNAKYTDCAYPCDGTCHHLVFKGRHL

SEQ ID NO: 3487 - protein, 437 aa, Sorghum bicolor
MFGTPSTTPVFGNPSTTPVFGTPSTTPAFGATSSTPAFGTPSSTPAFGTPSSTPAFGTASTTPAFGASTSAPAFGTASTSSAFGSLNFGTPSSTSAFGTPSSAPAFGALNFGTPSSTSAFGTPSSAPAFGGTPSPSPFGFQQQQATPSPSPFGLLGGGGAQITTQMAPVAPLPLSPSDRDIQAIVDAYKEDPGNPRYAFRHLLFSVTEPSQRVKPVAASDIMWAEAMGKLECMDSADRERLWPQLVQGFKDLSHRLKLQDEVLVSDTDRLSMTHSNVKKLQRHFQADTYPWIQRLKQQELVIQRRLLRFVRIVEALENRGYRSPLTKEEADLYERLVAILKRLKGPSADLSKRVNTLLSTSRLLASTGGAGGSVYIPSSAKVDERSVTELLEALQLQTEAVAKLGNVLKRDIRDLEIIQSEDTDMAEDSVGRRAQKI

SEQ ID NO: 3488 - protein, 416 aa, Panicum virgatum
  misc_feature (13)..(13): Xaa can be any naturally occurring amino acid
  misc_feature (25)..(25): Xaa can be any naturally occurring amino acid
  misc_feature (31)..(33): Xaa can be any naturally occurring amino acid
  misc_feature (40)..(42): Xaa can be any naturally occurring amino acid
  misc_feature (72)..(72): Xaa can be any naturally occurring amino acid
  misc_feature (98)..(98): Xaa can be any naturally occurring amino acid
  misc_feature (130)..(130): Xaa can be any naturally occurring amino acid
MFGTPSSSPLFGXPSSTPAFGTPSXTPAFGXXXSTPAFGXXXSTPAFGTPSSTPAFGTPAFGTPSSTPAFGXPSSTPAFGAASSAPAFGGLSAFGTPXSTSAFGAPSSTPAFGASPSPSPFGFQQQATPXPSPFGLLGGGGGQITTQMAPVAPLPLSPSDRDIQAIVDAYKEDPGNPRYAFRHLLFSVTEPSQRVKPVAASDIMWAEAMGKLECMDTADRERLWPQLVQGFKDLSHRLKLQDEVIVSDTDRLSMTNSNVKKLQRHLQAHTCPWIQRLKQQELVIQRRLLRFVRIVETLENRGYRSPLTKEEADLRERLVAILKQLKGPGADLSKRVNTLLSTSNLLASTGGPVYIPNSAKVDERSVTDLLETLQQQTEAIAKLGNVLKRDIRDLEIIQSNDTDMAEDSVGRRALKI

SEQ ID NO: 3489 - protein, 369 aa, Zea mays
MAAPAPGATRLHPPFLLLPSPPRPHPPLRLRFLLPSPPPLRLRRRFPLLAAAAVSAGGGGGGEEAAGRKADKARQLQKRVLVGVAIGVGAGGIVVAGGWVFAAAVAAAVLAGSREYFELVRSTASGGGTPPPRYVSRACSAICALMPILTLYYGRMDVTVAFSAFVIAIALLLQRGNPRFAQLTSSVFGLFYCGYLPSFWVKLRSGLAAPALNTSIAYRWPILLGGQAHWTVGLVATLMAISSIIAADTSAFLCGRAFGRTPLTNISPKKTLEGALAGLAGCVLTTVLLSTALRWPRSLLSATAYGILIFLGSLFGDLVESLIKRDAGVKDSGSLIPGHGGILDRVDSYVFTGALCYSFVRVALPSYGV

SEQ ID NO: 3490 - protein, 375 aa, Sorghum bicolor
MAAPAPAATRLHAPFLLFPSPPRPHPPLRLRFLLPSPPPVRLRRRFPLLAAAAVSTAAAGGDGGGGEDATASARKAEKARQLQKRVVVGVAIGVGAGGVVVAGGWVFAAAVSAAVLAGSREYFELVRGTAGGGGTPPPRYVSRACSAICAFMPILALYYGRMDVTVTFSAFVIAISLLLQRGNPRFAQLTSSVFGLFYCGYLPSFWVKLRSGLAAPALNTSIAYSWPILLGGQAHWTVGLVATLMAISSIIAADTSAFLCGRAFGRTPLTNISPKKTLEGALAGLAGCVLTTVLLSTVFRWPRSLLSATAYGILIFLGSLFGDLVESLIKRDAGVKDSGSLIPGHGGILDRVDSYVFTGALCYSFVRVALPLYGV

SEQ ID NO: 3491 - protein, 370 aa, Setaria italica
VPTSHGGAGAGAGGHTPPAPVPPTSFPAATPPSSSPPLPPAVPPPAPPLPAPRGRRRLRGRRGRGGSLQEGRQGPATTEAGPRGRRHRGGSWRHRGRRRLGLRAAVAAAVLAGSREYFELVRSTAGVGGTPPPRYVSRVCSAICALMPILTLYYGRMDVTVTFSAFVIAISLLLQRGNPRFAQLTSSVFGLFYCGYLPSFWVKLRSGLAAPALNTFLCYELHTVGQFLAHWTVGLVATLIAISSIIAADTSAFLCGRAFGRTPLTNISPKKTLEGALAGLAGCVLTTVLLSTFLRWPRSLLSATAYGILIFLGSLFGDLVESLIKRDAGVKDSGSLIPGHGGILDRVDSYVFTGALCYSFVRVALPLYGV

SEQ ID NO: 3492 - protein, 397 aa, Zea mays
KSLLISHRTLRLQSCTARAPHPHNFPPPMAAPAPGATRLHPPFLLLPSPPRPHPPLRLRFLLPSPPPLRLRRRFPLLAAAAVSAGGGGGGEEAAGRKADKARQLQKRVLVGVAIGVGAGGIVVAGGWVFAAAVAAAVLAGSREYFELVRSTASGGGTPPPRYVSRACSAICALMPILTLYYGRMDVTVAFSAFVIAIALLLQRGNPRFAQLTSSVFGLFYCGYLPSFWVKLRSGLAAPALNTSIAYRWPILLGGQAHWTVGLVATLMAISSIIAADTSAFLCGRAFGRTPLTNISPKKTLEGALAGLAGCVLTTVLLSTALRWPRSLLSATAYGILIFLGSLFGDLVESLIKRDAGVKDSGSLIPGHGGILDRVDSYVFTGALCYSFVRVALPSYGV

SEQ ID NO: 3493 - protein, 315 aa, Panicum virgatum
AVSAGGGGGEEAARKADKARQLQKRVLVGVAIGVGAGGIVVAGGWVFAAAVSAAVLAGSREYFELVRSTAGGGGTPPPRYVSRVCSAICALMPILTLYYGRMDVTVTFSAFVIAISLLLQRGNPRFAQLTSSVFGLFYCGYLPSFWYKLRSGLAAPALNTRIAYNWPILLGGQAHWTVGLVATLMAISSIIAADTSAFLCGRAFGRTPLTNISPKKTLEGALAGLAGCVLTTVLLSTVLRWPRSLLSATAYGILIFLGSLFGDLVESLIKRDAGVKDSGSLIPGHGGILDRVDSYVFTGALCYSFVRVALPLYGV

SEQ ID NO: 3494 - protein, 370 aa, Pseudoroegneria spicata
MAAAAAAAAVTATRLHPPLVLHSAARPQPPLRLRLRLLLPTPPPLRLHRRFPLLAVASAEEGRAEEAAEKSDKARQLQRRVLVGIAIGVGAGGVVVAGGWVFTAAMTAVVLAGAREYFGLVRGTASGGSTPPPRYVSRVCSAICALMPILTLYYGRMDVPLTLSAFIIAISLVLQRGNPRFAQLTSSVFGLFYCGYLPSFWVKLRCGLAAPALNTSIAHNWPVLLGGQAHWTVGLVATLISITSIIAADTSAFLCGRAFGRTPLTNISPKKTLEGALAGLTGCVLTTVLLSILFRWPRSLLSATAYGILIFLSSLFGDLIESLIKRDAGVKDSGSLIPGHGGILDRVDSYVFTGALCYSFVRVALPLYGV

SEQ ID NO: 3495 - protein, 186 aa, Sorghum bicolor
MKGSSEHGETSKAAPLGRGGVSKGVSVLDLILRFIAIIGTLASAIAMGTTNETLPFFTQFIRFKAQYSDLPTLTFFVVANSIVCAYLILSLPLSIVHIIRSRAKYSRLLLIFLDAAMLALVTAGASAAAAIVYLAHKGNVRANWLAICQQFDSFCERISGSLIGSFGAMVMLILLILLSAIALARR

SEQ ID NO: 3496 - protein, 184 aa, Setaria italica
MKGSSEHGETSKAPLSRGVSKGLSVLDLILRFIAIIGTLASAIAMGTTNETLPFFTQFIRFKAQYSDLPTLTFFVIANSIVCAYLILSLPLSIVHIIRSRAKFSRLLLIFLDAAMLALVTAGASAAAAIVYLAHKGNVRANWLAICQQFDSFCERISGSLIGSFGAMVLLILLILLSAIALARR

SEQ ID NO: 3497 - protein, 184 aa, Panicum virgatum
MKESSEHGETSKAPLSRGVSKGLSVLDLILRFIAIIGTLASAIAMGTTNETLPFFTQFIRFKAQYSDLPTLTFFVVANSIVCAYLILSLPLSIVHIIRSRAKFSRLLLIFLDAAMLALVTAGASAAAAIVYLAHKGNVRANWLAICQQFDSFCERISGSLIGSFGAMVVLILLILLSAIALARR

SEQ ID NO: 3498 - protein, 184 aa, Panicum virgatum
MKESGEHGETSKAPLNRGVSKGLSVLDLILRFIAIIGTLASAIAMGTTNETLPFFTQFIRFKAQYSDLPTLTFFVVANSIVCAYLILSLPLSIVHIIRSRAKFSRLLLIFLDAVMLALVTAGASAAAAIVYLAHKGNVRANWLAICQQFDSFCERISGSLIGSFGAMVVLILLILLSAIALARR

SEQ ID NO: 3499 - protein, 184 aa, Pennisetum glaucum
MKGSSEHGETSKAPLSRGVSKGLSVLDLILRFIAIIGTLASAIAMGTTNETLPFFTQFIQFKAKYSDLPTLTFFVVANSIVCAYLTLSLPLSVVHIIRSRAKFSRLLLIFLDAAMLALVTAGASAAAAIVYLAHKGNARANWLAICQQFDSFCERISGSLIGSFGAMVLLILLILLSAITLARR

SEQ ID NO: 3500 - protein, 107 aa, Pennisetum glaucum
MKGSSEHGETSKAPLSRGVSKGLSVLDLILRFIAIIGTLASAIAMGTTNETLPFFTQFIQFKAKYSDLPTLTFFVVANSIVCAYLTLSLPLSVCTSLGAGPNSAGCS

SEQ ID NO: 3501 - protein, 181 aa, Saccharum officinarum
  misc_feature (136)..(136): Xaa can be any naturally occurring amino acid
  misc_feature (169)..(169): Xaa can be any naturally occurring amino acid
  misc_feature (179)..(179): Xaa can be any naturally occurring amino acid
MKGSSEHGETSKAAPLGRGVSKGVSVLDLILRFIAIIGTLASAIAMGTTNETLPFFTQFIRFKAQYSDLPTLTFFVVANSIVCAYLILSLPLSILHIIRSRAKYSRLLLIFLDAAMLALVTAGASAAAAIVYLAHXGNVRANWLAICQQFDSFCERISGSLIGSFGAMXMLILLILLSXIA

SEQ ID NO: 3502 - protein, 184 aa, Oryza sativa
MEGSEEHGETSKAPLSRGVSKGVSILDVILRFVAIIGTLASAIAMGTTNQTLPFFTQFIRFKAQYSDLPTLTFFVVANSIVSAYLILSLPLSIVHVIRSRAKYSRLILIFFDAAMLALVTAGASAAAAIVYLAHKGNARANWLAICQQFDSFCERISGSLIGSFAAMVVLVLLIFLSAIALARR

SEQ ID NO: 3503 - protein, 624 aa, Saccharum officinarum
  misc_feature (8)..(8): Xaa can be any naturally occurring amino acid
  misc_feature (20)..(20): Xaa can be any naturally occurring amino acid
  misc_feature (51)..(51): Xaa can be any naturally occurring amino acid
  misc_feature (64)..(64): Xaa can be any naturally occurring amino acid
  misc_feature (153)..(153): Xaa can be any naturally occurring amino acid
  misc_feature (355)..(355): Xaa can be any naturally occurring amino acid
  misc_feature (584)..(585): Xaa can be any naturally occurring amino acid
  misc_feature (593)..(593): Xaa can be any naturally occurring amino acid
  misc_feature (603)..(603): Xaa can be any naturally occurring amino acid
MPLFDKKXFSLLEPPKDLDXKEKVFQIRFTKEIFRDYEEYLKRLNLYRQRXWTCKISGKSNLTXEEALVSEHKAMEKAQNLPTELMAHVLRMTQYSTLGLHELINRIYASLLEEVFEGIELYANKDGAVAPCKILKILDSGGTKMCEVGWIRXGKVVTNTSVIKAADLFYRRAPVSRNTLKIFIRDATSQSNPWVIHENLAKIFGISMDPPDSVMKKGRKRQENGTIEDGRKKLKTDEEQAYVMIKYPIDDLLVRPNADDPALFKRPPLATDFRVPRCSVGDLLMVWDFCSSFGRALNLSPFPLTDLENAICHKESNVLLVEIHAAMFHLLMKDEGDYFTVLQNKKRKSKVSSVXWVEYLCDFLEMTKNEELSTNIATVRRGYYGLIDTEIKLKILRELVEEAIQTSAIREILSDRVDQKQVLNATKRENTRKDKQEQNLNTEIAMKKEENQTDAVQGGHEGVDELVRGKENDKSNISRSRTEGKQHLVRHLETEIEKLSIRSSPLGKDRQYNRYWFFKREGRLFVETADSREWGYYSTKEELDALMGSLNVKGIRERALKRQLEKFYSKISNALEKRSKDIAXXMLLEEGVXRRSHVSGLTXRTTRPWHSSSMSTSGRITDVL

SEQ ID NO: 3504 - protein, 622 aa, Zea mays
MPLFDKKPFSLLEPPKDLDSKEKVFQIRFTKEIFRDYEEYLKRLNLYRQRVWTCNISGKSNLTFEEALVSEHKAMEKAQNLPTELMAQVLRMTQYSPLGLYELVDKIYASLLEEVFEGIELHANKDGNVAPCKILKILDSGGTKMCEVGWIRKGKAITNTSVIKAADLFYRRAPVSRNTLKFFIRDATSQSNPWVIHENLAKKFGITIEPPDSVMKKGRKRQENETVEDGRKKLKTDEEHAYVLIKYPIDDLLVRPNADDPSLFKRPLLATDFRVPRCSVGDLLMVWDFCSSFGRALNLSPFPLTDLENAICHKESNVLLVEIHAALFHLLMKDEGDYFTVPQNKKQKLKVSSVTWAEYLCDFLEMTKNEELSTNIATVRRGYYGLIDTNIKLKILRELVEEAIETSAIREILSDRVDQKQVLNATKRENTRKDKKEQNLNTEIAMKNEENQTDAVQGGHEGVDELVRRKEENDKSNISRGRTEVKRHMVQHLETEIEKLSIRSSPLGKDRQYSRYWFFKREGRLFVETADSREWGYYSTKEELDALMDSLNVKGIRERALKRQLEKFYSKISNALEKRSKDIANKTLLEEGVLRRSTRVRAQPKDNPSMAFLKYVNKWRDN

SEQ ID NO: 3505 - protein, 572 aa, Zea mays
MPLFDKKPFSLLEPPKDLDSKEKVFQIRFTKEIFRDYEEYLKRLNLYRQRVWTCNISGKSNLTFEEALVSEHKAMEKAQNLPTELMAQVLRMTQYSPLGLYELVDKIYASLLEEVFEGIELHANKDGNVAPCKILKILDSGGTKMCEVGWIRKGKAITNTSVIKAADLFYRRAPVSRNTLKFFIRDATSQSNPWVIHENLAKKFGITIEPPDSVMKKGRKRQENETVEDGRKKLKTDEEHAYVLIKYPIDDLLVRPNADDPSLFKRPLLATDFRVPRCSVGDLLMVWDFCSSFGRALNLSPFPLTDLENAICHKESNVLLVEIHAALFHLLMKDEGDYFTVPQNKKQKLKVSSVTWAEYLCDFLEMTKNEELSTNIATVRRGYYGLIDTNIKLKILRELVEEAIETSAIREILSDRVDQKQVLNATKRENTRKDKKEQNLNTEIAMKNEENQTDAVQGGHEGVDELVRRKEENDKSNISRGRTEVKRHMVQHLETEIEKLSIRSSPLGKDRQYSRYWFFKREGRLFVETADSREWGYYSTKEELDALMDSLNVKGIRERALKRQLEKFYSKI

SEQ ID NO: 3506 - protein, 319 aa, Setaria italica
PALSKRPPLATDFRVPRGCVGDLLMVWDFCSSFGRVLNLSPFPLTDMENAICHKESNVLLVEIHAAMFHLLIKDKGDYFSVLQHKKRKLKVSLVTWAEYLCDFLEMTKIEELSSNIATVRRGYYGLIDTDMKLKILRELVEEAIKTSAIREILIERVDQKQALNATKRESTRKDKEEQNLNTEIAMNNEENQTDAVQDGNESVEEPARGKEEKDKSNVSRSKTEGKRHLVWHLETEIEKLSIRSSPLGKDRHYNRYWFFRREGRLFVESADSREWGYYSTKEELDALMGSLNVKGIRERALKRQLEKYYNKISNTLEKR

SEQ ID NO: 3507 - protein, 335 aa, Pennisetum glaucum
MGLLLVFGRLLNLSPFPLTDMENAICHKESNVLLVEIHAAMFHLLIKDKGDYFSILQNKKRKLKVSLVTWAEYLCDFLEMTKIEELSSNIATVRRGYYGLIDTDMKLKILRELVEEAIKTTAIREILGERVDQKQALNATKRESTRKDKEEQNLNTEIAMNNEENQTGAVQDGNESVDEPARGKEEKDKSNISRKTEGKRHLVRHLETEIEKLSIRSSPLGKDRHYNRYWFFRREGRLFVESADFREWGYYSTKEELDALMGSLNVKGIRERALKRQLEKYYNKISNTLEKRTKEMVNKMLLEEGVLRRSTRVRAQPKDNPSMAFLKYVNKWKDN

SEQ ID NO: 3508 - protein, 491 aa, Pennisetum glaucum
CKIMKILILMAQRCVKWVGCVGQDLINTSVVKAADLFYRRAPVSRNTLKIFIRDSTTQTTPWVIHENLAKKYGIPMDPPKDLVFKKKGRKRKEDETIEDGRKKMKKEEGDAHVPIKYPIDDLLVRPNADDPALFKRPPLATDFRVPRGSVGDLLMVWDFCSSFGRLLNLSPFPLTDMENAICHKESNVLLVEIHAAMFHLLIKDKGDYFSILQNKKRKLKVSLVTWAEYLCDFLEMTKIEELSSNIATVRRGYYGLIDTDMKLKILRELVEEAIKTTAIREILGERVDQKQALNATKRESTRKDKEEQNLNTEIAMNNEENQTGAVQDGNESVDEPARGKEEKDKSNISRKTEGKRHLVRHLETEIEKLSIRSSPLGKDRHYNRYWFFRREGRLFVESADFREWGYYSTKEELDALMGSLNVKGIRERALKRQLEKYYNKISNTLEKRTKEMVNKMLLEEGVLRRSTRVRAQPKDNPSMAFLKYVNKWKDN

SEQ ID NO: 3509 - protein, 170 aa, Zea mays
MKDEGDYFTVLQNKKRKLKVSSVTWAEYLCDFLEMTKNEERSTNIATVIRGYYGLIDTDIKLKILRELVEEAIQTSAIKEILSDRVDQKQVLNATKRENTRKDKQEKNLNTEIAMKSQENQTDDVQVGHGGVDELVRRKEENDKSNISRSRTEGKRHLVQHLETEIEKLS

SEQ ID NO: 3510 - protein, 242 aa, Zea mays
MAAAAPASSVKEVLPSPLTSASEPPPLFDGTTRLYVAYHCPYAQRAWIARNYKGLQDKIKIVAIDLADRPTWYKEKVYPENKVPSLEHNNQVKGESLDLVKYIDSNFEGPSLLPEDPSKKQFAEELLAYTDAFNKALYFCIVSKEDVSEEAVAALDKIEDALGKFNEGPFSLGQFSLVDIAYVPFIERFQIFYSNIKNYDITKGRPNLQKFIEEVDKIDAYTQTKQDPQFLLEQTKKRLGIA

SEQ ID NO: 3511 - protein, 241 aa, Unknown
  Sequence found in Organisms: Sorghum bicolor, Triticum aestivum
MASGLPVSSKEVLPSPLTSASEPPPLFDGTTKLYVAYYCPFAQRAWIARNYKGLQDKIKIVAIDLADRPAWYKEKVYPENKVPSLEHNNQVKGESLDLVKYIDSNFEGPSLLPEDPAKKQFAEELLAYTDAFNKALYSSLLSKEDVSEETVAALDKIEDALGKFNDGPFFLGQFSLVDIAYVPFIERFQIFYSNIKNYDITKGRPNLQKFIEEVNKIDAYTQTKLDPDFLLEQTKKRLGIA

SEQ ID NO: 3512 - protein, 242 aa, Setaria italica
MAATAPPSSVKEVLPSPLTSASEPPPLFDGTTRLYVAYHCPYAQRAWIARNYKGLQDKIKIVAIDLADRPSWYKEKVYPENKVPSLEHNNQVKGESLDLVKYIDSNFEGPSLLPDDPAKQQFAEELLAYTDAFNKALYSSILSKEDVSEETVAALDKIEEALGKFNDGPFFLGQFSLVDIAYVPFIERFQIFYSNIKNYDITKGRPNLQKFIEEVNKIDAYTQTKQDPQLLLEHTKKRLGIA

SEQ ID NO: 3513 - protein, 242 aa, Panicum virgatum
MAAAAPASSVKEVLPFPLTAASEPPPLFDGTTRLYVAYHCPYAQRAWIARNYKGLHDKIKIVAIDLADRPAWYKEKVYPENKVPSLEHNNQVKGESLDLVKYIDSNFEGPSLLPDDPAKKQFAEELLAFTDAFNKALYSSIISKEDVSEETVAALDKIEEALGKFNDGPFFLGQFSLVDIAYVPFIERFQIFFENIKNYDITKGRPNLQKFIEEVNKIDAYTQTKQDPQFLLEHTKKRLGIA

SEQ ID NO: 3514 - protein, 245 aa, Cenchrus ciliaris
MAAAAPPSSVKEVLPSPLTSTSEPPSLFDGTTRLYVAYHCPFAQRAWIARNYKGLQDKIKIVAIDLADRPSWYKEKVYPENKVPSLEHNNQVKGESLDLVKYIDSNFEGPSLLPDDPAKKQFAEELLAYTDAFNKALYSSILSKEDVSEETVAALDKIEEALGKFNDGPFFLGQFSLVDIAYVPFIERFQIFFSNIKNYDITEGRPNLQKFIEEVNKIDAYTQTKQDPQFLLEHTKKRLGIAQSL

SEQ ID NO: 3515 - protein, 242 aa, Panicum virgatum
MAAAAPASFVKEVLPSPLTSVSEPPPLFDGTTRLYVAYHCPYAQRAWIARNYKGLQDKIKIVAIDLADRPAWYKEKVYPENKVPSLEHNNQVKGESLDLVKYIDSNFEGPSLLPDDPAKKQFAEELLAFTDAFNRALYSSIVSKEDVSEETVAALDKIEEALGKFTDGPFFLGQFSLVDIAYVPFIERFQIFFQNIKNYDITKGRPDLQRFIEEVNKIDAYTQTKQDPQFLLEHTKKRLGIA

SEQ ID NO: 3516 - protein, 244 aa, Oryza sativa
MAAAAAAPASSEKEVLPPSLTSSSEPPPLFDGTTRLYVAYHCPYAQRAWIARNYKGLQDKIKIVAIDLADRPAWYKEKVYPENKVPSLEHNNQVKGESLDLVKYIDTNFEGPALLPDDSEKQQFAEELLAYTDAFNKASYSSIVAKGDVCDEAVAALDKIEAALSKFNDGPFFLGQFSLVDIAYVPFIERFQIFFSGIKNYDITKGRPNLQKFIEEVNKIHAYTETKQDPQFLLEHTKKRLGIA

SEQ ID NO: 3517 - protein, 244 aa, Avena sativa
MAAAAAAPVISPKEDLPPILTSTSEPPPLFDGTTRLYVAYHCPYAQRAWIARNYKGVQDKIKIVAIDLADRPAWYKEKVYPGNKVPSLEHNNQVKGESLDLVKYIDSNFDGPALLPDDSEKKQFAEELLAYTDEFGKAAYSSIISKGDVSEETVAALDKIEAALGKFTDGPFFLGQFSLVDIAYVPFIERFQIFFSGIKNYDITKGRPNIQKFIEEVNKIDAYTQTKLDPQFLLEQTKKRLGIE

SEQ ID NO: 3518 - protein, 69 aa, Eragrostis curvula
IARVTISAKPPHRRMAAARRQAPLRKTPDSPDLRLRAASPFRWHYQVVRGVPLPVRSACLDCQELQGFA

SEQ ID NO: 3519 - protein, 245 aa, Hordeum vulgare
MAAAAAAAPVISPKENLPPSLTSTSEPPPLFDGTTRLYVAYHCPYAQRAWIARNYKGLQDKIKIVAVDLADRPAWYKEKVYPQNKVPSLEHNNQVKGESLDLVKYIDSNFDGPALLPDDSAKKQFSEELLVYTDEFNKALYSSITSKGDVAEETVAALDKIEAALGKFSDGPFFLGQFSLVDIAYVPFIERFQIFFSGIKNYDITKDRPNIQKFIEEVNKIDAYTQTKLDPQFLLQHTKKRLGIE

SEQ ID NO: 3520 - protein, 235 aa, Pseudoroegneria spicata
ISPKENLPPSLTSTSEPPPLFDGTTRLYVAYHCPYAQRAWIARNYKGLQDKIKIVAIDLADRPAWYKEKVYPQNKVPSLEHNNQVKGESLDLVKYIDSNFDGPALLPDDSAKKQFAEELLVYTDEFNKALYSSITSKGDVVEETVAALDKIEAALGKFSDGPFFLGQFSLVDIAYVPFIERFQIFFSGIKNYDMTKDRPNIQKFIEEVNKIDAYTQTKLDPKFLLEHTKKRLGIE

SEQ ID NO: 3521 - protein, 288 aa, Leymus cinereus x Leymus triticoides
EFPPNRRHGRHTGHVSRPSRGAESTAFDSRLNYSNRFSVVFLTWCLFLYSTVRSSPKENLPPSLTSTSEPPPLFDGTTRLYVAYHCPYAQRAWIARNYKGLQDKIKIVAIDLADRPAWYKEKVYPQNKVPSLEHNNQVKGESLDLVKYIDSNFDGPALLPDDSAKKQFAEELLVYTDEFNKVLYSSITSKGDVAEETVAALDKIEAALGKFTDGPFFLGQFSLVDIAYVPFIERFQIFFSGIKNYDITKDRPNIQKFIEEVNKIDAYTQTKLDPQFLLDHTKKRLGIE

SEQ ID NO: 3522 - protein, 244 aa, Brachypodium distachyon
MATAAAPPVIFPKENLPPSLTSTSEPPPLFDGTTRLYVAYHCPYAQRAWITRNCKGLQDKIKIVAIDLADRPVWYKEKVYPENKVPSLEHDNQVKGESLDLVKYIDSNFEGPALLPEDSAKKQSAEELLAYTDEFNKALYSSILSKGDVSEETVAALDKIEAALGKFTDGPFLLGQFSSVDIAYLPFIERFQIFYSGIKNYDITKGRPNFQKYIEEANKIDAYTQTKLEPQFLLDQTKKRLGIE

SEQ ID NO: 3523 - protein, 415 aa, Sorghum bicolor
MTLGAAADDMEAAGGERISGRRARFTEDWCCCACAGLFLGPNPMMARYMYALIFLVTNLLAWTLRDYGDSALAELQRLKVCQGARYCLGAEGVLRVSLGCFLFFFVMFLSTVNTRKVHECRNSWHSEWWPVKLVLWLGLTVVTFLAPSPLVQLYGKVAHFGAGAFLVIQLISVTRFIMWLNDWCRSEISQKRCHLQIQVVSIVTYVGSLLGIVLMYVWYAPSLSCKLNILFITVTLVLVQLMTFVSMSSKVKAGYLAPGLMGIYVVFLCWSAIRSEPHTEVCNKKAEVATSADWVNIASFVIAVIVIVAATFSTGIDSKCLQFKQAEGESEEDDIPYGFGFFHLVFAMGAMYFAMIFVGWNASHTMERWTIDVGWASTWVRIGNEWLAALVYIWMMIAPVIWKTRQVGSSAETET

SEQ ID NO: 3524 - protein, 422 aa, Zea mays
MTLGAGAGAAVADMEAGSSGGSSSDERRGRRVTEDWCCACAEGLFLGPPNPMVARYLYALIFLVTNLLAWTLRDYGSSAIAGLQRLKVCQGARRHCLGAEGVLRVSLGCFVFFVVMFLSTVHTRKLHDCRNSWHSDWWPAKIVLWLALTAVAFLAPSPLVQLYGKVAHFGAGAFLVIQLISVTRFIMWLNDWCRSETTQKRCHLLIQAVSIATYVGSLLGVVLMYVWYAPSPACRLNILFITVTLVLVQLMTFVSTRSKVKAGYLAPGLMGIYVVFLCWSAIRSEPHTEVCNRKAEVATSADWVNIASFVIAVVVIVAATFSTGIDSKCLQFKQAEGESEEDDIPYGLGFFHLVFAMGAMYFAMIFVGWNASHTMERWTIDVGWASTWVRVGNEWLAAVVYIWMMIAPVIWKTRQVGSSAET

SEQ ID NO: 3525 - protein, 396 aa, Panicum virgatum
  misc_feature (36)..(36): Xaa can be any naturally occurring amino acid
  misc_feature (41)..(41): Xaa can be any naturally occurring amino acid
  misc_feature (43)..(43): Xaa can be any naturally occurring amino acid
  misc_feature (392)..(392): Xaa can be any naturally occurring amino acid
RRGAVRLAVRGGLVLRLRGAPRRAQPDDGAVPVRAXLPRHXLXAWTLRDYGNSALDELQRLKVCQGARYCLGAEGVLRVSLGCFLFFFVMFMSTVNTRKVHECRNSWHSEWWPAKVVLWLGLTVVTFLAPSPLVQLYGKVAHFGAGAFLVIQLISVTRFIMWLNDCCQSEVTRKRCHLQIQAVSIVTYVGSLLGIVLMYVWYAPSPACKLNILFITVTLVLVLLMTFVSMSSKVKAGYLAPGLMGIYVVFLCWSAIRSEPHTEICNKKAEVATSADWVNIASFVIAVIVIVAATFSTGIDSKCLQFKKAEGESEEDDIPYGFGFFHLVFAMGAMYFAMIFVGWNAHQTMEKWTIDVGWASTWVRIGNEWLAAIVYIWMMIAPIIWKTRQVGXSAET

SEQ ID NO: 3526 - protein, 613 aa, Sorghum bicolor
MQHDHRKKSSVEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEQALAHPYFKGLAKVEREPSCQPITKIEFEFERRRVTKEDIRELIFREILEYHPQLLKDYINGTERTTFLYPSAVDQFRKQFAHLEENSGNGPVIPMERKHTSLPRSTIVHSAPIPVKEQPRIGPSRERPSSDESYRNPRETEKYSGNLPRTSQAPQRVPTARPGRVVGPVMPYQNGDTKDPYDTRRLAMNSGYPPQQQIPQTFGYYQTHGKPACSEPSQAERYTLHQQAYACANRTAASDVALDMRAPPFHHLSAGQKGDSSDRLTAETNLYTRSLNGIAATAAGVAATTHRKVGVVPFGMSSMY

SEQ ID NO: 3527 - protein, 613 aa, Saccharum officinarum
MQHDQRKKSSVEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEEALAHPYFKGLAKVEREPSCQPITKMEFEFERRRVTKEDIRELIFREILEYHPQLLKDYINGTERTTFLYPSAVDQFRKQFAHLEENSGNGPVIPMERKHTSLPRSTIVHSAPIPVKEQPRIGPSRERPSSDESYRNPWETEKYSGNLPRTSQAPQRVPTARPGRVVGPVMPYQNGDTKDPYDTRRLAMNSGYPPQQQIPQTFGYYQTHGKPACSEPSQAERYTLHQQAYACANRTAVSDVALDMRAPPFHHLSAGQKGDSSDRLTAETNLYTRSLNGIAATAAGVAATTHRKVGVVPFGMSSMY

SEQ ID NO: 3528 - protein, 613 aa, Saccharum officinarum
  misc_feature (459)..(459): Xaa can be any naturally occurring amino acid
MQHDQRKKSSVEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEEALAHPYFKGLAKVEREPSCQPITKMEFEFERRRVTKEDIRELIFREILEYHPQLLKDYINGTERTTFLYPSAVDQFRKQFAHLEENSGNGPVIPMERKHTSLPRSTIVHSAPIPVKEQPRIGPSRERPSSDESYRNPWETEKYSGNLPRXSQAPQRVPTARPGRVVGPVMPYQNGDTKDPYDTRRLAMNSGYPPQQQIPQTFGYYQTHGKPACSEPSQAERYTLHQQAYACANRTAVSDVALDMRAPPFHHLSAGQKGDSSDRLTAETNLYTRSLNGIAATAAGVAATTHRKVGVVPFGMSSMY

SEQ ID NO: 3529 - protein, 609 aa, Panicum virgatum
MQHDQRKKSSAEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFYSKYTTAIDVWSIGCIFAEVLTGKPLFPGKNVVHQLDLMTDLLGTPSMDTISRVRNEKARRYLSSMRKKDPIPFSQKFPNADPLALDLLQRLLAFDPKDRPTAEQALAHPYFKGLAKVEREPSCQPITKMEFEFERRRVTKEDIRELIFREILEYHPQLLKDYINGTERTTFLYPSAVDQFRKQFAHLEENSGSGPVIPMERKHTSLPRSTIVHSAPIPVKEQPRIGPSREKHSSDESYKNPRETEKYSGNVPRTSQAPQRVPTARPGRVVGPVMPYENGNTKDPYDARRLAMNSGYPPQQHIPQTYGYYQAPGKPACSEPSQAERYTLHQQAYSTTVSDVALDMRAPPFHHLSAGPKSDSSDRLTAETNLYSRSVNGIAATAAGVAASAHRKVGVVPFGMSRMY

SEQ ID NO: 3530 - protein, 611 aa, Oryza sativa
MQQDQRKKSSTEADFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNDKARRYLSSMRKKEPILFSQKFPSADPLALDLLQKLLAFDPKDRPTAEEALAHPYFKGLAKVEREPSCQPITKMEFEFERRRVTKEDIRELIFREILEYHPQLLKDYINGTERTTFLYPSAVDQFRKQFAHLEENGGNGPVIPMDRKHTSLPRSTIVHSTPIPAKEQPRIGPSRDKPSDEPYSNPREFDRFSGNAPRTSQAPQRVPTARPGRVVGPVLPYENGATKDSYDARRLAMNSGYPPQQQIPQAYGYYQIPGKSACSELSQAERYTLHQQAYTCANSATVTDVALDMRAPPFHLSGGPKSDSSERLAAETNLYTRSLNGLAATAAGVAASAHRKVGVVPYGMSRMY

SEQ ID NO: 3531 - protein, 594 aa, Pennisetum glaucum
DASRYKIQEVIGKGSYGVVCSAIDVHTGEKVAIKKIHDIFEHISDAARILREIKLLRLLRHPDIVEIKHIMLPPSRRVFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKEPIPFSQKFPSADPLALDLLQRLLAFDPKDRPTAEQALAHPYFKGLAKVEREPSCQPITKMEFEFERRRVTKEDIRELIFREILEYHPQLLKDYINGTERTTFLYPSAVDQFRKQFAHLEENSGNGPVIPMERKHTSLPRSTIVHSAPIPVKEQPRVGPSREKSSSDESYKNSRETEKYYSGNVLRTSQAPQRVPTARPGRVVGPVMPYENGNTKDHYDARRLAMNSGYPPQQQIPQTYGYYQPPGKLACSEPLQAERYTLHQQAYACADSTTVSDVALDMRAPPFHHLSAGPKSDSSDRLTADTSLYTRSLNGIAATTAGVAASAHRKVGVVPFGMSRMY

SEQ ID NO: 3532 - protein, 615 aa, Brachypodium distachyon
MQQDQRKKSSAEAEFFTEYGDASRYKIQEIVGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKEPIPFSQKFPNADPLALDLLQRLLAFDPKDRPTAGEALSHPYFKGLAKVEREPSCQPITKMEFEFERRRATKEDIRELIFREILEYHPQLLKDYINGTERTTFLYPSAVDQFRKQFAHLEENSESGPVVPMDRKHTSLPRSTIVHSAPIHAKEQPRIGPSRDRPLTDESYKNPRDSEKYSGNVPRSSHHSQAPQRVPTARPGRVVGPVLPYENVGTSHPYDPRRVAMNSGYPPQQQIPQTYGYYQTTGKSACSEPSQAERYTLHQQAYACANSSTAPDVALDMRAPPFHQSAGPKSGSSDRLTAETNLYTRSLNGIVATTSGVAASAHRKVSVVPYGMSQMY

SEQ ID NO: 3533 - protein, 613 aa, Triticum aestivum
MQQDQRKKSSAEAEFFTEYGDASRYKIQEIVGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKELISFSHKFPNADPLALDLLQRLLAFDPKDRPTAEEALSHPYFKGLAKVEREPSCQPITKMEFEFERRRVTKEDIRELIFREILEYHPQLLKDYTNGTERTTFLYPSAVDQFRKQFAHLEENSENGPVVPMDRKHTSLPRSTIVHSAPIHGKEQPRIGPSRDKPSPDESYKNHRDSEKYSGNVQRTSQAPQRVPTARPGRVVGPVLPYENGGMKDTYDPRRVAAMSSGYPPQQQIPQIYGYYQTPAKSACSEPSQAEMYTLHQQAYACANSSTVPDVALDMRAPPFHQSAGPKRGSSDRLSAESNLYSRSLNGMAPTTTGVAASAHRKVGVVPYGMSQMY

SEQ ID NO: 3534 - protein, 613 aa, Triticum aestivum
MQQDQRKNSSAEAEFFTEYGDASRYKIQEIVGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKELISFSHKFPNADPLALDLLQRLLAFDPKDRPTAEEALSHPYFKGLAKVEREPSCQPITKMEFEFERRRVTKEDIRELIFREILEYHPQLLKDYTNGTERTTFLYPSAVDQFRKQFAHLEENSENGPVVPMDRKHTSLPRSTIVHSAPIHGKEQPRIGPSRDKPSPDESYKNHRDSEKYSGNVQRTSQAPQRVPTARPGRVVGPVLPYENGGMKDTYDPRRVAAMNSGYPPQQQIPQIYGYYQTPAKSACSEPSQAEMYTLHQQAYACANSSTVPDVALDMRAPPFHQSAGPKRGSSDRLSAESNLYSRSLNGIAPTTTGVAASAHRKVGVVPYGMSQMY

SEQ ID NO: 3535 - protein, 613 aa, Hordeum vulgare
MQQDQRKKSSAEAEFFTEYGDASRYKIQEIVGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLTSMRKKEPISFSHKFPNADPLALDLLQRLLAFDPKDRPTAEEALSHPYFKGLAKVEREPSCQPITKMEFEFERRRVTKEDIRELIFREILEYHPQLLKDYTNGTERTTFLYPSAVDQFRKQFAHLEENTENGPVVPMDRKHTSLPRSTIVHSAPIHAKEQPRIGPSRDKPSPDESYKNPRDSEKYSGNVQRTSLAPQRVPTARPGRVVGPVLPYENGGMKDTYDPRRVAAAMNSGYAPQQQIPQIYGYYQTPKSACSEPSQAEMYTLHQQAYACANSSTVPDVALDMRAPPFHQSAVPKRGSSDRLSAESNLYSRSLNGMAPTTSGVAASGHRKVGVVPYGVSQMY

SEQ ID NO: 3536 - protein, 578 aa, Festuca arundinacea
MQQDQRKKSSAEAEFFTEYGDASRYKIQEIVGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKEPIPFSHKFPNADPLALDLLQRLLAFDPKDRPTAEESLSHPYFKGLAKIEREPSCQPITKKEFEFERRRVTKDDIRELIFREILEYHPQLLKDYTNGTERTTFLYPSAVDQFRKQFAHLEENTENGPVVPMDRKHTSLPRSTIVHSAPIHGKEQPHIGPSRDKPLSEESYRNSRDSEIYSGNVQRTSQAPQRVPTARPGRVVGPVQPYENGGINDPYDPRRVVMNSGYPPQQQIPQTYGYYQTPAKSVCSEPLQAERYTLHQQAYACANSSTVPDVALDMRAPPFHQSSGPKRGSSDRLSAETNL

SEQ ID NO: 3537 - protein, 233 aa, Zea mays
MEAAAISGTASASSSTSRRGRSISRLPARVAGAVIRGLVTFVFAAVGMVLGAVTGALIGLATESGLVRGAGIGSISGAVVSMEVVDSSVAIWRSDESGIWSVLYVLDVLWSLLTGRLVREKVDPAVQSAVDSQMNTADSQDMAPTLADMFETGAADAKGMPAAAVAALPIMAFTEHTVADASGEPIGCSVCLQDFEAGETARSLPECGHTFHLPCIDVWLLRHASCPLCRRAV

SEQ ID NO: 3538 - protein, 222 aa, Zea mays
ASSSTSRRGRSISRLPARVAGAVIRGLVTFVFAAVGMVLGAVTGALIGLATESGLVRGAGIGSISGAVVSMEVVDSSVAIWRSDESGIWSVLYVLDVLWSLLTGRLVREKVDPAVQSAVDSQMNTADSQDMAPTLADMFETGAADAKGMPAAAVAALPIMAFTEHTVADASGEPIGCSVCLQDFEAGETARSLPECGHTFHLPCIDVWLLRHASCPLCRRAV

SEQ ID NO: 3539 - protein, 237 aa, Zea mays
MEAAAVSGTGTASASSSPAPSSGSRGGRSVCRLPARVAGAVVRGLLTFVFAAVGMVLGAVTGALIGLATESGLVRGAGVGAISGAVVSMEVVDSSVAIWRSDESGIWSVLYVLDVLWSLVTGRLVREKVDPAVQSAVDSQMNAADSQDTAPTLADMFETAAAGMPAAAIAALPVTAVTESTVTDASGEPIGCPICLQDFEAGETARRLPECGHTFHLPCIDVWLLRHASCPLCRRAV

SEQ ID NO: 3540 - protein, 249 aa, Sorghum bicolor
MEAAAIFGTASASFSPAPSSSRSRGGGGGTSISRLPARVAGAVVRSLVTFVFAAVGMVLGAVTGALIGLATESGLVRGAGIGAISGAVVSMEVVDSSVAIWRSDESGIWSVLYVLDVLWSLLTGRLVREKVDPAVQSAVDSQMNAADSGDMDMAATLADMFDTGAGAGAGAPPKGMPAAAIAALPVTAFTEDTVTDASGEPIGCSVCLQDFEAGETARSLPECGHTFHPPCIDVWLLRHASCPLCRRAV

SEQ ID NO: 3541 - protein, 120 aa, Saccharum officinarum
MAMVASTSFAYHKPRFAVVCRKNKDGRDRERERDGKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 3542 - protein, 118 aa, Setaria italica
MAMVASTSFAYKPRFAVVCRKNKDGRDREREKEKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 3543 - protein, 120 aa, Sorghum bicolor
MAMVASTSFTYHKPRLAVVCRKNKDGRDRERERDGKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 3544 - protein, 122 aa, Pennisetum glaucum
MAMVASTSFTYHKPRFAVVCRKNRDGGRDREREREKEKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 3545 - protein, 115 aa, Panicum virgatum
MAMVASTSFTYHKPRLAVVCRKNKDGRDKEKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 3546 - protein, 119 aa, Avena sativa
MAMVASTSIAYHKPRLAVVCRKKDRPDRELEREKKEHKYPFKVVEITPPPRCLGVRCFPTNIHCGESVTIEGQAYTVSAVTHRYQLRKGRYEPSEKRLDVLSTGRYILNLYLDNLLDKS

SEQ ID NO: 3547 - protein, 117 aa, Triticum aestivum
MAMVASTSIAYHKPRLSVVCRKKDRDRELEREKEHKHPFKVVEITPPPRCLGVRCFPTNIHCGESVTIEGQAYTVSAVTHRYQLRKGRYEPSEKRLDVLSTGRYILNLYLDSLLDKS

SEQ ID NO: 3548 - protein, 117 aa, Triticum aestivum
MAMVASTSIAYHKPRLSVVCRKKDRDRELEREKEHKYPFKVVEITPPPRCLGVRCFPTNIHCGESVTIEGQAYTVSAVTHRYQLRKGRYEPSEKRLDVLSTGRYILNLYLDNLLDKS

SEQ ID NO: 3549 - protein, 117 aa, Hordeum vulgare
MAMVASTSIAYHKPRLSVLCRKKDRDRELEREKEHKHPFKVVEITPPPRCLGVRCFPTNIHCGESVTIEGQAYTVSAVTHRYQLRKGRYEPSEKRLDVLSTGRYILNLYLDSLLDKS

SEQ ID NO: 3550 - protein, 119 aa, Brachypodium distachyon
MAMVASTSIAYHKPRLAVVCRKKDRGDRGELEREKEHKHPFKVVEITPPPRCLGVRCFPTNIHCGESVTIEGQAYTVSAVTHRYQLRKGRYEPSEKRLDVLSTGRYILNLYLDSLLHKS

SEQ ID NO: 3551 - protein, 117 aa, Triticum aestivum
MAMVASTSIAYHKPRLSVVCRKKDRDRELEREKEHKYPFKVVEITPPPRCLGVRCFPMNIHCGESVTIEGQAYTVSAVTHRYQLRKGRYEPSEKRLDVLSTGRYILNLYLDSLLDKS

SEQ ID NO: 3552 - protein, 125 aa, Oryza sativa
MAAMVASTATSFSYHKPRFAVECRKKDRDRDRDRERPEREKEHKYPFKVVEITPPPRCLGVRCFPTNIHCGESVTIEGQAYTVSAVTHRYQLRKGRYEPSEKRLDVLSTGRYLLNLYLDGLLDKS

SEQ ID NO: 3553 - protein, 119 aa, Festuca arundinacea
  misc_feature (83)..(83): Xaa can be any naturally occurring amino acid
  misc_feature (112)..(113): Xaa can be any naturally occurring amino acid
MAMVASTSIVYHKPRLTVVCRKKDRPDRELEREKKDHKYPFKVVEITPPPRCLGVRCFPTNIHCGESVTIEGQAYTVSAVTHXYQLRKGRYEPSEKRLDVLSTGRYILNLYXXSLLDKS

SEQ ID NO: 3554 - protein, 438 aa, Saccharum officinarum
MEPAAAAKTVERLAQRLVPPAEPTPTGPHRLSWLDRYPTQMALIESLHVFKPDPARDGVSPAATIERALARALVDYYPLAGRLAVSEDAGGLHVDCSAEGVWFIEAAVRCRLEDVDYLEYPLQIPKDDLLPHPLPRPSHEEESKHILLVQVTAFACGGFVVGFRFSHAVADGLGAAKFMGAVGELARGAEQVSVSPVWARDAIPDPPGALVGRLPDPTGAKRLEYLAIDISADYIDHFKSQFAAATGGGRCSAFEVLIAKAWQSRTRAAGFEDPANTPVQLCFAMNARPLLGATRLPRGGAGFYGNCYYIMRVSSTADRVASSSVTDVVKIVREGKKRLPSEFARWAAGEEGAGGVDPYQITSDYRTLLVSDWTRLGFAEVDYGWGPPAHVVPLTNLDYIATCILVKPWAHKPGARLITQCVTPDRVSRFHDAMVDMN

SEQ ID NO: 3555 - protein, 430 aa, Zea mays
MEPAAAVERLAQRLVPPAEPTPTGPHGLSWLDRYPTQMALIESLHVFKPDPARDGASPSETIERALARALVDYYPLAGRLAVSEGAGGLHVDCSAEGVWFIEAAVRCRLEDVDYLEYPLQIPKDDLLPHPLPRPTHQEESKLILLVQVTAFECGGFVVGFRFSHAVADGLGAAKFMGAVGELARGADRVSVAPTWARDAIPDPAGALVGSLPEPTGAKRLEYLAVDISADYIDHFKSQFAAATGGGRCSAFEVLIAKAWQSRTRAAGFEDPDTPVQLCFAMNARPLLGARLPRGGAGFYGNCYYIMRVASTADKVSSSSVADVVKVIREGKKRLPSEFARWAAGEEDADPYQITSDYRTLLVSDWTRLGFAEVDYGWGPPAHVVPLTNLDYIATCILVKPWAHKPGARLITQCVTPDRVSRFHDAMVDMN

SEQ ID NO: 3556 - protein, 441 aa, Sorghum bicolor
MEPAAKTVERLAQRLVPPAEPTPTGPHRLSWLDRYPTQMALIESLHVFKPDPARDGVSPAATIERALARALVDYYPLAGRLAVSAGGQLHVDCSAEGVWFIEAAVRCRLDDVDYLEYPLQIPKDDLLPHPLPRPSHDEESKLILLVQVTAFACGGFVVGFRFSHAVADGLGAAKFMAAVGELARGAEQVSVPPVWARDAIPDPPGALVGSLPDPTGAKRLEYLAIDISADYIDHFKSQFAAATGGGRCSSFEVLIAKAWQSRTRAAGFDDPASTPVQLCFAMNARPLLLAGGSGGTRSPRGGGGGAGFYGNCYYIMRVSSTADRVASSSVTDVVRIIREGKKRLPSELARWAAGEDGGVDPYQITSDYRTLLVSDWTRLGFAEVDYGWGPPAHVVPLTNLDYIATCILVKPWAHKPGARLITQCVTPDRVERFHDAMVDMN

SEQ ID NO: 3557 - protein, 431 aa, Panicum virgatum
MEPAAKTVERLAQRLVPPAEPTPTGPHRLSWLDRYPTQMALIESLHVFKPDPARDGVSPAETIQRALARALVDYYPLAGRLAVSDAAGGLHVDCNGEGVWFVEAAVRCRLEDVDYLEYPLQIPKDDLLPHPLPRPTREEENKLILLVQVTTFGCGGFVVGFRFSHAVADGLGAAKFMGAVGELARGADQISPPPTWGRDAIPDPAGAHVGSLPELDGAKRLEYLAIDISADYIDHFKSQFAAASGGGRCSAFEVLIAKAWQSRTRAAAFDADTPVHLCFAVNARPLLAARLPRAGVGFYGNCYYIMRVSSTAGKVSTSSVTDVVRIIREGKKRLPSEFARWAAGEEAGDPYQITSDYRTLLVSDWTRLGFAEVDYGWGPPAHVVPLTNLDCIATCILVKPWAHKPGARLITQCVTPDRVAAFHDALVDMNC

SEQ ID NO: 3558 - protein, 434 aa, Brachypodium distachyon
MAAAAAAKPVPVERLAQRLVAPAGPTPEGPLRLSWLDRYPTQMALIESLHVFKPDMAREGDSPARAVERALARALVDYYPLAGRLAVSDAGELQVDCRDGGVWFIEAAVRCRLEDVDYLEYPLAVDKDELLPHPRPKPTHEEESKLILLVQVTTFDCGGFVVGFRFSHAVADGPGAAQFMGAVGELARGAGRISVPPAWGRDAIPDPAGALVGRLPEPAGAKRLEYLAIDISADYINHFKAQFAAATGGARCSAFEVLIAKAWQSRTRAAGFDEESPVHLSFAMNARPLLHARLPSGGAGFYGNCYYIMRVSSTAGKVASSSMADVVKIIKEGKKRLPSEFARWAAGEMAGVDPYQITSDYRTLLVSDWTRLGFAEVDYGWGPPAHVVPLTNLDYIATCILVKPWAHKPGARLITQCVTPDRVAAFHDAMVDTN

SEQ ID NO: 3559 - protein, 435 aa, Avena sativa
MAAVAAKPVPVPVERLAQRLVAPAGPTPEGPLRLSWLDRYPTQMALIESLHVFKPDMARADDSPARAVEQALARALVDYYPLAGRLAVSDAGELQVDCSDAGVWFIEAAVRCRLEDVDYLEYPLAVDKDELIPHPRPKPSLEEESKLILLVQVTTFDCGGFVVGFRFSHAVADGPGAAQFMGAVGELARGADRISVAPAWGRDAIPDPAGALVGGLPEPVGAKRLEYLAIDISADYINHFKGQFAAATGGARCSAFEVLIAKAWQSRTRAAGFDEDSPVHLSFAMNARPLLHARLPNAGAGFYGNCYYIMRVSSTAGKVASSTITDVVKIIKEGKKRLPSEFARWAAGEMAGFDPYQITSDYRTLLVSDWTRLGFAEVDYGWGPPAHVVPLTNLDYIATCILVKPWVHKPGARLITQCVTPDRVAAFHDAMVDTN

SEQ ID NO: 3560 - protein, 433 aa, Hordeum vulgare
MAAAAAKPVPVERLGQRLVAPAAPTPESHLRLSWLDRYPTQMALIESLHVFKPDMARQGDSPARAVEQALARALVEYYPLAGRLTVTDTGELQVDCSDGGVWFIEAAVRCRLEDVDYLEYPLVVDKDELLPHPRPKPSREEESKLILLVQVTTFDCGGFGVGFRLNHAVADGPGAAQFMGAEGELARGASRISVAPVWGRDAIPDPAGALVGSLPDPAGAKRLEYLAIDISADYINHFKGQFAAATGGARCSAFEVLIAKAWQSRTRAACFDEGSPVHLCFAMNARPLLQARLPSGGAGFYGNCYYIMRVSSTAGKVASSTITDVVKMIKEGKKRLPSEFARWGAGEMGSVDPYQITSDYRTLLVSDWTRLGFAEVDYGWGPPAHVVPLTNLDYIATCILVKPWVHKPGARLITQCVTPDRVAAFHDALVDTN

SEQ ID NO: 3561 - protein, 439 aa, Oryza sativa
MAAAAPDKAVERLSQKLVHPSSPTPSAPLRLSWLDRYPTQMALIESLHVFKPDPARDAAGQGLAPARAIETALARALVEYYPLAGRLAVSRDSGELQVDCCGGAGGHGGVWFIEAAVPCRLEDVDYLEYPLAISKDELLPHPRPRPTRDEEDKLILLVQVTTFACGGFVVGFRFSHAVADGPGAAQFMGAVGELARGGERITVAPSWGRDAVPDPAGAMVGALPEPAGASRLEYLAIDISADYINHFKSQFAAATGGARCSAFEVLIAKAWQSRTRAAAFDPSTPINLSFAMNARPLLLPRGGAGFYGNCYYIMRVASTAGRVATASVTDVVRMIREGKKRLPSEFARWAAGEMAGVDPYQITSDYRTLLVSDWTRLGFAEVDYGWGPPGHVVPLTNLDYIATCILVKPWAHKPGARLITQCVTPDRVTAFHDAMVDIN

SEQ ID NO: 3562 - protein, 109 aa, Zea mays
MAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3563 - protein, 208 aa, Zea mays
MDKVLLDTFVDYYNKGDGCQNGWKSHVYTAAVKNVCEKCNVTITKENISSRSKTFDKHYNIINGLLSTSGFGWDWEKNKLKVDSDTVWDEYVERNKEAKGYRHKVVKFWDLLSLVYNNGQANGESAKTAAESSKEMAKENDTGGKDAPYSVSSSSSLKRQRSDDSFNSIWCDKFDMLTSALKDDGPKLPSSAEVLAALQEVEGLDEDT

SEQ ID NO: 3564 - protein, 116 aa, Zea mays
DKKTRGYVPWNDEMVKVLLDTFVDYYNKGDRCQNGWKSHVYTAAVKNVCEKCNVTITKENISSRSKTFDKHYNIINGLLSTSGFGWDWEKNKLKVDSDTVWDEYVERNKEAKGYRL

SEQ ID NO: 3565 - protein, 109 aa, Zea mays
MAKENDTRGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3566 - protein, 208 aa, Zea mays
MDKVLLDTFVDYYNKGDRCQNGWKSHVYTTAVKNVCGKCNVTIIKENISSRSKTFDKHYNIVNGLLSTSGFGWDWEKNKLKVDSDTICDEYVERNKEAKGYRHKIVKFWDLLSLVYNKDQANGEGAKITAESSKEMAKENDTGGKDAPYSVSSSSSLKRQRSDDSFNSMWCDKFDMLTSALKDDGPKLPSSAKVLAALQEVEGLDEDT

SEQ ID NO: 3567 - protein, 244 aa, Zea mays
MDKVLLDTFVDYYNKGDRCQNGWKSHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3568 - protein, 108 aa, Zea mays
MDKVLLDKFVDYYNKSDRCQNGWKSHVYTAIVKNVCEKCNVTITKENISSRSKTFDKHYDIINGLLSTSGFGWDWEKNKLKVDSDTVWDEYVERNKEAKGYRHKVVKF

SEQ ID NO: 3569 - protein, 244 aa, Zea mays
MDKVLLDTFVDYYNKGDRCQNGWKFHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3570 - protein, 244 aa, Zea mays
MDKVLLDTFVDYYNKGDRCQNGWKSHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDPFNSIWCDKFDMLTSALKDDGPKLPSSAEVLAALQEVEGLDEDTELELYDILTSNARKFESMMALPMERRKRWLMMQLRK

SEQ ID NO: 3571 - protein, 170 aa, Zea mays
LLDKVLLDTFVDYYNKGDRCQNGWKSHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSI

SEQ ID NO: 3572 - protein, 244 aa, Zea mays
MDKVLLDTFVDYYNKGDRCQNGWKSHVYTAVVKNVCEKCNVTITKENISSRSKTFDKHYNIINGLLSTSGFGWDWEKNKLKVDSDTVWDEYIERNKEAKGYRHKVVKFWDLLSLVYNKDQANGEGAKTAAESSKEMAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3573 - protein, 244 aa, Zea mays
MDKVLLDTFVDYYNKGDRCQNGWKSHVYTAAVKNVCEKCNVTITKENNSSRSKTFDKHYNIINGLLSTSGFGWDWEKNKLKVDSDTVWDEYVERNKEAKGYRHKVVKFWGLLSLVYNKDQANGEGAKTAAESSKEMAKENNTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 3574 - protein, 173 aa, Zea mays
NKKTRGYVPWNDEMDKVLLDTFVYYYNKGDRCHNGWKSHVYTTAMKNVCEKCNVTITKENISSRSKTFHKHYNIINGLLSTSGFGWDWEKNKLKVDSDTVWDEYRNKEAKGYRHKVVKFWDLLSLVYNKDQANGEGAKTATESSKEMVKENDTGGKDAPYCVSSSSSLRTKIR

SEQ ID NO: 3575 - protein, 244 aa, Zea mays
MDKVLLDTFVDYYNKGDRCQNGWKSYVYTTAVKNVCEKCNVTITKENISSRSKTFDKHYNIINGLLSTSGFRWDWEKNKLKVDSDTVWDEYVERNKEAKGYRHKVVKFWDLLSLVYNKDQANGEGAKTAAESSKEMAKENNTGGKDAPYSVSSWSSLKRQRSDDSFNSIWCDKFDMLTSALKDDGPRLPSSAEVLAALQEVEGLDEDTELELYDILTSNARKFESMMALPMERRKRWLMMQLRK

SEQ ID NO: 3576 - protein, 166 aa, Zea mays
MLKVDSDTIWDEYVERNKELKGYKHKVVKFWNLLSLVYNKNQANGEGAKTTGESSKEMTKENDTGDKDAPYSISSWSSLKRQRLDDSFNSMWCEKFDMFKSALKDDGPKLPSSAEVLAALQEVEGLDEDTELELYDILTSNARKFESMVALPMERRKRWLMMQLRK

SEQ ID NO: 3577 - protein, 244 aa, Zea mays
MDKVLLDTFVDYYNKGDICQNGWKSHVYTTAVKNVCEKCNVTITKENISPRIKTFDKHYNIIDGLLSTSGFGWDWEKNKLKVDSDIVCDEYVEKNEEAKGYRHKVVKFWDLLSLVYNKDQANGEGAKTAAGSLKEMAKENDTGGKDAPYSVSSSSSLKRQRSDDSFNSMWCDKFDMLTSALKDDGPKLPSSAEVLTALQEVEGLDEDTKLELYDILTSNARKFESMMALPMERRKRWLMMQLRK

SEQ ID NO: 3578 - protein, 240 aa, Zea mays
MDKVLLDTFVDYYNKGDSCQNGWKSHVYIAAVKNVCEKCNVTITKENISSRSKTFDKHYNIINGLVSTSGFGWDWEKNKLKVYSDTIWDEYVERNKEAKGYRHKVVKFWDLLSLVYNKDQANGEGAKIAAKSSKEMAKDNDTVCKDASYSVSSSSSLKRQRSDDSFNSMWCDKFDMLTSALKDDGPKLPSSVEVLTALQEVEGLDEDTELELYDILTSNARKFESMMALPMERRKRWIMM

SEQ ID NO: 3579 - protein, 225 aa, Zea mays
MATSDKKTRGYVPWNDEMDKVLLDTFVDYYNKSDRCQNGWKSHVYTVAVKNVCEKCNVTITKENISSRSKNFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSIWCDKFDMLTSALKDDGPKLPSSAEVLAALQEVEGLDEDT

SEQ ID NO: 3580 - protein, 98 aa, Zea mays
FLYVWFFDCRDKKTRGYVPWNDEMDKVLLDTFVDYYKGKILALAARPLISTTISLMVCCPLVVLDGIGRRTSSKLIVTLYGMSMLRGIRKQKDIDIRL

SEQ ID NO: 3581 - protein, 225 aa, Zea mays
MATSDKKTRGYVPWNDEMDKVLLDTFVDYYNKSDRCQNGWKSHVYTVAVKNVCEKCNVTITKENISSRSKNFDKHYNIINGLLSTSGFGWDWEKNKLKVDSDTVWDEYVERNKEAKGYRHKVVKFWVLLSLVYNKDQANGEGAKTAVESSKEMAKENDTGDKDAPYSVSSSSSLKRQRSDDSFNSIWCDKFDMLTSALKDDGPKLPSSAEVLAALQEVEGLDEDT

SEQ ID NO: 3582 - protein, 221 aa, Zea mays
DKKTRGYVPWNDEMDKVLLDTFVDYYNKSDRCQNGWKSHVYTVAVKNVCEKCNVTITKENISSRSKNFDKHYNIINGLLSTSGFGWDWEKNKLKVDSDTVWDEYVERNKEAKGYRHKVVKFWVLLSLVYNKDQANGEGAKTAVESSKEMAKENDTGDKDAPYSVSSSSSLKRQRSDDSFNSIWCDKFDMLTSALKDDGPKLPSSAEVLAALQEVEGLDEDT

SEQ ID NO: 3583 - protein, 300 aa, Sorghum bicolor
MGMGPFNDAVSAVESAAAAAAAAAGAAAGAAVVSAVAAEVVPSAGGGSYAVLQCGEDSEYVRQKYSGYFTVFRALLEEDGESWRVYRAVRGELPTDAEAAAFDGFVISGSCADAHADDPWILDLVGLIRRLHAAGKRFLGVCFGHQILCRALGGRTGRSTKGWDIGVSCIHPTAAAARLFAPLKLPVHMPVIEFHQDEVWDLPANAEVLARSDKTRVEMFRLGDRVMGVQGHPEYSKDILMSIADRLLRHNQILDCQVDVAKASFDVRQPDKELWKKVCRAFLKGRLPSQQQQQQQAVAL

SEQ ID NO: 3584 - protein, 148 aa, Saccharum officinarum
MAATAYSVALLGGARLPAAPRSALLPRRSVCQLRLQDAPRLSLLRAKAASEDTSASGDELIEDLKAKWDAVEDKPTVLLYGGGAIVALWLTSVVVGAINAVPLLPKILELVGLGYTGWFVYRYLLFKESRKELAADIETLKKKIAGTE

SEQ ID NO: 3585 - protein, 148 aa, Sorghum bicolor
MAATAYSVALLGGARLPAAPRSALLPRRSVCQLRLQDAPRLSLLRAKAASEDTSASGDELIEDLKAKWDAIEDKPTVLLYGGGAIVALWLTSVVVGAINAVPLLPKILELVGLGYTGWFVYRYLLFKESRKELAADIETLKKKIAGTE

SEQ ID NO: 3586 - protein, 149 aa, Setaria italica
MAATAYSVALLGGARLPAVPRGSALLPRRTACQLRLQDAPRLSLLRVKAASEDTSASGDELIEDLKAKWDAVEDKPTVLLYGGGAVVALWLTSVVVGAINAVPLLPKILELVGLGYTGWFVYRYLLFKESRKELATDIETLKKKIAGTE

SEQ ID NO: 3587 - protein, 148 aa, Pennisetum glaucum
MAATAYSVALLGGARLPAAPRGSALLPRRTVCQLRLDAPRLSLLRVKAASEDTSASGDELIEDLKAKWDAIEDKPTVLLYGGGAVVALWLTSVVVGAINAVPLLPKILELVGLGYTGWFVYRYLLFKESRKELATDIETLKKKIAGTE

SEQ ID NO: 3588 - protein, 148 aa, Panicum virgatum
MAATAYSVALLGGARLPAAPRSAALPRRSACQLRLQDAPRLSLLRVKAASEDTSASADELIEDLKAKWDAVEDKPTVLLYGGGAIVALWLTSVVVGAINAVPLLPKIMELVGLGYTGWFVYRYLLFKESRKELASDIETLKKKITGTE

SEQ ID NO: 3589 - protein, 150 aa, Panicum virgatum
MAATAYSVALLGGARLPAAPRSALLPRRSACQLRLQQDAPRLSLLRVKAASEDTSSASADELIEDLKAKWDAVEDKPTVLLYGGGAIVALWLTSVVVGAINAVPLLPKIMELVGLGYTGWFVYRYLLFKESRKDLASDIETLKKKITGTE

SEQ ID NO: 3590 - protein, 150 aa, Panicum virgatum
MAATAYSVALLGGARLPAAPRSALLPRRSACQLSLQQDAPRLSLLRVKAASEDTSSASADELIEDLKAKWDAVEDKPTVLLYGGGAIVALWLTSVVIGAINAVPLLPKIMELVGLGYTGWFVYRYLLFKESRKELASDIETLKKKITGTE

SEQ ID NO: 3591 - protein, 149 aa, Cynodon dactylon
MAATAYSVALLGGARLPAVPHSGLLPRRSSVCPLRVQAAPRLSLLRVKAASEDTSASGDELIEELKAKWDAIEDKPTVLLYGGGAIVALWLTSVVVGAINSVPLLPKILELVGLGYTGWFVYRYLLFKESRKELATDIESLKKKITGTE

SEQ ID NO: 3592 - protein, 150 aa, Eragrostis curvula
  misc_feature (8)..(8): Xaa can be any naturally occurring amino acid
  misc_feature (13)..(13): Xaa can be any naturally occurring amino acid
  misc_feature (40)..(40): Xaa can be any naturally occurring amino acid
MAATAYSXALLGXARLPAVPRSGLLPRRSSVCTLRLQDAXRLSLLRTKAASSEDSSASADELIEDLKAKWDAIEDKPTVLLYGGGAIVALWLTSVVVGAINSVPLLPKILELVGLGYTGWFVYRYLLFKESRKELATDIESLKKKIAGTE

SEQ ID NO: 3593 - protein, 150 aa, Zea mays
MAATAYSVALLGGARLPAAFLPRRSSVCHHQLRLQDAPRLISLHRARAASEDTSASGGDELIEDLKAKWDAVEDKPTVLLYGGGAVVALWLTSVVVGAINAVPLLPKILELVGLGYTGWFVYRYLLFKQSRKELVDDIETLKKKIAGTAE

SEQ ID NO: 3594 - protein, 154 aa, Brachypodium distachyon
MATTAYSVALHGGARLPTAGAGAPRSPSALLPRRAFHPLRLQDAPRTSLLRVKAASEDTSASGDELIEDLKAKWEAVEDKPTFLLYGGGAVVALWLTTVVVGAINSVPLLPKLLELVGLGYTGWFVYRYLLFKESRKELASDIETLKKKIAGTE

SEQ ID NO: 3595 - protein, 148 aa, Zea mays
MAATAYSVALLGGAPAGRLPPSTRSVCHQQLRLQDAPRLSLHRARAASEDTSASGGDELIEDLKAKWDAVEDKPTVLLYGGGAVVALWLTSVVVGAINAVPLLPKILELVGLGYTGWFVYRYLLFKQSRKELVDDIETLKKKIAGTAE

SEQ ID NO: 3596 - protein, 154 aa, Leymus cinereus x Leymus triticoides
  misc_feature (83)..(83): Xaa can be any naturally occurring amino acid
MAATAYSVALLGGARLPGPTGNAAPRSSALLPRRNLHPLRLQDAPRPSLLRVKAASEDTSASGDEIIEDLKGKWEAIEDKPTXLLYSGGAVVALWLTTVVVGAINSVPLLPKLLELVGLGYTGWFVYRYLLFKESRKELATDIESLKKKIAGTE

SEQ ID NO: 3597 - protein, 154 aa, Unknown
  Sequence found in Organisms: Setaria italica, Triticum aestivum
MAATAYSVALLGGARLPAATGNAAPRSSALLPRRNFHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3598 - protein, 154 aa, Triticum aestivum
MAATAYSVALLGGARLPAATGNLAPRSSALLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3599 - protein, 154 aa, Pseudoroegneria spicata
MAATAYSVALLGGARLPAATGNAAPRSSALLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3600 - protein, 156 aa, Oryza sativa
MAAATAYTVALLGATGARVPAAPRSAALLPRRGGVLQPLRLQDAPRLSLLRVRAASDDTSTSASGDELVADLKAKWEAIEDKPTFLLYSGGAVVALWLTTVVVGAINSVPLLPKILELVGLGYTGWFVYRYLLFKESRKELATDIETLKKKIAGTE

SEQ ID NO: 3601 - protein, 155 aa, Avena sativa
MAATAYSVALLGGARLPAATGAPRSASASALLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIEGLKKKIAGTE

SEQ ID NO: 3602 - protein, 145 aa, Triticum aestivum
MAATAYSVALLGGARLPAATGNAAPRSSALLPRRNFHPLRLQDAPRPSLLRVKAASDDTSASGDEIIEDLKGKWEAIEDKPTFLLYSGGAVVALWLTTVVVGAINSVPLLPKLLELVGLGYTGWFVYRYSSSRKAGKSWPPTSRA

SEQ ID NO: 3603 - protein, 154 aa, Triticum aestivum
MAATAYSVALLGGARLPAATGNAAPRSSAFLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3604 - protein, 154 aa, Festuca arundinacea
MAATAYSAALLGGARLPATTGAPRFSSSALLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3605 - protein, 154 aa, Hordeum vulgare
MAATAYSVALLGGARLPAATSNAAPRSSALLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESFKKKIAGTE

SEQ ID NO: 3606 - protein, 154 aa, Lolium multiflorum
MAATAYSVALLGGARLPATTGATRFTSSALLPRRNLQPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 3607 - protein, 178 aa, Triticum aestivum
MAATAYSVALLGGARLPAATGNAAPRSSAFLPRRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKEAGKSWHRHRKLEEEDCRNRINSSSLERFRWLFCLSMEWKKHLLA

SEQ ID NO: 3608 - protein, 134 aa, Secale cereale
  misc_feature (37)..(37): Xaa can be any naturally occurring amino acid
MAATAYSVALLGGARLPAATGNAAPRSSALLPRRNLXPLRLQDAPRPSLLRVKAASDDTSRAATRSSRTSRGSGRRLRTSPPSSSTAAARRGSLAHHRRRRRHQLRAVAPQAPGAGWAGLHRVVRVPLPPLQGK

SEQ ID NO: 3609 - protein, 157 aa, Zea mays
MAATAYSTALPGGARLPAAGAAAPPSALLLPRRNKLSPLPLRLQDAPRLSLLRVKASSDDSSAASGDELIADLKAKWDAVENKSTVLTYAGGAVVALWLTSVIVGAINSVPLLPKIMELVGLGYTGWFVYRYLLFKESRKELADDIESLKKKIAGTE

SEQ ID NO: 3610 - protein, 426 aa, Brachypodium distachyon
MADAAPTVSKSPPALVPPVGPTPRGALPLSSIDKTAAVRVSVDFIQVFPPSTDGASAGDQVAAMRDGFARALVPYYPVAGRIAEPTPGDLVVDCTGEGVWFVEAAASCSLADVNGLERPLLIPKGELIPRPPPEEKLEDLILMAQVTKFTCGGFAVGICFSHLVFDGQGAAQFLKAAGELARGLPAPSVAPVWDRDAIPDPPKLPRGPPPSFTAFNFVTQVVEISPENIARIKEDFKAATGGETCSTFDAVTAVVFKCRALAVELPDTAEVRLGFAASTRHLLQGVLPSVDGYYGNCVYPVGITRSSKTIREAALTEVVGVMREAKEALTVRFTDWMRGGAKDDHYNVPLDYGTVTVSDWSRVGFNEVDYGFGEPGYVFTLNDDVNIVASVIYLKPPTPKRGIRLMLRCVEEPHAAVFADEIAKYA

SEQ ID NO: 3611 - protein, 220 aa, Sorghum bicolor
MSAAAAAPTVLKSAPELVAPAEPTPGGTLPLSSIDKTAAVRVSVDFIQVFPPAAGAGGDQDAAVAAMRDGFAKALVPYYPVAGRIADASPGEPVVDCTGQGVWFVEAAASCALADVNYLERPLLIPKEELLPRPPPEEKLEDLVLMAQVTKFTCGGFSVGICFSHLVFDGQGAAQFLKAAGEMARGLPAPSVAPVWDRDAIPDRPKLPRGPRRRSRRSTP

SEQ ID NO: 3612 - protein, 428 aa, Zea mays
MSTVAAAPTVVKSAPELVAPVGPTPGGTLPLSSIDKTAAVRVSVDFIQVFPPAVGAGGDKDAAVAAMRDGFAKALVPYYPVAGRIADASPGEPVVECTGQGVWFVEAAASCALADVNYLERPLLIPKEELLPRPPPEEKLEDLVLMAQVTKFACGGFAVGICFSHLVFDGQGAAQFLKAAGEMARGLPAPSVAPVWDRDAIPDPPKLPRGPPPSFTAFSFVTQVVEISPESIARIKDDFKDATGQTCSTFDAVTAVVFKCRALAMALPDDAEVRLGFAASTRHLLHGVLPSVDGYYGNCVYPVGITRTSKAIREASLPEVVGVMREAKEALTTRFTDWMRGGAKDDHYNVPLDYGTVTVSDWSRVGFNEVDYGFGEPGYVFTLNDDVNIVASVIYLKPPAPKRGIRLMLRCVEEPHAAAFAEELAKFA

SEQ ID NO: 3613 - protein, 425 aa, Saccharum officinarum
MSAAAHPVKSAPELVAPAGPTPGGTLPLSSIDKTAAVRVSVDFIQVFPPAAAAGGDQDAALAAMRDGFARALVPYYPVAGRIADASPGEPVVNCTGQGIWFVEAAASCALTDVNYLERPLLIPKEELLPRPPPEEKLEDLVLMAQVTKFTCGGFAVGICFSHLVFDGQGAAQFLKAAGEMARGLPAPSIAPVWDRDAIPDPPKLPRGPPPSFTAFSFVTQVVEISPESIARIKDEFKGATGQTCSTFDAVTAVVFKCRALAMALPDDAEVRLGFAASTRHLLHGVLPSVDGYYGNCVYPVGITRTSKAIREASLPEVVGVMREAKEALTARFTDWMRGGAKDDHYNVPLDYGTVTVSDWSRVGFNEVDYGFGEPGYVFTLNDDVNIVASVIYLKPPAPKRGIRLMLRCVEEPHAAAFADELAKFA

SEQ ID NO: 3614 - protein, 426 aa, Avena sativa
MAAAAAPAVVKSPPALVPPAGPTPGGVLPLSSIDKTAAVRVSVDFIQVFPPSSSDGAAGDQVAAMRDGFARALVPYYPVAGRIAEPSPGDLVVDCTGDGVWFVEAAASCSLAVVNGLERPLLIPKAELIPRPPPEEKLEDLILMAQVTKFTCGGFAVGICFSHLVFDGQGAAQFLKAAGELARGLPAPSVAPVWDREAIPDPPKLPRGPPPSFTAFNFVTQVVEISPENIARIKDEFKAATGGQTCSTFDAVTAVVFKCRALAVELPDDAEVRLGFAASTRHLLQGVLPSVDGYYGNCVYPVGITRSSKTIREAALPEVVSVMREAKVALTVRFTDWMHGGAADHYNVPLDYGTVTVSDWSRVGFNEVDYGFGEPGYVFTLNDDVNIVASVIYLKPPTPKRGIRLMLRCVEEPHAAVFADELAKYA

SEQ ID NO: 3615 - protein, 422 aa, Triticum aestivum
MAAPTVAKSPPELVPPAGPTPGGVLPLSSIDKTAAVRVSVDFIQVFPPSSDRGGDDQVASMRQGFARALVPYYPVAGRIAEPSPGDLVVDCTGEGVWFVEATASCSLADVNGLERPLLIPKAELIPRPPPEEKLEDLILMAQVTKFTCGGFAVGICFSHLVFDGQGAAQFLQAAGELARGFPAPSVAPVWDRETIPDPPKLPRGPPPSFTAFSFVTQVVEISPESILRIKDEFKAATGETCSTFDAVTAVVFKCRALAVELPDAAEVRLGFAASTRHLLQGVLPSVDGYYGNCVYPVGITRSSKTIREAALPEVVGVMREAKEALKVRFTDWMHGGAKDDHYNVPLDYGTVTVSDWSRVGFNEVDYGFGEPGYVFTLNDDVNIVASVIYLKPPAPKRGIRLMLRCVEEPHAAVFADELAKYA

SEQ ID NO: 3616 - protein, 62 aa, Unknown
  Sequence found in Organisms: Sorghum bicolor, Saccharum officinarum
MASLKASKPAGVAAQGKEPAPKLSETATKPSAAKSGGVKKAEQKPRETKKKVKSSKPAAAKK

SEQ ID NO: 3617 - protein, 61 aa, Panicum virgatum
MASMKAVKVAGAAAQAKEPAPKLSETATKPSAAKSGVKKAEQKPREPKKKVKSSKPAAAKK

SEQ ID NO: 3618 - protein, 61 aa, Panicum virgatum
MASTKAVKVAGAAAQAKEPAPKLSETATKPSAAKSGVKKAEQKPREPKKKVKSSKPAAAKK

SEQ ID NO: 3619 - protein, 98 aa, Zostera marina
MASMKAVKVAGAAAQAKEPAPKLSETATKPSAAKSGVKKAEQKPGAEEEGEEQQAGGSQKVTMEAKRSTGACARGPPIMLLQIQSLLFCLNDVMNLCP

SEQ ID NO: 3620 - protein, 88 aa, Eragrostis curvula
MASLKAVKPAGQAGQAKEPAPQLSRRRQSRLLQRVASRKLSRSPGSQRRRLRAASQQQQRSDDSSKINGVSMLCILVQSFPSFVFHSM

SEQ ID NO: 3621 - protein, 61 aa, Panicum virgatum
MASTKAAKVAGAAAQAKEPAPKLSETVTKPSAAKSGVKKAEQKPREPKKKVKSSKPAAAKK

SEQ ID NO: 3622 - protein, 417 aa, Brachypodium distachyon
MGYVLSAVARVLQQPTAWGAACEMALLAGPLWAAALVGLLLGWAWRPRWAAGIVATADPPQFATAEFWRGQLPARLRAPLDYFAGGTAATAAAQQEEEETSLQGSSEMANEELAVGKDDLVKLWRLVEGNDGGPSWIKMMEKALPDMTYQAWRRDPQNGPPQYQSSTIFENATPEEVRDFFGDDEFRMSNKWDDMLISHKTLEECQTTGMMKVHWVRKFPFFCSDREYIIARRIWKLGSAYYCVTKGVQCSSIPRRSKPRRVDLYYSSWCIRAVESRRGNGGSTACEILLFHHEDMGIPYEIAKIGIRQGMWGCVKRIEPGLRAYQEARAAGEPPSPSALMARINTKVGDNFVRALESNSNQSDIVEAEEKPVKNRVARFLVLGGAVALACTLDQGLLTKALIFGVARKFVGQRNAL

SEQ ID NO: 3623 - protein, 417 aa, Pseudoroegneria spicata
MGYVLSAVARVLEQPTAWGAACEMALLAGPLWAAALVGLLLGWAWRPRWAAGIVAPADPPQVATLDFWRAQLPTRIRAPLDYLAGARQQQQRQEQEDDETSLQGSSEMANEELAVGKADLVNLWRLVEGNDGGPAWINMMEKALPNMTYQAWRRDPQNGPPQYQSSTIFENATPDEVRDFFGDDEFRMSNKWDDMLISHQTLEECQTTGTMKVHWVRKFPFFCSDREYIIARRIWKLGSAYYCVTKGVPCSSIPRRSKPRRVDLYYSSWCIRAVESRRGNGGSTACEILLFHHEDMGIPYEIAKIGIRQGMWGCVKRIEPGFRAYQKARAAGEPPSPSALMARINTKVGDNFVRGLESNSDQSDIMEAEEKPVKNRMARFLVLGGAVALACTLDQGLLTKALIFGVARRFVGQRNTL

SEQ ID NO: 3624 - protein, 413 aa, Hordeum vulgare
MGYVLSAVARVLEQPTAWGAACEMALLAGPLWAAALVGLLLGWAWRPRWAAGIVAPADPPQLASLDFWRAQLPARIRAPLDYLAGARQQQEDDDEASLHGSSEMGKEELAVGKDDLVNLWRLVEGNDGGPAWIKMMEKALPNMTYQAWRRDPQNGPPQYQSSTIFENATPDEVRDFFGDDEFRMSNKWDDMLISHQTLEECQTTGTMKVHWVRKFPFFCSDREYIIARRIWKLGSAYYCVTKGVPCSSIPRRSKPRRVDSYYSSWCIRAVESRRGNGGSSACEILLFHHEDMGIPNEIAKIGIRQGMWGCVKRIEPGLRAYQKARAAGEPPSPSALMARINTKVGDNFVRGLESNSDQSDIMEAEEKPVKNRMARFLVLGGAVALACTLDQGLLTKALIFGVARKFVGQRNAL

SEQ ID NO: 3625 - protein, 416 aa, Leymus cinereus x Leymus triticoides
  misc_feature (10)..(10): Xaa can be any naturally occurring amino acid
  misc_feature (51)..(51): Xaa can be any naturally occurring amino acid
  misc_feature (106)..(106): Xaa can be any naturally occurring amino acid
  misc_feature (230)..(230): Xaa can be any naturally occurring amino acid
  misc_feature (238)..(238): Xaa can be any naturally occurring amino acid
MGYVLSAVAXVLEQPTAWGAVCEMALLAGPLWAAALVGLLLGWAWRPRWAXGIVATADPPQFASLDFWRGQLPACIRTPLDYLAGARQQQRQEQEEDETSLQGSSXMAKEELAVGKDDLVNLWRLVEGNDGGPAWIKMMEKALPNMTYQAWRRDPQNGPPQYQSRTIFENATPDEVRDFFGDDEFRMSNKWDDMLISHQTLEECQTTGTMKVHWVRKFPFFCSDREYIIXRRIWKLGXAYYCVTKGVPCSSIPRRSKPRRVDLYYSSWCIRAVESRRGNGGSTACEILLFHHEDMGIPYEIAKIGIRQGMWGCVKRIEPGLRAYQKARAAGEPPSQSALMARINTKVGDNFVRGLESNSDQSDIMEAEEKPVKNRMARFLVLGGAVALACTLDQGLLTKALIFGVARKFVGQRNTL

SEQ ID NO: 3626 - protein, 425 aa, Sorghum bicolor
MGYVLSAVARVLEQPTAWGAAWEMALLAGPLWAAALLGLLLGWAWRPRWAAGLVVATADGGSAAAAAQALAQPPFATLDFWKAQLPARLRAPLGYAGAAVQQREEDEDAVQGSSEGANEELAVGKDDLVNLWRLVEGRDGGPAWIKMMEKSLPTMTYQAWRRDTQTGPPQYQSSSIFENATPEEVRDFFGDDEFRMSNKWDDMLIYHKTLEECQTTGTMKVHWVRKFPFFCSDREYIIARRIWKLGGAYYCVTKGIPCSSVPRRNKPRRVDLYYSSWCIRAVESKRGNGGLTACEVLLFHHEDMGIPYEIAKLGIRQGMWGCVKKIEPGLRAYQEARAAGEPASRSALMARINTKVGDNFVRSLESNSDESEIVEAEEKPARNHVARFLVLGGAVALACTLDQGLLTKALIFGVARKFVGQRKTL

SEQ ID NO: 3627 - protein, 425 aa, Saccharum officinarum
MGYVLSAVARVLQQPTAWGAAWEMALLAGPLWAAALLGLLLGWAWRPRWAAGLVVATADGGSAAAAAQAPAQPPFATLDFWKAQLPARLRAPLGYAGAAVQQREDDEDAVQGSSEMANEELAVGKDDLVNLWRLVEGRDGGPAWIKMMEKSLPTMTYQAWRRDAQTGPPQYQSSSIFENATPEEVRDFFGDDEFRMSNKWDDMLIYHKTLEECQTTGTMKVQWVRKFPFFCSDREYIIARRIWKLGGAYYCVTKGIPCSSIPRRNKPRRVDLYYSSWCIRAVESKRGNGGLTACEVLLFHHEDMGIPYEIAKLGIRQGMWGCVKKIEPGLRAYQEARAAGVPASRSALMARINTKVGDNFVRSLESNSDESEIVEAEEKPARNHVARFLVLGGAVALACTLDQGLLTKALIFGVARKFVGQRKTL

SEQ ID NO: 3628 - protein, 425 aa, Saccharum officinarum
MGYVLSAVARVLQQPTAWGAAWEMALLAGPLWAAALLGLLLGWAWRPRWAAGLVVATADGGSAAAAAQAPAQPPFATLDFWKAQLPARLRAPLGYAGATVQQREDDEDAVQGSSEMANEELAVGKDDLVNLWRLVEGRDGGPAWIKMMEKSLPTMTYQAWRRDAQTGPPQYQSSSIFENATPEEVRDFFGDDEFRMSNKWDDMLIYHKTLEECQTTGTMKVQWVRKFPFFCSDREYIIARRIWKLGGAYYCVTKGIPCSSIPRRNKPRRVDLYYSSWCIRAVESKRGNGGLTACEVLLFHHEDMGIPYEIAKLGIRQGMWGCVKKIEPGLRAYQEARAAGVPASRSALMARINTKVGDNFVRSLESNSDESEIVEAEEKPARNHVARFLVLGGAVALACTLDQGLLTKALIFGVARKFVGQRKTL

SEQ ID NO: 3629 - protein, 420 aa, Panicum virgatum
MGYVLSAVTRVLEQPTAWGAVWEMARLAGPLWAAALLGLLLGWAWRPRWAAGLVATADGNAAAAAPAQPPFATLDFWKAQLPARLRAPLGYCETAVQQQEDVGAAHGSSEMANEELAVGKDYLVNLWRLVEGRDGGPAWIKMMEKSLPTMTYQAWRRDAQTGPPQYQSSTIFENATPEEVRDFFGDDEFRMSNKWDDMLIYHKTLEECHTTGTMKVHWVRKFPFFCSDREYIIARRIWKLGGAYYCVTKGIPCSSIPRRNKPRRVDLYYSSWCIRAVESKRGNGGLTACEIILFHHEDMGIPYEIAKLGIRQGMWGCVKKIEPGLRAYQEARAAGEPASKSALMARINTKVGDNFVRSLETNSDESEIVEAEEKPARSNVSRFLVLGGAVALACTLDQGLLTKAVIFGIARKFVGQRKTL

SEQ ID NO: 3630 - protein, 420 aa, Panicum virgatum
MGYVLSAVARVLEQPTAWGAVWEMSLLAVPLWAAALLGLLLGWAWRPRWAAGLVATADGNAAAPAPAQPPFATLDFWKAQLPARLRAPLGYSETAVQQQEDEATAHGSPEMANEEMAVGKDDLVNLWRLVEGRDGGPSWIKMMEKSLPTMTYQAWRRDAQTGPPQYQSSTIFENATPEEVRDFFGDDEFRMSNKWDDMLIYHKTLEECHTTGTMKVHWVRKFPFFCSDREYIIARRIWNLGGAYYCVTKGIPCSSIPRRNKPRRVDLYYSSWCIRAVESKRGNGGLTACEILLFHHEDMGIPYEIAKLGIRQGMWGCVKKIEPGLRAYQEARAAGEPASKSALMARINTKVGDNFVRSLETNSDESEIVEAEEKPVRSNVARFLVLGGAVALACTLDQGLMTKAVIFGVARKFVGQRKTL

SEQ ID NO: 3631 - protein, 419 aa, Zea mays
MGYVLSAVARVLEQPTAWGAAPEMALLAGPLWAAVLLGLLLGWAWRPRWAAGLVAAPAPAAAAQPPFATLGFWKAQLPARLRAPLGSAAAVRHGEEEEEDEVSVRGSSEAGSEELAVGKRDLANLWRLVEGRDGGPAWIKMMDRSLPTMTYQAWRRDAQTGPPQYQSSSIFEDATPEEVRDFFGDDEFRVSNKWDDMLVYHKTLEECQTTGTMKVHWVRKFPFFCSDREYIIARRIWKLGGAYYCVTKGIPCSSIPRRNKPRRVDLYYSSWCIRAVESRRGNGGSTACEVLLFHHEDMGIPYEIAKLGIRQGMWGCVKRIEPGLRAYQQARAAGEPVSRSALMAQINTKVGDSFVRSLESDSDGSETVEAEEKPARNRVARFLVLGGAVALACTLDQGLLTKALIFGVARKFVGQRKAL

SEQ ID NO: 3632 - protein, 421 aa, Zea mays
MGYVLSAVARVLEQPTAWGAAPEMALLAGPLWAAVLLGLLLGWAWRPRWAAGLVAAPAPAAAAQPPFATLGFWKAQLPARLRAPLGSAAAVRHGEEEEEDEVSVRGGRSSEAGSEELAVGKRDLANLWRLVEGRDGGPAWIKMMDRSLPTMTYQAWRRDAQTGPPQYQSSSIFEDATPEEVRDFFGDDEFRVSNKWDDMLVYHKTLEECQTTGTMKVHWVRKFPFFCSDREYIIARRIWKLGGAYYCVTKGIPCSSIPRRNKPRRVDLYYSSWCIRAVESRRGNGGSTACEVLLFHHEDMGIPYEIAKLGIRQGMWGCVKRIEPGLRAYQQARAAGEPVSRSALMAQINTKVGDSFVRSLESDSDGSETVEAEEKPARNRVARFLVLGGAVALACTLDQGLLTKALIFGVARKFVGQRKAL

SEQ ID NO: 3633 - protein, 410 aa, Setaria italica
LEQPTAWGAVWEMALLAGPLWAAALIGLLLGWAWRPRWAAGLVATADGSAAAPAPAQAPFATLDFWKAQLPARLRVPLGYAGTAVQQREEDKAAAQGSSEMANEELAVGKEDLVNLWRLVEGRDGGPAWIKMMEKSLPTMTYQAWRRDAQTGPPQYQSSTIFENATPEEVRDFFGDDEFRMSNKWDDMLIYHKTLEECQTTGTMKVHWVRKFPFFCSDREYIIGRRIWKLGGAYYCVTKGIPCSSIPRRNKPRRVDLYYSSWCIRAVESKRGNGGLTACEILLFHHEDMGIPYEIAKLGIRQGMWGCVKKIEPGLRAYQEARAAGEPASKSALMARINTKVGDNFVRSLESNSEESEIVEAEEKPARNNVARFLVLGGAVALACTLDQGLLTKALIFGVARKFVGQRKTL

SEQ ID NO: 3634 - protein, 1675 aa, Brachypodium distachyon
MAAARGSRSGVSGAALALLAAVLVGCLAGGASAAEIRRQKNVQVALRAKWAGTPLLLEANELLSKEGKDLFWGFVDHWKELDKGSECLTAKCCVQKIVEDVHSLIGEPLASIFEFSLTLRSASPRLVLYRQLAEESLSSVPVEDDALEQISGHGPVEGTCCWVDTGSALLFNSADLHKWLEGSGKRTMDSTGQPELFDFDHVYPRSNVTAPVAILYGAVGTKCFKELHVRLAEASKKGKVRYALRPVLPSGCQATSSFCASIGAVDAVTLSGYGVELALKNMEYKAMDDTAIKKGVALEDPKTEDLGQEVRGFIFSKILERKPELNDEAMAFRDYLLSSTVSDTLEVWELKDLGHQTAQRILHASDPLQSMQEINQNFPSVVSSLSRMKLDDSIKDEIIANQRMVPPGKSLMALNGALINIEDLDLYLLMDMVREELSLADQFIRLKLPKSAVHKILSAAPPAESNSFRVDFRASHVHYLNNLEEDDLYKRWRSNLNELLMPVYPGQMRYIRKNLFHAVYVLDPASACVWCLLFSLITLQTIDTIMSLYQDSVPVRFGIIMYSSRFINVIEENDGTHQVNDGSKSEDDTSTLIIRLFLYIKETYSTQLAFEFLSNIHKLRNGGDDYSEEPVEAHHVEEAFVDSVLSGAKSHPQDVLLKLQKENMYKQEAEENSRFVHKLGLYKLHCCLLMNGLVHESNEDATMNAMNDELPRIQEQVYYGHIQSHTDVLEKFLSESSYKRYNPSITGKSTEKKRFVSLFASYHQEDSVLHDINYLHSDGTTDDVKPVTHLLAVDLSSKIGTKLLHEAICYLMDGSNRARVGLLLYARSDSASNILLMKDIIDRTISSFSDKEKVLGFLHGFCKFYESQHMPASTAVGDRISPMMDEVYNLAAETDLPVDDYKSWLASFSADTVLKRIDKLNDFLFGQLGLEFGSNAVITNGREPKNMRFLQSTEGVGGAVVLGRSREVSARESGPRCVGGAGHGGKPRWPDRWAVLVSFGIFVVGVGDSFLTDDLGLLESMEYELRTKYIHEIVEEVEWAGVDPDYLTSKFYSDITMLVSSSMSVRERPSERAHFEILHAEHSAIKLNYMNSSIHIDAVIDPLSPAGQKLSPLLRILWRQIQPSMRIVLNPISSLADLPLKNYYRFVLPSMDDFSNTDYSVHGPKAFFSNMPLSKTLTMNIDVPEPWLVEPVVAIHDLDNILLENLGDVRTLQAVFELEALLLTGHCMEKDREPPRGLQFILGTKQMPHLVDTLVMANLGYWQMKVSPGVWYLQLAPGRSADLYELPSKLIAIDSLRGKLIHIEVQKKKGKEHEDLLNADDENHFQEKMDNKGWNSNLLKWASSFISGDASLKKKSEKINDLKDARQGETINIFSVASGHLYERFLKIMILSVLKKTQRPVKFWFIKNYLSPQFKDVIPHMAQEYGFGYELITYKWPTWLHKQKEKQRIIWAYKILFLDVIFPLSLRKVIFVDADQIVRTDMGELYDMNLKGRPLAYTPFCDNNKEMDGYRFWKQGFWKDHLRGRPYHISALYVVDLAKFRQTAAGDTLRVVYETLSKDPNSLSNLDQDLPNYAQHTVPIFSLPQEWLWCESWCGNATKARAKTIDLCNNPMTKEPKLQGARRIVPEWVDFDSEARQFTARILGENLESAEATSVPSDAPKPDDKDSRQDVKDEL

SEQ ID NO: 3635 - protein, 421 aa, Brachypodium distachyon
MPSSSTYADALAAARPFLRGEEELQPDPSLPALAAVLSAAGAGECWHKHGTFLAHLLDVHRILRLWSAPDAVARCGLYHSAYSNSYVNLAIFEPDVGRAHVAGVVGAEAERLVHLFCVVPRQQLIHDDLLFHYEDEDLVVDLARSEESLADARGGVFEEDEPWRRKIQRLLPASGITVKHIRTGEDVALSRRVAAAFLLMTMADFSDQLFDWQDRLFDNTNGRLEFRGNTWTSLWPGTGKPGLWTTSISRMGALYSLIVREEEIYIAHRTHTTGQEGDETATRDEDIALVIPPVFNGCTKVLNADDQKAARDLYWEAVCSDEEAMDRHRVEELLRQTVAKNPFVGEPRLVLAQVCLNAEMYEEAQEQAEEGLKLLLEWGSSWDKRMTWEGWVSWGRAMLTKAKEKDWPHTSFGILSLGLVK

SEQ ID NO: 3636 - protein, 420 aa, Panicum virgatum
MPPPPPRSLDDALAAARPFLRGEEAQVDPALPELAAVLRAAGAGECWHKHGTFLAHLLDVYRILRLWGAPDAVARCGLYHSAYSNSYVNLAIFQPDTGRAHVAAVVGAPAERLVHLFCVVPRQQLIHDHLLFHYTDHDLVADLQRSEASLQDARRGVFHHDEPWRRKIQRLLPPAGITVKHIRTGEDVALSRRIAASFLLMTMADFSDQLFDWQDRLFDNADGRLEFRGNTWTSLWPGTGKPGLWVTSISRMGALYALIVREEEIHIAHRGAHAATAQEQGSDRDEDIHLVLPPVLDGCTKVLDAQDQKVARDLYWEAVCGGDDDWRKVEQLLQQSIAKNPFVGEPHLVLAQVYLNMDRYGDAQIQAEEGLKLLLEWGSCWDKRMPWEGWVSWGRAMLTKARDKDWPHTSFGILSLGLVK

SEQ ID NO: 3637 - protein, 821 aa, Brachypodium distachyon
MASGGGGCLPAMDLMRSEPMQLLQVIIPTESAHLAVSYLGDLGLIQFKDLNADKSPFQRTYAAQIKRCGEMARKLRFFKEQMSKAGIQISPVQLTETPLDFDDMEIKLGELEAELTEVNANDEKLQRTYNELLEYSTVLQKAGEFFYSAQRSAAAQQREMETSQSGDISLESPLLEQDMFTDASKQVKLGSLSGLVPKEKAMAFERILFRATRGNILLRQESVDEPVTDPQSGEKVSKNTFVIFYSGERAKAKILKICDAFRANRYPFPEDLGKQMHTVQEVSGKISELKATIDMGLAHRDSILKTIALEYEHWNHLAKKEKSIYHTLNMLSVDVTKKCLVGEGWSPVFATSQVQDALQRATLESKSQVGSIFQVLNTKESPPTYFQTNKFTSAFQEIVDAYGVAKYQEANPGVFTVITFPFLFAVMFGDWGHGICILLATLYLIIREKKFASQKLGDIMEMMFGGRYIIMMMALFSIYTGLIYNEFFSVPFELFAKSAYACRDPSCGDATTEGLVKIRPTYPFGVDPVWHGSRSELPFLNSLKMKMSILLGVAQMNLGIMMSYFNAKFFRNSVNVWYQFVPQLIFLNSLFGYLSMLIIIKWCTGSKADLYHVMIYMFLSPTDELGENELFPGQKTVQLVLLLLALVSVPWMLIPKPFFLKMEHERRHQGHQYAMLEGADESVVAELGEHHEESNHHEEFEFSEIFVHQLIHTIEFVLGAVSNTASYLRLWALSLAHSELSTVFYDKVLLLTLGYNNLFILAIGVFVFICATVGVLLVMETLSAFLHALRLHWVEFQNKFYEGDGYKFAPFSFALITEEEE

SEQ ID NO: 3638 - protein, 822 aa, Sorghum bicolor
MARGGGGGCCPQMDLMRSEAMQLVQVIIPAESAHLTVSYLGDLGLLQFKDLNAEKSPFQRTYAAQIKRCSEMARKLRFFKEQMSKADITTSPTQLNETHLDFDDLEIKLGELEAELTEVNANNEKLQRTYNELLEYHTVLQKAGDFFYSAQRTAAAQQREMEANQSGQTSLESPLLEQEMSNDPSKQVKLGSLSGLVPKEKAMAFERILFRATRGNIFLRQEPVDEPVTDPVSGEKVTKNAFVIFYSGERAKTKILKICDAFNANRYPFPEDVSKQLHAVQEVSGKISELKATIDMGLAHRDSILKNIASDFEQWNHLAKKEKAIYHTLNMLSVDVTKKCLVAEGWSPVFASVQIQDALQRATVDSKSQVGSIFQVLNTKESPPTYFQTNKFTTAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFELFGKSAYECRDPSCSDATTDGLIKVRDAYPFGVDPVWHGSRSELPFLNSLKMKMSILLGVAQMNLGIVISYFNAKFFRNSLNVWYQFIPQLIFLNSLFGYLSLLIIIKWCTGSKADLYHVMIYMFLSPTDELGENQLFSGQKTVQLVLLLLALVSVPWMLIPKPLLLKKQHQQRHQGHQYAMLQGTDESVGAELGEHHEDAHDHEEFEFSEVFVHQLIHTIEFVLGAVSNTASYLRLWALSLAHSELSTVFYDKVLLTALGLNNIFALIIGGIVFVFATVGVLLVMETLSAFLHALRLHWVEFQNKFYEGDGYKFAPFSFALIREEED

SEQ ID NO: 3639 - protein, 821 aa, Triticum aestivum
MARSGGGCCPSMDLMRSEAMQLLQVIIPTESAHLAVSHLGDLGLIQFKDLNADKSPFQRTYAAQIKRCAEMARKLRFFKEQMSKAGILVSPMQSTETPLDFDDMEVKLGELEAELTEVNANDEKLQRAHNELLEYSTVLQKAGEFFYSAQRSAAAQHRQMEANQSGETSLESPLLEQDMLTDASKQVKLGSLSGLVPKEKAMAFERILFRATRGNILLRQESVDEPVTDPQSGEKVYKNTFVVFYSGERAKAKILKICDAFRANRYPFPEDLAKQTHTVQEVSGKISELKATIDMGLAHRDSILKTIASEFEHWNHLAKKEKSIYHTLNMLSVDVTKKCLVGEGWSPVFAANQIQDALKRATLESKSQVGSIFQVLNTKESPPTYFQTNKFTSAFQEIVDAYGVAKYQEANPGVYTIITFPFLFAVMFGDWGHGICILLATLYLIIREKKFASQKLGDIMEMMFGGRYIIMMMSIFSIYTGLIYNEFFSVPFELFAKSAYACRDSSCSDSTTEGLIKVRDTYPFGVDPVWHGSRSELPFLNSLKMKMSILLGVSQMNLGIFMSYFNAKFFRNSVNVWYQFVPQLIFLNSLFGYLSMLIIIKWCTGSKADLYHVMIYMFLSPTDDMGENQLFPGQKTLQQVLLLLALVSVPWMLIPKPFFLKWEHERRHQGHQYAMLEGADESVVAELGEHNEESNHHEEFEFSEIFVHQLIHTIEFVLGAVSNTASYLRLWALSLAHSELSTVFYDKVLLLTLGYNNIFILAIGVVVFICATVGVLLVMETLSAFLHALRLHWVEFQNKFYEGDGYKFAPFSFALISEDEE

SEQ ID NO: 3640 - protein, 821 aa, Triticum aestivum
  misc_feature (211)..(211): Xaa can be any naturally occurring amino acid
MARSGGGCCPSMDLMRSEAMQLLQVIIPTESAHLAVSHLGDLGLIQFKDLNADKSPFQRTYAAQIKRCAEMARKLRFFKEQMSKAGILVSPMQSTETPLDFDDMEVKLGELEAELTEVNANDEKLQRAHNELLEYSTVLQKAGEFFYSAQRSAAAQHRQMEANQSGETSLESPLLEQDMLTDASKQVKLGSLSGLVPKEKAMAFERILFRXTRGNILLRQESVDEPVTDPQSGEKVYKNTFVVFYSGERAKAKILKICDAFRANRYPFPEDLAKQTHTVQEVSGKISELKATIDMGLAHRDSILKTIASEFEHWNHLAKKEKSIYHTLNMLSVDVTKKCLVGEGWSPVFAANQIQDALKRATLESKSQVGSIFQVLNTKESPPTYFQTNKFTSAFQEIVDAYGVAKYQEANPGVYTIITFPFLFAVMFGDWGHGICILLATLYLIIREKKFASQKLGDIMEMMFGGRYIIMMMSIFSIYTGLIYNEFFSVPFELFAKSAYACRDSSCSDSTTEGLIKVRDTYPFGVDPVWHGSRSELPFLNSLKMKMSILLGVSQMNLGIFMSYFNAKFFRNSVNIWYQFVPQLIFLNSLFGYLSMLIIIKWCTGSKADLYHVMIYMFLSPTDDMGENQLFPGQKTLQQVLLLLALVSVPWMLIPKPFFLKWEHERRHQGHQYAMLEGADESVVAELGEHNEESNHHEEFEFSEIFVHQLIHTIEFVLGAVSNTASYLRLWALSLAHSELSTVFYDKVLLLTLGYNNIFILAIGVVVFICATVGVLLVMETLSAFLHALRLHWVEFQNKFYEGDGYKFAPFSFALISEDEE

SEQ ID NO: 3641 - protein, 822 aa, Zea mays
MARGGGGGCCPPMDLMRSEAMQLVQVIIPAESAHLTVSYLGDLGLLQFKDLNIDKSPFQRTYAAQIKRCSEMARKLRFFKEQMSKADITASPTQLNGTHMDFDELEIKLGELEAELTEVNANNEKLQRTYNELLEYHTVLQKAGEFFYSAQRTAAAQQMEMEANQSGQTSLESPLLEQEMTTDPSKQVKLGSLSGLVPKEKAMAFERILFRATRGNIFLRQEPVDEPVTDPVSREKVTKNAFVIFYSGERAKTKILKICDAFNANRYPFPEDVGKQLHAVQEVSGKISELKTTIDMGLAHRDSILKNIASDFEQWNHLVKKEKAIYHTLNMLSVDVTKKCLVAEGWSPIFASIQIQDALQRATLDSKSQVGSIFQVLNTKESPPTYFQTNKFTSAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFGLFGKSAYACRDSSCSDATTEGLLKVRDAYPFGVDPVWHGSRSELPFLNSLKMKMSILLGVAQMNLGIVISYFNAKFFRNSINVWYQFIPQLIFLNSLFGYLSLLIIIKWCTGSKADLYHVMIYMFLSPTDDLSENQLFSGQKTVQLVLLLLALVSVPWMLIPKPLLLKKQHQQRHQGHQYAMLQGIDESVGAELGEHHEDAHDHEEFEFGEVFVHQLIHTIEFVLGAVSNTASYLRLWALSLAHSELSTVFYEKVLMTAYGFNNVFILIIGVVIFIFATIGVLLVMETLSAFLHALRLHWVEFQNKFYEGDGYKFAPFSFALIREEED

SEQ ID NO: 3642 - protein, 740 aa, Zea mays
MSKADITASPTQLNGTHMDFDELEIKLGELEAELTEVNANNEKLQRTYNELLEYHTVLQKAGEFFYSAQRTAAAQQMEMEANQSGQTSLESPLLEQEMTTDPSKQVKLGSLSGLVPKEKAMAFERILFRATRGNIFLRQEPVDEPVTDPVSREKVTKNAFVIFYSGERAKTKILKICDAFNANRYPFPEDVGKQLHAVQEVSGKISELKTTIDMGLAHRDSILKNIASDFEQWNHLVKKEKAIYHTLNMLSVDVTKKCLVAEGWSPIFASIQIQDALQRATLDSKSQVGSIFQVLNTKESPPTYFQTNKFTSAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFGLFGKSAYACRDSSCSDATTEGLLKVRDAYPFGVDPVWHGSRSELPFLNSLKMKMSILLGVAQMNLGIVISYFNAKFFRNSINVWYQFIPQLIFLNSLFGYLSLLIIIKWCTGSKADLYHVMIYMFLSPTDDLSENQLFSGQKTVQLVLLLLALVSVPWMLIPKPLLLKKQHQQRHQGHQYAMLQGIDESVGAELGEHHEDAHDHEEFEFGEVFVHQLIHTIEFVLGAVSNTASYLRLWALSLAHSELSTVFYEKVLMTAYGFNNVFILIIGVVIFIFATIGVLLVMETLSAFLHALRLHWVEFQNKFYEGDGYKFAPFSFALIREEED

SEQ ID NO: 3643 - protein, 821 aa, Hordeum vulgare
MARSGGGCCPSMDLMRSEAMQLLQVIIPTESAHLAVSHLGDLGLIQFKDLNADKSPFQRTYAAQIKRCAEMSRKLRFFKEQMSKAGIQVPPMQSTETPLDFDDMEVKLGELEAELTEVNANDEKLQRAHNELLEYSTVLQKAGEFFYSAQRSAAAQHRQMEANQSGETSLESPLLEQDMLTDASKQVKLGSLSGLVPKEKAMAFERILFRSTRGNILLRQESVDEPVTDPQSGEKVSKNTFVVFYSGERAKAKILKICDAFRANRYPFPEDLAKQTHTVQEVAGKISELKATIDMGLAHRDSILKTIASEFEHWNHLAKKEKSIYHTLNMLSVDVTKKCLVGEGWSPVFATNQVQDALQRATLESKSQVGSIFQVLNTKESPPTYFQTNKFTSAFQEIVDAYGVAKYQEANPGVYTIITFPFLFAVMFGDWGHGICILLATLYLIIREKKFASQKLGDIMEMMFGGRYIIMMMSIFSIYTGLIYNEFFSVPFELFAKSAYACRDSSCSDSTTEGLIKVRDTYPFGVDPVWHGSRSELPFLNSLKMKMSILLGVSQMNLGIFMSYFNAKFFRNSVNVWYQFVPQLIFLNSLFGYLSMLIIIKWCTGSKADLYHVMIYMFLSPTDEMGENQLFPGQKTVQQVLLLLALVSVPWMLIPKPFFLKWEHERRHQGHQYAMLEGADESVIAELGDHNEEPNHHEEFEFSEIFVHQLIHTIEFVLGAVSNTASYLRLWALSLAHSELSTVFYDKVLILTLGYNNILILAIGVVVFICATVGVLLVMETLSAFLHALRLHWVEFQNKFYEGDGYKFAPFSFALISEDEE

SEQ ID NO: 3644 - protein, 808 aa, Setaria italica
MDLMRSEAMQLVQVIIPAESAHLTVSYLGDLGLIQFKDLNAEKSPFQRTYAAQIKRCSEMARKLRFFKEQMSKANISPSPTQLNEAHLEFDDLEIKLGELEAELTEVNANNEKLQRTYNELLEYNTVLQKAGEFFYSAQRSAAAQQREMEANQSSQTSLESPLLEQEMSTDPSKQVKLGSLSGLVPKEKAMAFERILFRATRGNIFLRQEPIDEPVTDPVSGEKVAKNAFVIFYSGERSKAKILKICDAFNANRYPFPEDVTKQLHAVQEVSGRISELKATIDMGLAHRDSILKSIASDFEQWNHLAKREKAIYHTLNMLSVDVTKKCLVAEGWSPVFASVQIQDALQRATVDSKSQVGSIFQILNTKESPPTYFQTNKFTTAFQEIVDAYGVAKYQEANPGVFTIVTFPFLFAVMFGDWGHGICLLLGTLFLIIREKKLASQKLGDITEMMFGGRYVIMMMSIFSIYTGLIYNEFFSVPFELFGKSAYACRDPSCRDSTTEGLIKVRGTYPFGVDPVWHGSRSELPFLNSLKMKMSILLGVAQMNLGIVMSYFNAKFFRNSINVWYQFIPQLIFLNFGYLSLLIIIKWCTGSKADLYHVMIYMFLSPTDELGENQLFSGQKTVQLVLLLLALVSVPWMLIPKPVLLKKQHERRHQGHQYAMLQGTDESVGAELGEHHDESHDHEEFEFSEVFVHQLIHTIEFVLGAVSNTASYLRLWALSLAHSELSTVFYDKVLMLTWRMNNVVALILGVIIFIFATIGVLLVMETLSAFLHALRLHWVEFQNKFYEGDGYKFAPFSFALIREEED

SEQ ID NO: 3645 - protein, 823 aa, Avena sativa
MPRGGGGCLPPMDLMRSEAMQLLQVIIPTESAHLAVSNLGELGLIQFKDLNADKSPFQRTFAAQIKRTGEMARKLRYFKEQMSKAGIQVSPLQSTETALDFDDMEIKLGELEAELIEVNANDEKLQRTYNELMEYSTVLRKAGEFFYSAQRSAAAQQTELGANQSGSGETSLESPLLEQDMFTDASKQVKLGSLSGLVPKEKAMAFERILFRATRGNILLRQESVDELVTDPQSGEKVSKNTFVVFYSGERAKAKILKICDAFRANRYPFPEDLAKQMHTIEEVSGKIKELKATINMGLAHRDTILKSIASEFEHWNHVTKKEKSIYHTLNMLSVDVTKKCLVGEGWSPVFATNQVQDALQRATLESKSQVGSIFQVLNTKESPPTYFQTNKFTSAFQEIVDAYGVAKYQEANPGVFTVVTFPFLFAVMFGDWGHGICLLLATLYLIIREKKFASQKLGDIMEMMFGGRYIIMMMALFSIYTGFIYNEFFSVPFELFAKSAYACRDPSCGDATTEGLIKVRPTYPFGVDPVWHGSRSELPFLNSLKMKMSILLGVSQMNLGIMMSYFNAKFFRNNVNIFYQFIPQLLFLNSLFGYLSMLIIIKWCTGSKADLYHVMIYMFLSPTDDMGENELFPHQKYVQQALLVIALISVPWMLIPKPFILKNEHERRHQGHQYAQLEGADESVIAELGVHHEESNHHEEFEFSEVFVHQLIHTIEFVLGAVSNTASYLRLWALSLAHSELSTVFYDKVLLLTLGYNNIIILAIGVVIFIFATVGVLLVMETLSAFLHALRLHWVEYQNKFYEGDGYKFAPFSFALISDEEE

SEQ ID NO: 3646 - protein, 819 aa, Oryza sativa
MSRGGGGCCPSMDLMRSEAMQLVQVIIPAESAHLAVSYLGDLGLLQFKDLNADKSPFQRTYASQIKRCGEMARKLRFFREQMSKAAIATSTQFSGTSLEIDDLEVKLGELEVELTEVNANNDKLQRTYNELVEYNIVLQKAGEFFYSAQRSATEQQREMSADQSGDSSLESPLLQQEMVTDPSKQVKLGSLSGLVPKEKAMAFERILFRATRGNMFLRQEPVDETVTDPLSGEKVIKNAFVIFYSGERAKSKIVKICDAFGANRYPFPEDLGKQLQTIQEVSGKISELKATIEIGLAHRDSILKNISSEFEQWNTLVKKEKAIYHTLNMLSLDVTKKCLVAEGWSPVFATSQIQDALQRATVDSKSQVGSIFQVLNTQESPPTFFQTNKFTSAFQEIVDAYGIAKYQEANPGVFTIVTFPFLFAIMFGDWGHGICLLLATLYLIIREKKLASQKLDDIMDMMFGGRYVILMMSLFSIYTGLIYNEFFSVPFELFGKSAYACRDPSCGDATTEGLIKVRPAYSFGVDPVWHGSRSELPFLNSLKMKLSILIGVAQMNLGIMMSYFNAKFFRNAINVWYQFIPQLIFLNSLFGYLSLLIIIKWCTGSKADLYHVMIYMFLSPTDDLGENELFPGQKLVQLVLLLLALVSVPWMLIPKPFFLKKQHEQRHQGQQYTMLQATDESVTELEEHQDDPHHHEEFEFSEVFVHQLIHTIEFVLGAVSNTASYLRLWALSLAHSELSTVFYEKVLVLSWGYNNIFILIIGAVIFLFATIGVLLVMETLSAFLHALRLHWVEFQNKFYEGDGYKFVPFAFASIIEEED

SEQ ID NO: 3647 - protein, 823 aa, Brachypodium distachyon
MSRGGGGGGGCCPPMDLMRSEAMQLVQVIIPAESARLVVSNLGDLGLVQFKDLNGDKSPFQRAYAAQIKRCGEMARKLRFFKEQMLKAAILTGATQFSGSPLEIDDLEIKLEEFEADLIEVNRNNGKLQRTYNELVEYNVLLKTIGDFFYSAQRSATRQQREMVADQSGDSSLESPLLEQEMVIDPSKQVKLGSLSGLVPKQKSMAFERILFRATRGNMLLRQESVDEPVTHPQSGEKVVKNSFVIFYSGERAKSKIVKICDSFGANRYPFPEDLAKQTQTIQEVSGKISELKATIEIGLAHRDSILKNIAYEFEQWSNLLKKEKAIYHTLNMFSLDVTKKCFVAEGWSPVFATDQVQDALHRATTDSNSQVGSIFQVLNTQESPPTYFQTNKFTSSFQDIVDAYGIAKYQEANPGLFTIVTFPFLFAVMFGDWGHGICLLLSALYLVIREKKLASQKLDDIVEIMFGGRYVILMMSLFSIYTGLIYNEFFSVPFELFGKSAYACRDPSCVDATSEGLIKVRQTYPFGVDPVWHGSRSELPFLNSLKMKMSILIGVSQMNLGIVMSFFNAKYFKNSVNVWYQFVPQLIFLNSLFGYLSLLIIIKWCTGSKADLYHVMIYMFLGPTDDIGENQLFPGQKIVQIVLLLLALVSVPWMLIPKPLFLKKQHEQRHQGQQYTMIQATTESVTGLQRHHENPHHHDEFEFSEVFVHQLIHTIEFVLGAVSNTASYLRLWALSLAHSELSSVFYDKVLLLAWGYNNITILVVGVIVFLFATIGVLLSMETLSAFLHALRLHWVEFQNKFYEGDGYKFAPFAFASIIEEED

SEQ ID NO: 3648 - protein, 760 aa, Pennisetum glaucum
MDLMRSEAMQLVQVIIPAESAHLTVSYLGDLGFIQFKDLNAEKSPFQRTYAAQIKRCSEMARKLRFFKEQMSKADISPSPTQLNEAHLEFDDLEIKLGELEAELTEVNANNEKLQRTYNELLEYNTVLQKAGEFFYSAQRSAAAQQREMEANQSSETSLESPLLEQEMSTDPSKQVKLGSLSGLVPKEKAMAFERILFRATRGNIFLRQEPIDEPVTDPVSGEKVAKNAFVIFYSGERAKAKILKICDAFNANRYPFPEDVTKQLHAVQEVSARISELKATIDMGLAHRDSILKNIASDFEQWNHLAKREKAIYHTLNMFSVDVTKKCLVAEGWSPVFASVQIQDALQRATVDSKSQVGSIFQVLNTKEYPPTYFQTNKFTSAFQEIVDAYGVARYQEANPGVFTIVTFPFLFAVMFGDWGHGICIFLATLYLIIREKKLASQKLGDMMEMMFGGRYVILMMSLFSIYTGLIYNEFFSVPFELFGKSAYACRDPSCRDSTTEGLIKVRGTYPFGVDPVWHGSRSELPFLNSLKMKMSILLGVAQMNLGIVMSYFNAKFFRNSINVWYQFIPQLIFLNSLFGYLSLLIIIKWCTGSKADLYHVMIYMFLSPTDELGENQLFSGQKTVQLVLLLLAFVSVPWMLIPKPFLLKKQHERRHQGHQYAMLQGTDESVGAELGEHHDESHDHEEFEFSEVFVHQLIHTIEFVLGAVSNTASYLRLWALSLAHSELSTVFYDKFLLLLLASSSSSLPRLVSCFLWRL

SEQ ID NO: 3649 - protein, 749 aa, Zea mays
MARKLRFFKEQMSKADIGPTQLNETHLDFDDLEIKLGELEAELTEVNANNEKLLRTYNELLEYHTVLQKAGDFFYSAQRTAASQQRELEANQSGQTSLESPLLEQEMSTDPSKQVKLGSLSGLVPKEKAMAFERILFRATRGNIFLRQEPVDEPVTDPVSGEKVTKNAFVIFYSGERAKTKILKICDAFNANRYPFPEDVSKQLHAVQEVSGKISELKATIDMGLAHRDSILKNIASDFEQWNHLVKKEKAIYHTLNMLSVDVTKKCLVAEGWSPVFASIQIQDALQRATVNSKSQVGSIFEVLNTKESPPTYFQTNKFTSAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFGLFGKSAYACRDSSCSDATTEGLIKVRDAYPFGVDPVWHGSRSELPFLNSLKMKMSILLGVAQMNLGIVISYFNAKFFRNSLNVWYQFIPQLIFLNSLFGYLSLLIIIKWCTGSKADLYHVMIYMFLSPTDEIGENQLFSGQKTVQLVLLLLALVSVPWMLIPKPLLLKKQHQQRHQGHQYAMLQGVDESVGAELGEHHEEAHDHEEFEFSEVFVHQLIHTIEFVLGAVSNTASYLRLWALSLAHSELSTVFYDKVLLMAWGFNNVIILIIGIIVFIFATVGVLLVMETLSAFLHALRLHWVEFQNKFYEGDGYKFAPFSFALIREEED

SEQ ID NO: 3650 - protein, 1490 aa, Brachypodium distachyon
MTKLAYLHEPGVLHNLACRYGLNEIYTYTGNILIAVNPFQRLPHLYDVHMMEQYKGATFGELSPHLFAIADSCYRAMINEHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRSFHYLNQTNCYEVANVDDAREYLETRNAMDIVGICEEEQDAIFRVVAAILHLGNINFSKGEEIDSSRLRDEKSVYHLKTVAELLMCDEKYLEDSLCKRVIVTPDGNITKPLDPDSALQSRDALAKTVYSRLFDWIVDKINNSIGQDPDAISIIGVLDIYGFESFKINSFEQLCINMTNEKLQQHFNQHVFKMEQEEYTRDEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNYSRCPFVANLFPPLPEESSKQSKFSSIGTRFKQQLQALMETLSTTEPHYIRCVKPNTVLKPGIFENYNVLNQLRCGGVLEAIRISCAGYPTKRTFDEFIDRFGVLAPELVDSSDEKAACAAICDRMGLKGYQIGKTKVFLRAGQMAELDARRAEVLANAVRLIQRRIRTHLMRKEFTNLRKASIQTQKFWRARLARKLFEHMRRVAAAITIQKHTRTRSAWKAYLQIYRSSITIQTGLRAMAARNEHRFRRQTKAAIIIQTRWRQHKAYVAYKQQKKASLILQCSWRARVARKELRKLKMEARDNGALKEAKDKLEKRVEELTWRLDVEKHLRIDLEISKGQEIAKLQSALQEMREKLEEAHTAIIKEKEDAKLAIEQAPPKIVEVPVVDNEKVELLTSQNEELEGKFGMFKKKADDLENKVIEIQKQFDKLSRETQERDSKINQLEEMISRLETNLSSMESENHVLRQQSLLASADDDKSRQIESLESKIANLESENQLLRNNSALAVQAAVTPEVIQPSVIEVLENGQQLGELKIFNEQVVVPPVKNLSKQKSLTDRQQENHDVLIKSLAEDRRYDNRRPAAACIVYKSLLHWHSFEAEKTNIFDRIIHTIRSSIESAEGSGELAYWLSTTSTLLYLLQNTLKTSSSSTKGSNRSRTSTGNLFNRMMQNARSSSSGLGISSGYSGMIGRTDIASMVEAKYPAVRFKQQLTAYVEKIYGMMRDSLKKEISTILIMCIQAPRAVRVRSSRGSLKSIHSSALSRQVSNVHWQNIVMCLNNTLETMNSNYVPPMIIRKTFSQVFAFMNVQLFNSLLLRRECCSFSNGEFLKAGLQELEQWCSRTTEEFAGTSWDEMKHIRQAVGFLVLHQKSHKTLDEITDELCPVLSITQICRIGTMFWDDKYGAQGLSQEVIGNMRTLTTDDSVATPNSSFLLDDDSSIPISLDDISRLMLDINPSDVEPPPLLRQNSQFHFLLQQCT

SEQ ID NO: 3651 - protein, 1399 aa, Sorghum bicolor
MTKLAYLHEPGVLHNLSCRYGLNEIYTYTGNILIAVNPFQRLPHLYDVHMMEQYKGASFGELSPHLFAIADACYRALINDQGSQAILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRQFHYLNQTNCYEVANVDDAREYLETRNAMDIVGIDQEEQDAIFRVVAAILHLGNINFSKGQEIDSSKLRDDKSVYHLKTVAELLMCDEKALEDSLCQRVIVTPDGNITKPLDPDSAALSRDALAKTVYSRLFDWIVDKINNSIGQDPDATNIIGVLDIYGFESFKINSFEQLCINLTNEKLQQHFNQHVFKMEQEEYTREEIDWSYVEFVDNQDVLDLIEKKPGGIIALLDEACMFPKSTHETFAQKMYQTYKAHKRFSKPKLARTAFTINHYAGDVTYQADHFLDKNKDYVVAEHQALLNSSRCPFVANLFPPLPEETSKQSKFSSIGTRFKQQLQSLMETLNTTEPHYIRCVKPNAVLKPGIFENHNVLNQLRCGGVLEAIRISCAGYPTKRTFDEFIDRFGMLAPELVDSDEKAACAAICDRMGLKGYQIGKTKVFLRAGQMAELDARRAEILANAARLIQRHIKAHLMRKEFINLRKASVQSQKFWRARLARKLFEYMRRDAASIRIQKHVRTHSARKAYLQVYESAIVIQTGLRAMAARNEHRFRRETKASIIIQEARETGALKEAKDKLEKRVEELTWRLDVEKRLRTDLEEAKGHEIEKLQSALQKLQENLEEAHAAIVKEKEAAKLAIEQAPPKIVEVPVVDNAKLEELTTQNKELEDELTTFKQKAEDLENKLLELQKQSDELSQETQEQASKVTQLQELIERLEASLSNMESENQVLRQQSLVVTSADEDKSKQIERFESKISTLESEIELLRCNSALAVQAVVTPEMNQTTVIEELDKGHQLEEVKTVNEQVVIPPVKNLSKQKSLTDRQQENHDALIKSLVEDRRFDDKKSAAACIAYKSLLHWHSFEAEKTNIFDRIIQTIRSSVEGAESSGELAYWLSTTSTLLYLLQNTLKASSSLSKGTNRSRTTTGSLFSRMVQSARASSGLGIPSGYSGMVRRPDTASMVEAKYPALRFKQQLTAYVEKIYGIIRDNLKKEISPFLTMCIQAPRANRVRPSRGSLKSIHSNGLARQASSLHWQNIVKCLDHTLETMKNNYVPPVIIRKTFSQVFAYLNVQLLNSLLLRRECCSFSNGEFLKAGLQDLEQWCSTITEEYVGTSWDELQHIRQAVGFLVLHQKSHKTLEEITNDLCPVFEHNSNISHSNDVLGRQVWCTRYISRGDWKDENDDNRRLNNYSK

SEQ ID NO: 3652 - protein, 87 aa, Oryza sativa
MAGAAKASWMVAMSVGAVEALKDQAGLCRWNYALRSIHRAAKANARAGVSRGKKLPASAAAVAERRRAEKAEEGLRTVMYISCWSTN

SEQ ID NO: 3653 - protein, 214 aa, Oryza sativa
MAGAAKASWMVAMSVGAVEALKDQGGLCRWNYALRSIHKAAKANAAGVSQGKKLPASAAAVAERRRAEKAEEGLRTVISLKVLLKQLKVIRHAWILEESDVQSGTIAQDRRLLLVLPANAGSREHWRVQKVRSCISLIYGATFSCRLCQLSRASEYSLASHNTGDPLTCSYLVPSYGTAFGIKGCDRYCLLLQQLWLQELKMAAAAAAEKQPQP

SEQ ID NO: 3654 - protein, 90 aa, Festuca arundinacea
MAGAAKASWMVAMSVGAVEALKDQAGLCRWNYALRSIHRAAKAKASIRGAVSQGKKQLPASAAAVAERRRAEKAEEGLRTVMYLSCWGPN

SEQ ID NO: 3655 - protein, 90 aa, Triticum aestivum
MAGAAKASWMVAMSVGAVEALKDQAGLCRWNYALRSIHRAAKAKSNIHAGVSQGKKQLPASAAAVPERRRAEKAEEGLRTVMYLSCWGPN

SEQ ID NO: 3656 - protein, 90 aa, Triticum aestivum
MAGAAKASWMVAMSVGAVEALKDQAGLCRWNYALRSIHRAAKAKANIRAGVSQGKMQLPASAAAVAERRRAEKSDEGLRTVMYLSCWGPN

SEQ ID NO: 3657 - protein, 87 aa, Triticum aestivum
AGPAKASWMVAMSVGAVEALKDQAGLCRWNYALRSIHRAAKANVRGGVSQGSKQLPASASAVAERRRAEKAEEGLRTVMYLSCWGPN

SEQ ID NO: 3658 - protein, 88 aa, Triticum aestivum
MAGPAKASWMVAMSVGAVEALKDQAGLCRWNYALRSIHRAAKANVRGGASQGTKQLPASAVAVAERRRAEKAEEGLRTVMYLSCWGPN

SEQ ID NO: 3659 - protein, 88 aa, Triticum aestivum
  misc_feature (53)..(53): Xaa can be any naturally occurring amino acid
MAGPAKASWMVAMSVGAVEALKDQAGLCRWNYALRSIHRAAKANVRGGASQGXKQLPASASAVAERRRAEKAEEGLRTVMYLSCWGPN

SEQ ID NO: 3660 - protein, 103 aa, Triticum aestivum
MAGAAKASWMVAMSVGAVEALKDQAGLCRWNYALRSIHRAANIRAGVSQGKKQLPASAAAVAERRRAEKAEEGLRTVMCLSCWGVQNTCCAMNWLQVQVLPVG

SEQ ID NO: 3661 - protein, 65 aa, Brachypodium distachyon
MAGAAKASWMVAMSVGAVEALKDQAGLCRWNYALRSIHRAAKANGRPLAGQEAVPCRGDGREGES

SEQ ID NO: 3662 - protein, 91 aa, Triticum aestivum
MAGAAKASWMVAMSVGAVEALKDQAGLCRWNYALRSIIHRAAKARANVRGGVSQGAKQLPASAAAAAERRRAEKAEEGLRTVMYLSCWGPN

SEQ ID NO: 3663 - protein, 90 aa, Triticum aestivum
MAGPAKASWMVAMSVGAVEALKDQAGLCRWNYALSSIHRAAKAKANVRGGVSQGKKQLPAFAAAVAERRRAEKAEEGLRTVMYLSCWGPN

SEQ ID NO: 3664 - protein, 50 aa, Triticum aestivum
MAGPAKASWMVAMSVGAVEALKDQVGLCRWNYALRSIHCAAKANVRSGVS

SEQ ID NO: 3665 - protein, 91 aa, Avena sativa
MAGAAKTSWMVAMSVGAVEALKDQAGLCRWNYALRSIHRAAKAKASVRGTVSQQGKKQLPASAAAVAERRRAEKAEKGLRMVMYLSCWGPN

SEQ ID NO: 3666 - protein, 90 aa, Triticum aestivum
MAGAAKASWMVAMSVGAVEALKDQAGLCRWNYALRSIHRAAKARANVRGGVSQGAKQLPASAASVVERRRWEKAEEGLRTVMYLSCWGPN

SEQ ID NO: 3667 - protein, 90 aa, Triticum aestivum
MAGAAKASWMVAMSVGAVEALKDQAGLCRWNYALRSIHRAAKARANVRGTVSLGTKQLPASTAAVAERRRAEKAEEGLRTVMYLSCWGTN

SEQ ID NO: 3668 - protein, 90 aa, Triticum aestivum
MAGAAKASWMVAMSVGAVEALKDQVGLCRWNYALKSIHRAAKARANVCGGVSQGAKQLPASAAAVAERRQGEKAEEGLRTVMYLSCWGPN

SEQ ID NO: 3669 - protein, 90 aa, Pseudoroegneria spicata
MAAPAKASWMVAMSVGAVEALKDQAGLCRWNYALGSIHRAAKARANVRGGVSQGKKQLPASAAAVAERWRAEKAEEGLRTVMYLSCWGPN

SEQ ID NO: 3670 - protein, 85 aa, Triticum aestivum
MAGPAKASWMAAMSVGAVEALKDQAGLCRWNYALRSIHRAAKANVRGGVSQGTKQLPAAVAERRRAEKAEEGLRTVMYLSCWGPN

SEQ ID NO: 3671 - protein, 113 aa, Triticum aestivum
MAGAAKTSWMVAMSVGAVEALKDQAGLCRWNYALRTIHRTAKANVGGGVSQGAKQLPASAAVAEKRRAEKAEEGLRTVMYLSCWGPNGRMHFSNAEAGEFPLFKKKKSCWGPN

SEQ ID NO: 3672 - protein, 96 aa, Triticum aestivum
MAGPAKASWMAAMSVGAVEALKDQAGLLPLELCPQVHPPCSQGQRPRRRLAGHEAASGSCGGEAASGEGRGGAEDGDVPQLLGPKLEVPVAQASGV

SEQ ID NO: 3673 - protein, 90 aa, Unknown
  Sequence found in Organisms: Zea mays, Triticum aestivum
MAAAAKASWMVAMSVGAVEALKDQVGLCRWNYALRSIHRAAKARANVRGGVSQGAKQLPASAVAVAERRREEKAEEGLRTVMYLSCWGLN

SEQ ID NO: 3674 - protein, 90 aa, Triticum aestivum
MAGAAKASWMVAMSVGAGEALKDQVGLCRWNYVIRSIHRAAKARANIHGGVSQGAKQLPASAGAVAERRRAEKAEEGLRTVMYLSCWGPN

SEQ ID NO: 3675 - protein, 90 aa, Triticum aestivum
MAGAAKASWMVAMSVGAVEALKDQAGLCRWNYALRSIHRTAKARANVHGAVSQGSKQLPASAAAVAEKQRAEKAEEGLRTVMYLSCWGPN

SEQ ID NO: 3676 - protein, 90 aa, Hordeum vulgare
MASPAKASWMVAMSVGAVEALKDQAGLCRWNYALKSIHRAAKARANVRGGVSQGAKQLPASAAAVAEKRRAEKAEEGLRTVMYLSCWGPN

SEQ ID NO: 3677 - protein, 89 aa, Triticum aestivum
MAGAAKASWMVAMSVGGVEALKDQAGLCRWNYALRSIHRAAKARANVRGGVLQGAKQLPASAAVAERRRGEKAEEGLRTVMYLSCWGPN

SEQ ID NO: 3678 - protein, 88 aa, Triticum aestivum
MAAPAKASWMVAMSVGAVEALKDQAGLCRWNYALRSVHRTAKANVRGGASQGKKQLPASAAAVAERRRAENSEEGLRTVMYLSCWGPN

SEQ ID NO: 3679 - protein, 88 aa, Triticum aestivum
MAAPAKASWMVAMSVGAVEALKDQAGLCRWNYALKSIHRAAKANVCGGISQGTKQLLASASAVAERRRAEKAEEGLRTVMYLSCWGPN

SEQ ID NO: 3680 - protein, 91 aa, Hordeum vulgare
MAAAAKASWMAAMSVGAVEALKDQAGLCRWNYALRSVHGAAKAKATIRGGVVSQGTKRLPASAAAVAERRRAEKAEEGLRTVMYLSCWGTN

SEQ ID NO: 3681 - protein, 90 aa, Hordeum vulgare
MASPAKASWMVAMSVGAVEALKDQAGLCRWNYALKSIHRAAKARANVRGGVSQGAKQLPPSAAAVAEKRRAEKAEEGLRTVMYLSCWGPN

SEQ ID NO: 3682 - protein, 90 aa, Lolium multiflorum
MAAAAKASWTVAMSVGAVEALKDQAGLCRWNYALRSIHRAAKAKASARGAVSQGKKQLPVSAAAVAEQRRAQKAEEGLRTVMYLSCWGPN

SEQ ID NO: 3683 - protein, 89 aa, Triticum aestivum
MAGAAKASWMVAMSVGAVEALKDQAGLCRWNYALRSIHRTAKARANVRGGVSQGARQLPASAAVAEKRRAEKTEEGLRTVMYLSCWGPN

SEQ ID NO: 3684 - protein, 90 aa, Hordeum vulgare
MAGAAKASWMVAMSVGAVEALKDQAGLCRWNYALKSIHRTAKARANVHGGVSLSTKQLPASAAAVAERRRAEKAEDGLRTVMYLSCWGPN

SEQ ID NO: 3685 - protein, 85 aa, Zea mays
MAGPAKASWMAAMSVGAVEALKDQAGLFRWNYALRSIRRAAKANVRGGVSQGTKQLPAAVAERRRAEKAEEGLRTVMYLSCWGPN

SEQ ID NO: 3686 - protein, 88 aa, Triticum aestivum
MAGAAKASWTVAMSVGAVEALKDQAGLCRWNYALKSIHRAAKATVRGGVSQGSKQLQASASAVAERRRAEKAEEGLRTAMYLSCWGPS

SEQ ID NO: 3687 - protein, 84 aa, Sorghum bicolor
MAGAAKASWMVAMSVGAVEALKDQAGLCRWNYALRSIHQAAKANAPSFAQAKKLAPAPAERRRADKAAEEGLRTVMYLSCWGPN

SEQ ID NO: 3688 - protein, 92 aa, Triticum aestivum
MAAAAKASWMAAMSVGAVEALKDQAGLCRWNYALRSVHGAAKAKANMRGGGVISQGTKRLPASAAAVAERRRAEKAEEGMRTVMYLSCWGPN

SEQ ID NO: 3689 - protein, 78 aa, Triticum aestivum
MAGAAKASWMVAMSVGVVEALKDQVGLCRWNYALKSIHRAAKARAHVRGSVSQGARQLPASAAGGGPRSSERRRPRKG

SEQ ID NO: 3690 - protein, 90 aa, Triticum aestivum
MTGATKASWMVAMSVGAVEALKDQAGLCRWNYALRSIRRAAKARANVRSVVSRDAKQLPASAAAVAERRRAEKAEEGLRTVMYLSCWGPN

SEQ ID NO: 3691 - protein, 89 aa, Triticum aestivum
  misc_feature (2)..(2): Xaa can be any naturally occurring amino acid
MXGAAKASWMVAMSVGGVEALKDQAGLCRWNYALRSIHRAAKARANVRGGVLQGAKQLPASAAVAERRRGDKAEEGLRTVMYLSCWGPN

SEQ ID NO: 3692 - protein, 90 aa, Triticum aestivum
MAAPVKASWMVAMSVGAVEALKDQARLCRWNYALTSIHRAAKARTNVRGSVSQGPKQLPASAAAVAERRRAEKAEEGLRTVMSLSCWGPN

SEQ ID NO: 3693 - protein, 90 aa, Hordeum vulgare
MAGPAKASWMVAMSVGAVEALKDQAGLCRWNYALKSIHRPAKARANVCGGVSQGAKQLPASAAVLAERRRAEKAEEGIRTVMYLSCWGPN

SEQ ID NO: 3694 - protein, 85 aa, Triticum aestivum
MAGPAKASWMVAMSVGAVEALKDQAGLCRWNYALKSIHRAAKANVRASVSQGTKQLPASVVERRQAEKAEEELRTVMYLSCWGPN

SEQ ID NO: 3695 - protein, 88 aa, Triticum aestivum
  misc_feature (52)..(52): Xaa can be any naturally occurring amino acid
MAGAAKASWTVAMSVGAVEALKDQAGLCRWNYALKSIHRAAKATVRGGVSQXSKQLQASASAVAERRRAEKAEEGLRTAMYLSCWGPS

SEQ ID NO: 3696 - protein, 88 aa, Triticum aestivum
MAAPAKASWMVAMSVGTVEALKDQAGLCRWNYTLRSIHRAAKANVRSGVSQGNKQLPASVSAVAERRPAEKAEEGLRTVMYLSCWGLN

SEQ ID NO: 3697 - protein, 79 aa, Triticum aestivum
MVAMSVGALEALKDQAGLCRWKYALRSIHRAAKANVRSGVSQGNKQLPATVAAVAERWRAEKAEEGLRTVMYLSCWGLN

SEQ ID NO: 3698 - protein, 85 aa, Setaria italica
MAAAAKASWMVAMSVGAVEALKDQAGLCRWNYALRSIHRMAKANAPSFAQAKKLAPATAAAERRRADKAEEGMRTVMYLSCWGPN

SEQ ID NO: 3699 - protein, 84 aa, Pennisetum glaucum
MAGAAKASWMVAMSVGAVEALKDQAGLCRWNYALRSAHRAAKANAPSFAQAKKMATPAAAERRRADKAEEGMRTVMYLSCWGPN

SEQ ID NO: 3700 - protein, 92 aa, Unknown
  Sequence found in Organisms: Zea mays, Triticum aestivum
MAGPAKASWMVAMGVGAVEALKDQAGLCRWNYALRSIHRTAKAKANVRGGGGVSQGKKQLPTSAAAVTERRRADKAEEGLRTVMYLSCWGPN

SEQ ID NO: 3701 - protein, 92 aa, Triticum aestivum
MAAAAKASWMAAMSVGAVEALKDQAGLCRWNYALRAIHGAAKGKASIRRGAVVSQGTKRPPASAAAVAERRRAEKAEEGLRTVMYLSCWGPN

SEQ ID NO: 3702 - protein, 91 aa, Avena sativa
MAGAAKASWMVVMSVGAVEALKDQAGLCRWNYALRSIHRAAKAKASVRGAVSQQSKKQIPASAVAVAERRRAKKAEEGLRTVMYLSCWGPN

SEQ ID NO: 3703 - protein, 91 aa, Triticum aestivum
MAGAAKASWTVAMSVGAVEALKDQAGLCRWNYALKSIHRTAKARVNVHGGASQSTKQLPASAAAVAERRRAEKAEEGLRTVMYLGCWGPNC

SEQ ID NO: 3704 - protein, 90 aa, Avena sativa
MAGAGKASWMVAMSVGAVEALKDQAGLCRWNYALRSIHRAVNAKAGGRAAASQSKKQLPPFIAAVAERRRAEKAEEGLRTVMYLSCWGPN

SEQ ID NO: 3705 - protein, 90 aa, Triticum aestivum
MAAPAKASWLVAMSVGAVEALKDQAGLCRWNYALSSIHRADKARANVRGGVSQGPKQLAASAAAVAERRRAEKAEEGLRTMMYLSCWGPN

SEQ ID NO: 3706 - protein, 90 aa, Hordeum vulgare
MTSAAKASWMMAMSLGAVEALKDQAGLCRWNYALRSIHRAAKAKANVRGGVSQGAKQLPASSAAEAEKRRAEKAEEGLRTVMYLSCWGPN

SEQ ID NO: 3707 - protein, 85 aa, Hordeum vulgare
MAGPAKASWMVAMSVGAVEALKDQAGLCRWNYALRSIHRAAKANVRGGVVHGPKQLPASPAERRRAETDEEGLRTVMYLSCWGPN

SEQ ID NO: 3708 - protein, 86 aa, Triticum aestivum
MAAPAKASWMVAMSVGAVEALKDQAGLCRWNYALRSIHRAAKASVRGGVSHGKKQLPATAVVETWRAEKAEEGLRTVMYLSCWGPN

SEQ ID NO: 3709 - protein, 81 aa, Panicum virgatum
MAGAAKASWMVAMSVGAVEALKDQAGLCRWNYALRSVHRAAKANAPSFAQAKKLAAAERRRADKAEEGMRTVMYLSCWGPN

SEQ ID NO: 3710 - protein, 82 aa, Pennisetum glaucum
MAAAAKASWMVAMSVGAVEALKDQVGLCRWNYALRSIHRAAKANAPSLAQAKKLAPAAERRRADKAEEGMRTVMYLSCWGPN

SEQ ID NO: 3711 - protein, 81 aa, Pennisetum glaucum
MAGAAKASWMVAMSVGAVEALKDQAGLCRWNYALRSIHRAAKANAPSFAQAKKLAPAAGRRADKAEEGMRTVMYLSCWGPN

SEQ ID NO: 3712 - protein, 81 aa, Triticum aestivum
MVAMSVGAVEALKDQAGLCRWNYALRSIHRSTKAKANVPGGASQVKKQLPASAAAVAERRRARKAEEGLRTVVYLSCWGLN

SEQ ID NO: 3713 - protein, 90 aa, Hordeum vulgare
MTSAAKASWMMAMSLGAVEALKDQAGLCRWNYALRSIHRAAKAKANVRGGVSQGAKQLPASSAAEAEKRRAKKAEEGLRTVMYLSCWGPN

SEQ ID NO: 3714 - protein, 85 aa, Hordeum vulgare
MAGAAKASWMVAMSVGAVEALKDQAGLCRWNYALKSIQRAAKARANVRASVSQGKKQLPASASAMAEKAEEGLRTVMYLSCWGPN

SEQ ID NO: 3715 - protein, 85 aa, Setaria italica
MAGAAKASWMVAMSVGAVEALKDQAGLCRWNYALRSVHRNAKANVRSLAQAKKMAPAATAAERRRADKAEEGMRTVMYLSCWGPN

SEQ ID NO: 3716 - protein, 81 aa, Saccharum officinarum
MAGAAKASWMVAMSVGAVEALKDQAGLCRWNYALRSLHRTAKANAPSFAQAKKLAPAERRRADKAEEGMRTVMYLSCWGPN

SEQ ID NO: 3717 - protein, 85 aa, Panicum virgatum
MSGAAKASLMVAMSVGAVEALKDQAGLCRWNYALRSVHRAAKASAPSFAQAKKLAPAAAAAERRRADKAEEGMRTVMFLSCWGPN

SEQ ID NO: 3718 - protein, 82 aa, Sorghum bicolor
MAAAAKASWMVAMSVGAVEALKDQAGLCRWNYALRSIHQAAKANAPSFAQAKKKLAPAERRRADKAEEGMRTVMYLSCWGPN

SEQ ID NO: 3719 - protein, 81 aa, Saccharum officinarum
MAAAAKASWMVAMSVGAVEALKDQAGLCRWNYALRSIHRAAKANAPSFAQAKKLAPAEKRRADKAEEGMRTVMYLSCWGPN

SEQ ID NO: 3720 - protein, 90 aa, Hordeum vulgare
MAAPAKASWMVAMSVGAVEALKDQAGLCRWNYALKSIHRAAKARTNVCGGASRGAKQRPASAAAVAEKRRAEKGEEGMRTVMYLSCWGPN

SEQ ID NO: 3721 - protein, 90 aa, Triticum aestivum
MAAPAKASWMVATSVGTVEALKDQAGLCRWNYALSSIHRAAKARTNVCGGASQGTKQLSASAAAVAERRRVEKADEGLRTVMYLSCWGPN

SEQ ID NO: 3722 - protein, 90 aa, Triticum aestivum
MAIAAKASWMVAMSVGTVEALKDQARLCRWNYALRSIHRAAKAKATVRGGVSLGTEQLLASTAAVAERRRATKAEEGLRTVMYLSCRGPN

SEQ ID NO: 3723 - protein, 130 aa, Oryza sativa
MDHHQHHEQQQQRMVEMRMGMAMGEAYVGGGEVVAREAAAQALGAVVQLHFDKTLEKKRAADAQKQELWRLFLAFFLFLAILLSAVAQSPPSRLQCRHLWAPAGLLSLAHLAFYAAVAHHLRCLNGFRSL

SEQ ID NO: 3724 - protein, 229 aa, Oryza sativa
MVVPVINFSKLDGTAAERAETMAQIDNGCEEWGFFQLVNHGVPKELLDRVKKLPTPGGGVHGVEPVRTLEGLMAAERRGEAAAPVDDMDWEDIFYLHDDNQWPSKPPEFKETMREYRAALRGLAERVMEAMDENLGLDKGRMRRAFTGDGRHAPFFGTKVSHYPPCPRPDLITGLRAHTDAGGVILLFQDDRVGGLQVLRGGEWVDVQPLADAIVVNTGNQVEVLSNGR

SEQ ID NO: 3725 - protein, 308 aa, Hordeum vulgare
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGQWLDVQPLPDAIVVNTGDQVEVLSNGRYRSAWHRVLPMRNGNRRSIASFYNPAFEAAISPAVGEGGAAAYPDYVFGDYMDVYNKQKFDAKEPRFEAVKAPKSA

SEQ ID NO: 3726 - protein, 308 aa, Triticum aestivum
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKSA

SEQ ID NO: 3727 - protein, 308 aa, Leymus cinereus x Leymus triticoides
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEAAISPAVGEGGGAAYPDYMFGDYMDVYNKQKFDAKEPRFEAVKTPKSA

SEQ ID NO: 3728 - protein, 308 aa, Triticum aestivum
MVVPVIDFSKLDRVERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEAAISPAVGEGGATAYPDYVFGDYMDVYNKQKFDAKEPRFEAVKAPKAA

SEQ ID NO: 3729 - protein, 308 aa, Triticum aestivum
MVVPVIDFSKLDGAERAETMAQIADGCENWGFFQLVNHGIPLELLDRVKKVCSESYRLREAAFRSSEPVQTLERLVDAERRGEPVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEAAISPAVGEGRAAAYPDYVFGDYMDVYNKQKFNAKEPRFEAVKAPKAA

SEQ ID NO: 3730 - protein, 308 aa, Triticum aestivum
MVVPVIDFSKLDGAERAETMAQIADGCENWGFFQLVNHGIPLELLDRVKKVCSESYRLREAAFRSSEPVQTLERLVETERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKAA

SEQ ID NO: 3731 - protein, 308 aa, Leymus cinereus x Leymus triticoides
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLVTGLRAHTDAGGVILLFQDDKVGGLEVLKDGEWLDVQPLADAIVVNTGDQVEVLSNGRYRSAWHRVLPMRNGNRRSIASFYNPAFEAAISPAVGENGAAAYPDYVFGDYMDVYNKQKFEAKEPRFEAVKAPKAA

SEQ ID NO: 3732 - protein, 308 aa, Hordeum vulgare
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRSELKKLAERVMEAMDENLGLDKGRMKAAFTGDGLHAPFFGTKVSHYPPCPRPDLITGLRAHTDAGGVILLFQDDKVGGLEVLKDGQWLDVQPLADAIVVNTGDQVEVLSNGRYRSAWHRVLPMRNGNRRSIASFYNPAFEAAISPAVGEAGAAEYPDYVFGDYMDVYNKQKFEAKEPRFEAVKAPKAA

SEQ ID NO: 3733 - protein, 308 aa, Triticum aestivum
MVVPVIDFSKLDGAERAETMAQIADGCENWGFFQLVNHGIPLELLDCVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLLAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKAA

SEQ ID NO: 3734 - protein, 308 aa, Pseudoroegneria spicata
MVVPVIDFSKLDGSERAETMAQIADGCENWGFFQLVNHGIPLELLDRVKKVCSESYRLREAAFRSSEPVQTLERLVEEERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKAA

SEQ ID NO: 3735 - protein, 308 aa, Triticum aestivum
MVVPVIDFSKLHGAERAETMAQIADGCENWGFFQLVNHGIPLELLDRVKKVCSESYRLREAAFRSSEPVQTLERLAEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEVAISPAVGEGAAAAYPDYVFGDYMDVYNKQKFEAKEPRFEAVKAPKAA

SEQ ID NO: 3736 - protein, 308 aa, Hordeum vulgare
MVVPVIDFSKLDGAERAETMAQIADGCENWGFFQLVNHGIPLELLDRVKKVCSESYRLREAAFRSSKPVQTLERLVEAERRGEAVAPVDDMDWEDIFYLHDNNQWPSDPPAFKETMREYRSELKKLAERVMEAMDENLGLDKGRMKAAFTGDGLHAPFFGTKVSHYPPCPRPDLITGLRAHTDAGGVILLFQDDKVGGLEVLKDGQWLDVQPLADAIVVNTGDQVEVLSNGRYRSAWHRVLPMRNGNRRSIASFYNPAFEAAISPAVGEAGAAEYPDYVFGDYMDVYNKQKFEAKEPRFEAVKAPKAA

SEQ ID NO: 3737 - protein, 312 aa, Avena sativa
MVVPVIDFSKLDGAERAETMAQIADGCENWGFFQLVNHGIPLELLDRVKKVCSESYRLREAAFRVSEPVRTLEALVEAERRGEAVAPVDDMDWEDIFYLHDDNQWPSDPPAFKETMREYRAELKKLAERVMEAMDENLGLDKGRMKAAFTADGQHAPFFGTKVSHYPPCPRPDLVTGLRAHTDAGGVILLFQDDKVGGLEVLKDGQWLDVQPLADAIVVNTGDQVEVLSNGRYRSAWHRVLPMRNGNRRSIASFYNPAFEASISPAVSDQGGAASAYPEFVFGDYMDVYSKHKFEAKEPRFEAVKAPKTASA

SEQ ID NO: 3738 - protein, 312 aa, Avena sativa
MVVPVIDFSKLDGAERAETMAQIADGCENWGFFQLVNHGIPLELLDRVKKVCSESYRLREAAFRVSEPVRTLEALVEAERRGEAVAPVDDMDWEDIFYLHDDNQWPSDPPAFKETMREYRAELKKLAERVMEAMDENLGLDKGRMKAAFTADGLHAPFFGTKVSHYPPCPRPDLVTGLRAHTDAGGVILLFQDDKVGGLEVLKDGEWLDVQPLADAIVVNTGDQVEVLSNGRYRSAWHRVLPMRNANRRSIASFYNPAFEATISPAVPEGGAAASAYPEFVFGDYMDVYNQHKFEAKEPRFEAVKAPKTAEA

SEQ ID NO: 3739 - protein, 311 aa, Avena sativa
MVVPVIDFSKLDGAERAETMAQIADGCENWGFFQLVNHGIPLELLDRVKKVCSESYRLREAAFRVSEPVRTLEALVEAERRGEAVAPVDDMDWEDIFYLHDDNQWPSDPPAFKETMREYRAELKKLAERVMEAMDENLGLDKGRMKAAFTSDGLHAPFFGTKVSHYPPCPRPDLVTGLRAHTDAGGVILLFQDDKVGGLEVLKDGEWLDVQPLVDAIVVNTGDQVEVLSNGRYRSAWHRVLPMRNGNRRSIASFYNPAFEASISPAVAEGAAASAYPEFVFGDYMDVYSKHKFEAKEPRFEAVKAPKTASA

SEQ ID NO: 3740 - protein, 311 aa, Brachypodium distachyon
MVVPVIDFSKLDGAERAETMAQIADGCENWGFFQLVNHGIPTELLERVKKVCSESYRLREAAFRSSEPVRTLEALVEAERRGEAAAPVDDMDWEDIFYLHDDTQSWPSSPPGFKETMHEYRAELKKLAERVMEAMDDNLGLETGRIKAAFTGHGRHAPCFGTKVSHYPPCPRPDLVTGLRAHTDAGGVILLFQDDKVGGLEVLKGGEWLSVQPLADAIVVNTGDQIEVLSNGRYRSAWHRVLPMRDANRRSVASFYNPAFEAAISPAVAGAGGEYPESYVFGDYMDVYSKHKFEAKEPRFEAVKAPAKATA

SEQ ID NO: 3741 - protein, 312 aa, Avena sativa
MVVPVIDFSKLDGAERAETMAQIADGCENWGFFQLVNHGIPLELLDRVKKVCSESYRLREAAFRVSEPVRTLEALVEAERRGEAVAPVDDMDWEDIFYLHDDNKWPSDPPAFKETMREYRAELKKLAERVMEAMDENLGLDKGRMKAAFTADGLHAPFFGTKVSHYPPCPRPDLVTGLRAHTDAGGVILLFQDDKVGGLEVLKDGEWLDVQPLEDAIVVNTGDQVEVLSNGRYRSAWHRVLPMRNANRRSIASFYNPAFEATISPAVPEGGAAASAYPEFVFGDYMDVYNQHKFEAKEPRFEAVKAPKTAEA

SEQ ID NO: 3742 - protein, 311 aa, Brachypodium distachyon
MVVPVIDFSKLDGAERAETMAKIADGCENWGFFQLVNHGIPTELLERVKKVCSESYRLREAAFRVSEPVRTLEALVEAERRGEAAAPVDDMDWEDIFYLHDDTQSWPSSPPGFKETMHEYRAELKKLAERVMEAMDDNLGLETGRIKAAFTGHGRHAPFFGTKVSHYPPCPRPDLVTGLRAHTDAGGVILLFQDDKVGGLEVLKDGEWLAVQPLADAIVVNTGDQIEVLSNGRYRSAWHRVLPMRDANRRSVASFYNPAFEAAISPAVGGAGGEYPESYVFGDYMDVYSKHKFEAKEPRFEAVKAPAKATA

SEQ ID NO: 3743 - protein, 316 aa, Sorghum bicolor
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 3744 - protein, 314 aa, Zea mays
MVVPVIDFSKLDGAERAETLAQIANGCEEWGFFQLVNHGIPLELLERVKKVCSDCYRLREAGFKASEPVRTLEALVDAERRGEVVAPVDDLDWEDIFYIHDGCQWPSDPPAFKETMREYRAELRKLAERVMEAMDENLGLARGTIKDAFSGGGRHDPFFGTKVSHYPPCPRPDLITGLRAHTDAGGVILLFQDDKVGGLEVLKDGEWTDVQPLEGAIVVNTGDQIEVLSNGLYRSAWHRVLPMRDGNRRSIASFYNPANEATISPAAVQASGGDAYPKYLFGDYMDVYVKQKFQAKEPRFEAVKTGAPKSSPAA

SEQ ID NO: 3745 - protein, 316 aa, Sorghum bicolor
MVVPVIDFSKLELDGAERAETLEQIANGCEAWGFFQLVNHGIPLELLERVKKVCSDCYRLREAGFKASEPVRTLEALVAAEQRGEEVAPVDDLDWEDIFYIHDGCQWPSDPPAFKETMREYRAELRKLAERVMEAMDENLGLDRGTIKAAFSGDGRREPFFGTKVSHYPPCPRPDLITGLRAHTDAGGVILLFQDDRVGGLEVLKDGQWTDVQPLAGAIVVNTGDQIEVLSNGRYRSAWHRVLPMRDGNRRSIASFYNPANEATISPAAVATSGGAAYPKYMFGDYMDVYVKQKFQAKEPRFEAVKAAAPKSSPAA

SEQ ID NO: 3746 - protein, 314 aa, Zea mays
MVVPVIDFSKLDGAERAETLAQIANGCEEWGFFQLVNHGIPLELLERVKKVSSDCYRLREAGFKASEPVRTLEALVDAERRGEVVAPVDDLDWEDIFYIHDGCQWPSEPPAFKETMREYRAELRKLAERVMEAMDENLGLARGTIKDAFSSGGRHEPFFGTKVSHYPPCPRPDLITGLRAHTDAGGVILLFQDDRVGGLEVLKDGQWTDVQPLAGAIVVNTGDQIEVLSNGRYRSAWHRVLPMRDGNRRSIASFYNPANEATISPAAVQASGGDAYPKYVFGDYMDVYAKHKFQAKEPRFEAVKVAAPKSSPAA

SEQ ID NO: 3747 - protein, 501 aa, Triticum aestivum
  misc_feature (142)..(142): Xaa can be any naturally occurring amino acid
PPLTTVHTHTQSALPPPGTLAFLHQFSTPARPPARSQNPTNTPSPTPNSPPAARPQRPRASRPAGSPSDLISPIAGESLDGSFGAGNVNCRKEQLFTFWYCMMNGSTGSLGDHVNGKQVQSVDPPGLSSFNNGPRHRPLNAXRRCRGVLCLVIMPVTACMMMVYLAPVTTFVVRLFSVHYSRKWTCFLFGMWLAMFPFLFEKINRTRFVFSGEKVPPKECVLLFANHRTEVDWMYLWDLALRKGRLQSIKYILKKSLMKLPIFNWAFHIIEFIPVERNWEVDEPLIRRRLSQLKYPKDPLWLAVFPEGTDYTEKKCIKSQEYAAEHGLPILKNVLLPKIKGFNCCLQELRSNLDAVYDITIAYKHRLPTFMDNVYGIDPSEVHVHTKIIQVCDIPTAEDEVSSWLTERFRLKDELLSDFLAQGHFPNEGTEEDLSTLKCVANFLAVIGMTAFFIYLTLFSSVWFRVFAACSASFLTFATVYSIHAPQIVCLPEAGAHAKKA

SEQ ID NO: 3748 - protein, 1155 aa, Zea mays
MDDVCEGKDFSFPEQEERVLELWAKLDAFHEQLRRTEGGEEFVFYDGPPFATGLPHYGHILAGTIKDVVTRHQSMRGRHVSRRFGWDCHGLPVEFEIDKLLGITNRQQVFDLGIGKYNETCRSIVTKYVSEWEAMVTRTGRWIDFKNDYKTMDLNFMESVWWVFAQLWEKDLVYKGFKVMPYSTGCKTALSNFEAALDYRTVPDPAVMVSFPIVGDMDNAAFVAWTTTPWTLPSNLALCINANLMYAKVRDKSNGKVYVIAESRLGQLPVKAKASGKKQAPSKGSNAEAAQDGLDKESYELLVKIPGPYLVGLKYTPLFDFFIELQETAFRVIADNYVTDDSGTGVVHCAPAFGEDDHRVCLAAGIFETAGLVVAVDDDGCFIEKISDFKGRYVKEADKDIISADKGRLVSKGSIEHSYPFCWRSGTPLIYRAVPSWFVKVEKIKDQLLECNKETYWVPDYVKEKRFHNWLEGARDWAISRSRFWGTPLPLWMSQDRKEIVVMDSIEKLEKLSGVKVTDLHRHYVDDITIPSKRGPKFGTLKRVDDVFDCWFESGSMPYAYIHYPFENRELFEKNFPGNFVAEGLDQTRGWFYTLMVLSTALFGKPAFKNLICNGLVLAEDGKKMSKSKKNYPSPKDLIDEFGADSLRLYLVNSPVVRAESLRFKRTGVFAVVKDVFLPWYNAYRFFVQNAKRLEVEGLASFSPMEQAVLLKSSNVLDHWINSATESLVVPYLVKYIDYLTNIYVRLNRKRFKGRTGEEDCRISLSTLYHVLVTTCVVMAPFTPFFTEVLYQNLRKVSSKSEESIHFCKFPSTTGERDERVEQSVNRMVTIIDLARNIRERHNKALKTPLKEMVVVHPDNDFLEDITGKLKEYVMEEINVKTVTPCNDPLMYASLRAEPNFSVLGKRLGKDMGKVSNVVKKMTQEQILDFEKSGEISFFGHCLKLDDIKVVRQFKRPENVSEKEIDAAGDGDVLVILDLRADQSLFEAGVAREVVNRIQKLRKTAQLEPADPVDVYYESVGSDKNTLEEILKSQDQYIRDALGSPIMPKEMAPTDDVILGEESHNVHDMSFVICIARSTPILAPDLLSHASGKSNHVEALRVYLLSRSLSRLKNQFQAGKGMITVDCIEGYPPVSLLLGKHVFLSAGDFYLASRS

SEQ ID NO: 3749 - protein, 979 aa, Zea mays
MLVMPYSTGCKTALSNFEAALDYRTVPDPAVMVSFPIVGDADNAALVAWTTTPWTLPSNLALCVNANLTYAKVKDKSNGAVYVIAESRLGQLPVKAKASGKKQAPSKGSNIEAVQDGLDKESYELLSKIPGVSLVGLKYTPLFDFFIELQGTAFRVIADNYVTDDSGTGVVHCAPAFGEDDHRVCLAAGIFETAGLVVAVDDDGCFIEKISDFKGRYVKEADKDIINADKGRLISKGSIEHSYPFCWRSGTPLIYRAVPSWFVKVEKIKDQLLECNKETYWVPDYVKEKRFHNWLEGARDWAVSRSRFWGTPLPLWISQDGEEIVVMDSIEKLEKLSGVKVTDLHRHYVDDITIPSKRGPEFGVLKRVDDVFDCWFESGSMPYAYIHYPFENRELFEKNFPGNFVAEGLDQTRGWFYTLMVLSTALFGKPAFKNLICNGLVLAEDGKKMSKSKKNYPPPKDLIDEFGADALRLYLVNSPVVRAESLRFKRTGVFAVVKDVFLPWYNAYRFFVQNAKRLEVEGLASFSPMEQVVLLKSSNVLDHWINSATESLVVPYLVKYIDYLTNIYVRLNRKRFKGRTGEEDCRISLSTLYHVLVTTCVVMAPFTPFFTEVLYQNLRKVSSNSEESIHFCKFPSTTGERDERVEQSVKRMVTIIDLARNIRERHNKALKTPLKEMVVVHPDNDFLEDITGKLKEYVMEEINVKNVTPCNDPLMYASLRAEPNFSVLGKRLGKDMGKVSNVVKKMTQEQILAFEKSGEVSFFGHCLKLDDIKVVRQFKRPENVSEKEIDAAGDGDVLVILDLRTDQSLFEAGVAREVVNRIQKLRKTAQLEPADPVDVYYESVGNDKNTLEEILKSQDQYIRDALGSPIVPKEMAPTDVVVLGEESHNVHDMSFVICIARSTPIISPDLLSHASGNSNHVEALRVYLLSKSLSRLKNQFQSGNGVITVDCIEGYPLIRLQLGKHVFLSAGDFYLASRS

SEQ ID NO: 3750 - protein, 1079 aa, Sorghum bicolor
MDDVCEGKDFSFPEQEERVLQLWAKLDAFHEQLRRTEGGEEFVFYDGPPFATGLPHYGHILAGTIKDVVTRHQSMWGRHVSRRFGWDCHGLPVEFEIDSSLGITNRQQVLDLGIGKYNEACRSIVTKYVSEWEAVVTRSGRWIDFKDGYKTMDLNFMESVWWVFAQLWEKDLIYKGFKVMPYSTGCKTALSNFEATKEHRTVHDLAVMVSFPIVGDVDNSALVAWTTTPWTLPSNLALCVNANLTYAKVKDKSNGAVYIIAESRLGQLPVKAKASGKKQTPSKGSNTEAVQDGLDKESYELLAKIPGSSLVGLKYTPLFDFFIELQETAFRVIADNYVMDDSGTGVVHCAPAFGEDDHRVCLASGIIETAGLVVAVDDDGCFIEKISDFKGRYVKEADKDIISAVKDKGRLVSKGSIEHSYPFCWRSGTPLIYRAVPSWFVKVEKIKDQLLECNKETYWVPDFVKEKRFHNWLEGARDWAVSRTRFWGTPLPLWMSQDGEEIVVMDSIEKLEKLSGVKVTDLHRHYVDDITIPSNRGPEFGVLKRVDDVFDCWFESGSMPYAYIHYPFENQELFEKNFPGNFVAEGLDQTRGWFYTLMVLSTALFGKPAFKNLICNGLVLAEDGKKMSKSKNNYPSPKGLIDKYGADSLRLYLINSPVVRAESLRFKSSGVYDVVKYVFLPWYNAYRFFVQNAKRLELEGLASFSPMEQAVVPYLVKYIDSLTNIYVRLNRKRFKGRTGDEDCRVSLSTLYHVLVTTCVVMAPFTPFFTEVLYQNLRKVSSKSEESIHFCKFPSTTGERDDRVEQSVNRMVTIIDLARNIRERHNKALKTPLKEMVVVHPDIQFLEDITGKLEEYVMEEVNVKTVTPCNDPLMYASLRAEPNFSALGKRLGKDMGKVANVVKKMTQEQILAFEKCGEISFFGHCLKVDDIKVVRQFKRPENVSEKEIDAAGDGDVLVILDLRTDQSLFEAGVAREVVNRIQKLRKTAQLKPTDPVDVYYESVGNDKNTLEEILKSQGQYVRDTLGSPIIPKEMAPRDVVVLGEESHNVHDMSFVICIARSTPILSPDLLPNASAIMWRH

SEQ ID NO: 3751 - protein, 294 aa, Sorghum bicolor
MEKPRQVVRKFLARPQHEGVGAVVRRSIGRFELRYFDPFLVLDEFSVSAPAGFPDHPHRGFETVTYMLEGAVTHEDFEGHRGTIKAGDVQWMTAGRGIVHSEMPAGPGTSKGLQLWVNLSSGNKMVEPGYQEIQSKDIACTSADGVTVRVIAGHAMGVRSPVCTRTPTMYLDFTVRPRGVVRQPVLASWNAFAYVLEGEGVFGAERGAPVGAHHLLLLGQGDGVEVWNRSDDRPLRFLLIAGEPIGEPVAQLGPFVMNTEEEIDMTVNDFECYANGFEKARHWKSQAMVALGVE

SEQ ID NO: 3752 - protein, 304 aa, Brachypodium distachyon
MEKPRQVVRKFLARPQHEGAGAVVRRSIGRFELRYFDPFLVLDEFSVSAPAGFPDHPHRGFETVTYMLEGAVTHEDFEGHRGTIKAGDVQWMTAGRGIVHSEMPAAPGTSRGLQLWVNLSSQNKMIEPRYQEMQSKDIASTTSSDGVTVRVVAGHSMGARSPVCTRTPTMYLDFTVRPHAAARQPVPASWNAFAYVLEGEGVFAGGGAAEAADSSSSSKAGPHHLLLLGLQGDGVEVWNKSDKPLRFLLIAGEPIGEPVVQLGPFVMNTEEEIDAAVNDFEYCVNGFEKAKHWKSQAMVALEVE

SEQ ID NO: 3753 - protein, 229 aa, Pennisetum glaucum
MLEGAVTHEDFEGHRGTIKAGDVQWMTAGRGIVHSEMPAGPGTSKGLQLWVNLSSGNKMIEPGYQEIQSKDIACTSADGVTVRVIAGHAMGARSPVRTRTPTMYLDFTVRPRAAAVRQPVPPSWNAFVYVLEGEGVFGSERSAPVGAHHILFLGQGDGLEAWNKSADRPLRFLLIAGEPIGEPVAQLGPFVMNTEEEIDMTVDDFERYANGFEKARHWKSQAMVALGVE

SEQ ID NO: 3754 - protein, 296 aa, Zea mays
MEKPRQVARKFLARPQHEGAGAVVRRSIGRFELRYFDPFLVLDEFTVSAPAGFPDHPHRGFETVTYMLEGAVTHEDFEGHRGTIKAGDVQWMTAGRGIVHSEMPAGPGTSRGLQLWVNLSSANKMVEPGYQEIQSKDIACTSDGDGGVTVRVIAGHAMGVRSPVRTRTPTMYLDFTVRPRGAVRQPVRASWNAFAYVLEGEGVFGAERCAPVGAHHLLLLGHGDGLEVWNKLPDRPLRFLLVAGEPIGEPVAQLGPFVMNTEEEIDMTVNDFECYANGFEKARHWKSQAMLALGVE

SEQ ID NO: 3755 - protein, 334 aa, Brachypodium distachyon
MASLLRLQALSLTLNTPRCLPFHLRLAAAAGAPLARRISAAASNGSPEQRASETDLESGLYLVATPIGNLEDITLRALRVLKCADVILSEDTRHSGKLLQHYNIKTPLLSFHKFNEREREPSILKRIHEGEAVAVISDAGTPGISDPGMELARLCATEKIPVIPIPGPSAAMAALSASGLPTDEFTFVGFLPKHGRSRKDRLELSAREAATQIFYVPPHGIHQFLVDAASSFGDSRPCVIAREITKLHEEFWRGTLGGANEAFATRQPKGEITVLIEGNSISVDETPSEDFLEHELKELMAKGHALSTAVKLVADATSAKKKDVYALALRVFGK

SEQ ID NO: 3756 - protein, 333 aa, Panicum virgatum
LLRLQAFAPALNVPRNRCFLSPLGLASAATAPLARRLSTAASTSSPVPPSSEPNLESGLYLVATPIGNLEDITLRALRVLKCANVILSEDTRHSGKLLQHYNIKTPLLSFHKFNEREREPSILRRLQEGEAVALISDAGTPGISDPGMELARLCAAEKISVVPIPGPSAAIAALSASGLPSNEFTFVGFLPKHARSRRDRLEISAREAATQIFYVPPHGIHQFLVDAASSFGDSRSCVIAREITKLHEEFWRGTLGEANEAFATRQPKGEITVLIEGQLISVDETPSEDFLEHELRELMAKGHTLSAAVKLVTEATSAKKKDVYALALRLFGK

SEQ ID NO: 3757 - protein, 335 aa, Triticum aestivum
MASLLRLQALFSLTLATPRRLPSHLRCAAAVASPLPRRLPAAASNGSPEQRASETDLESGLYLVATPIGNLEDITLRALRVLKCAHVILSEDTRHSGKLLQHYNIKTPLLSFHKFNEREREPIILKRLHEGEAIAVISDAGTPGISDPGMELARLCATEKIPVIPIPGPSAAIAALSASGLPTEEFTFVGFLPKHGRSRKARLEVSAREAVTQIFYVPPHGIHQFLLDAASSFGDSRSCVIAREITKLHEEFWRGTLGEANEAFASRQPKGEITILIDGNSVSIDETPSDDFLEHELRELMAKGHALSTAVKLVAEATSAKKKDVYALALRVFGK

SEQ ID NO: 3758 - protein, 335 aa, Hordeum vulgare
MASLLRLQALFSLTLATPRCLPSHLRCVAAVASPVPSRLPAAASNGSPEQRASETTLESGLYLVATPIGNLEDITLRALRVLKCACVILSEDTRHSGKLLQHYNIKTPLLSFHKFNEREREPIILKRLHEGEAIAVISDAGTPGISDPGMELARLCMTEKIPVIPIPGPSAAIAALSASGLPTEEFTFVGFLPKHGRSRKARLEVSAREAVTQIFYVPPHGIQQFLVDAASSFGDSRSCVIAREITKLHEEFWRGTLGEANEAFATRQPKGEITILIDGNSISIVEKPSDDFLEHELRELMAKGHALSTAVKLVAEATSAKKKDVYALALRVFGK

SEQ ID NO: 3759 - protein, 130 aa, Sorghum bicolor
MEVPMNSTQSGAHFPVQHRSFSLDIKGNKTDIVISKYEDTFLVIVTQIGCMGTILAAKKDESVFSDPTYNVSVLFGKRDEPLLVACARQLIEHISGSGSARSLVISLGLKDHSQGTLKDIIVAVIENRLW

SEQ ID NO: 3760 - protein, 337 aa, Zea mays
MTVPRHHFLISPLRLASAATVPFARRFSNAASSNKPEPLLSEPDLESGLYLVSTPIGNLEDITLRALRVLKCANVILSEDTRHSGKLLQHYNIKTPLLSFHKFNEREREPTILRRLHEGEAVALISDAGTPGISDPGMELARLCATEKIPVIPIPGPSAAIAALSASGLPSNEFTFVVRNYWGQFIFSILVGFLPKHARSRRDRLEISAREAATQIFYVPPHGIQQFLVDAASSFGDSRHCVVAREITKIHEEFWRGTLGEANEAFATRQPKGEITVLIEGKLISDDEIPSEDFLEHELRELTAKGYTLSAAVKLVTEATSAKKKDVYALALRLFGK

SEQ ID NO: 3761 - protein, 1016 aa, Zea mays
MSARIEGGTFSSDSTQSPIWTCCPVTTPPFIDLSPGETLKSGVVEKQIDSALTLALESQTRALLSELDKRLQILDNKWESRVSTLESKATEAAQSLSEFSGTHRANVEAHLTAADASTDTKIGQIEADLGYRVAALESTVGEDLHSSMDWLRSEVSKMEIQWSRGARANDFHMSGVLGAHGSTPGRSSVAGDVVDISRFGHRNDAHHRDSGPWHPNADARYPVTVCRTTTSIHVMATILPVMLSVLTIAAMTWMEVVVPNTVSSECADTIQLHAVQELWEIFYSEPHESEGEFEDSAKTFMILLSTEAMSTKKAPSRSFRLQGQLQGYQPLVPASTILEVWPVPELQDTSAQLNCVEDMSLPKPISHLLHSYEDLFQPLTTLPPSRSCDHSIPLIDGARPVSIRPYRFSPALKDEIESQRAMNHTLAPLLRKCALVFFDDILVYNASLNEHISHLEQVFELLSADDWKELRSFLGLADYYHKFIRHFGIICQPLTALLKKGVLYIWTSDHTCAFHTLKTALTQAPVLSLLDFASPFFIETDASAVGVSAVLMQHCHPLAFPSKVLGPKSHGLSTYEKEYLTVILPVQQWRYYHENAIRRSRTSLSLLRLVTSACTFAMFWFAICFFRRSTEGGSAAATESKRLLRLAGPLVLSFILRNAVQMVSVMFVGHLGKLPLAGASLASSLANVTGFSLVAGMAGALDTLCGQAFGARRYALLGVYKQRSMLVLALASLPVVLTWVFVEQLLLAIGEDPDIAAEAGAYARWLIPSLAAFVPLTCHMRFLQTQSVVVPVMASSGVTALAHVLLCYTLVYKVGMGSKGAALGAAVSYSVNLAVLALYVRLSSACKATWTGFSTEAFSFSGLREYAKLAVPSAMMVCLEWWSFELLVLLSGFLPNPKLETSVLSICVNTAILLYMVPLGLGTSARCSTIRAEQKIGCGKQKIGARVNLGAFYMVGIPTGLLLAFVFNLNGMGLWLGIVCGSISKLALLLWIALRIDWESEAIKAKDRVLRSSGQT

SEQ ID NO: 3762 - protein, 210 aa, Panicum virgatum
ASAAGAVTFDATNTASSTPGGRRFDQAVGLGYAKRVLSDASTFIWSTFNQRSAAGRKPVDAVTLVVEDIDGVAFTSANGIHLSARYVGGYSSGDVQAEVTGVLYHEATHVWQWDGRGRANGGLIEGIADYVRLKAGYAPGHWVKPGQGDRWDQGYDVTARFLDYCDSLKPGFVALLNAKMKDGYSDDFFAQITGKSVQQLWQDYKKKYGG

SEQ ID NO: 3763 - protein, 72 aa, Oryza sativa
MIIPVRCFTCGKVIGNKWDLYLDLLQADYTEGDALDALGLVRYCCRRMLMTHVDLIEKLLNYNTLEKTETAG

SEQ ID NO: 3764 - protein, 93 aa, Avena sativa
  misc_feature (16)..(16): Xaa can be any naturally occurring amino acid
SARGNPSSPFLLVSGXVVAASKMIIPVRCFTCGKVIGNKWDHYLDLLQADYTEGDALDALGLVRYCCRRMLMTHVDLIEKLLNYNTLEKTETT

SEQ ID NO: 3765 - protein, 71 aa, Avena sativa
MIIPVRCFTCGKVIGNKWDHYLDLLQADYTEGDALDALGLVRYCCRRMLMTHVDLIEKLLNYNTLEKTETT

SEQ ID NO: 3766 - protein, 130 aa, Gossypium hirsutum
  misc_feature (102)..(102): Xaa can be any naturally occurring amino acid
  misc_feature (113)..(113): Xaa can be any naturally occurring amino acid
MASTFLALPKTFTSNKPTFSSLSTHKLPGTRRNSLRINAVATKWEPTKVVPQADRVLIRLQELPEKSAGGVLLPKSAVKFERYLMGEIVSVGAEVGNVETGXKVLFSDIMLMXWIWEQILSMCFVKRVTC

SEQ ID NO: 3767 - protein, 91 aa, Ananas comosus
PTNSRRVSIRHSQRRSEEAKMIIPVRCFTCGKVIGNKWDTYLDLLQADYTEGDALDALGLVRYCCRRMLMTHVDLIEKLLNYNTLEKTEPS

SEQ ID NO: 3768 - protein, 104 aa, Triticum aestivum
TFPFADPRLRLKTLVPLSFSSGGGGKGGGGGSKMIIPVRCFTCGKVIGNKWDHYLDLLQADYTEGDALDALGLVRYCCRRMLMTHVDLIEKLLNYNTLEKTETS

SEQ ID NO: 3769 - protein, 84 aa, Triticum aestivum
SSGGGKGGGGGSKMIIPVRCFTCGKVIGNKWDHYLDLLQADYTEGDALDALGLVRYCCRRMLMTHVDLIEKLLNYNTLEKTETS

SEQ ID NO: 3770 - protein, 102 aa, Triticum aestivum
HTLTLTDPRLRPKTLVPLSFSSGGGGGGGSKMIIPVRCFTCGKVIGNKWDHYLDLLQADYTEGDALDALGLVRYCCRRMLMTHVDLIEKLLNYNTLEKTETS

SEQ ID NO: 3771 - protein, 71 aa, Unknown
  Sequence found in Organisms: Hordeum vulgare, Festuca arundinacea, Leymus cinereus x Leymus triticoides, Pseudoroegneria spicata, Triticum aestivum
MIIPVRCFTCGKVIGNKWDHYLDLLQADYTEGDALDALGLVRYCCRRMLMTHVDLIEKLLNYNTLEKTETS

SEQ ID NO: 3772 - protein, 71 aa, Brachypodium distachyon
MIIPVRCFTCGKVIGNKWDHYLDLLQADYTEGDALDALGLVRYCCRRMLMTHVDLIEKLLNYNTLEKTEAT

SEQ ID NO: 3773 - protein, 73 aa, Pennisetum glaucum
MIIPVRCFTCGKVIGNKWDQYLDLLQADYTEGDALDALELVRYCCRRMLMTHVDLIEKLLNYNTLEKTDTTAT

SEQ ID NO: 3774 - protein, 71 aa, Triticum aestivum
MIIPVRCFTCGKVIGNKWDHYLDLLQADYTEGDALDALGLVRYCCRRMLMTHVDLIEKLLNYNTLEKTETN

SEQ ID NO: 3775 - protein, 71 aa, Lolium multiflorum
MIIPVRCFTCGKVIGNKWDHYLDLLQADYTEGDALDALGLVRYCCRRMLMTHVDLIEKLLNYNTLEKTETA

SEQ ID NO: 3776 - protein, 71 aa, Aristolochia fimbriata
MIIPVRCFTCGKVIGNKWDTYLDLLQADYTEGDALDALGLVRYCCRRMLMTHVDLIEKLLNYNTLEKNETS

SEQ ID NO: 3777 - protein, 71 aa, Unknown
  Sequence found in Organisms: Gossypium hirsutum, Theobroma cacao, Vitis vinifera
MIIPVRCFTCGKVIGNKWDTYLDLLQADYTEGDALDALGLVRYCCRRMLMTHVDLIEKLLNYNTLEKSETS

SEQ ID NO: 3778 - protein, 71 aa, Curcuma longa
MIIPVRCFTCGKVIGNKWDTYLDLLQADYTEGDALDAVGLVRYCCRRMLMTHVDLIEKLLNYNTLEKTETS

SEQ ID NO: 3779 - protein, 71 aa, Cynodon dactylon
MIIPVRCFTCGKVIGNKWDMYLDLLQADYTEGDALDALNLVRYCCRRMLMTHVDLIEKLLNYNTLEKTETS

SEQ ID NO: 3780 - protein, 72 aa, Setaria italica
MIIPVRCFTCGKVIGNKWDHYLDLLQADYTEGDALDALDLVRYCCRRMLMTHVDLIEKLLNYNTLEKTDTTT

SEQ ID NO: 3781 - protein, 71 aa, Heritiera littoralis
MIIPVRCFTCGKVIGNKWDTYLDLLQADYTEGDALDALGLVRYCCRRMLMTHVDLIEKLLNYNTLEKSETN

SEQ ID NO: 3782 - protein, 71 aa, Ananas comosus
MIIPVRCFTCGKVIGNKWDTYLDLLQADYTEGDALDALGLVRYCCRRMLMTHVDLIEKLLNYNTLEKTEPS

SEQ ID NO: 3783 - protein, 71 aa, Panicum virgatum
MIIPVRCFTCGKVIGNKWDLYLDLLQADYTEGDALDALELVRYCCRRMLMTHVDLIEKLLNYNTLEKTDTN

SEQ ID NO: 3784 - protein, 71 aa, Musa acuminata
MIIPVRCFTCGKVIGNKWDTYLDLLQADYTEGDALDALGLVRYCCRRMLMTHVDLIEKLLNYNTLEKTESN

SEQ ID NO: 3785 - protein, 118 aa, Carthamus tinctorius
  misc_feature (74)..(75): Xaa can be any naturally occurring amino acid
  misc_feature (78)..(79): Xaa can be any naturally occurring amino acid
  misc_feature (81)..(81): Xaa can be any naturally occurring amino acid
MGRAPKGEKTNWVIHEFRLEGKLSLQNLPKSAKNDWVICRVFHKASGGKKFQFSGLSRMNSGGVVLGSLPPLMXXPVXXGXRMTNPSISESINVPCFSNPIEFPTTQKAMISNFLSNP

SEQ ID NO: 3786 - protein, 123 aa, Zingiber officinale
VGCRFLAYPRPTRRTPSISRRLFSGSSPHCAGFLSPVLPPFLFAKLSAVVEKMIIPVRCFTCGKVIGNKWDTYLDLLQADYTEGDALDAVGLVRYCCRRMLMTHVDLIEKLLNYNTLEKTETS

SEQ ID NO: 3787 - protein, 92 aa, Ipomoea nil
PPPSTDNSWETRADRVEREARMIIPVRCFTCGKVIGNKWDEYLDLLQADYTEGDALDALGLVRYCCRRMLMTHVDLIEKLLNYNTLEKAEGS

SEQ ID NO: 3788 - protein, 89 aa, Elaeis guineensis
YCERRDGSDFRSLRRNEEMIIPVRCFTCGKVIGNKWDTYLDLLQADYSEGDALDALGLVRYCCRRMLMTHVDLIEKLLNYNTLEKTDPN

SEQ ID NO: 3789 - protein, 310 aa, Zingiber officinale
MEREPVDDKIVAVHAAMGGGTGLNYFQKRFPEKCFDVGIAEQHAVTFAAGLAAEGLKPFCAIYSSFLQRGYDQVVHDVDLQKIPVRFALDRAGLVGADGPTHCGAFDITYMACLPNMIVMAPSDEAELMHMVATAAAIDDRPSCFRFPRGNGVGVPLPTGYKGTPLEVGKGRILMEGDRVAILGYGSIVQTCLQAADSLKTHGIFTTVADARFCKPLDVELIRRLVDEHEILITVEEGSIGGFGSHVAQFLGLNGLLDGHLKLRSIFLPDRYIDHGSPKDQVEAAGLSSEQIAGTVLNLLGKPKEALHLQ

SEQ ID NO: 3790 - protein, 85 aa, Helianthus annuus
GESIELVKAKLGQKMIIPVRCFTCGKVIGNKWDTYLDLLQSDYTEGDALDALGLVRYCCRRMLMTHVDLIEKLLNYNTLEKSDTN

SEQ ID NO: 3791 - protein, 71 aa, Unknown
  Sequence found in Organisms: Ipomoea nil, Ipomoea batatas, Ipomoea nil
MIIPVRCFTCGKVIGNKWDEYLDLLQADYTEGDALDALGLVRYCCRRMLMTHVDLIEKLLNYNTLEKAEGS

SEQ ID NO: 3792 - protein, 71 aa, Tropaeolum majus
MIIPVRCFTCGKVIGNKWDTYLDLLQADYSEGDALDALGLVRYCCRRMLMTHVDLIEKLLNYNTLEKSDTT

SEQ ID NO: 3793 - protein, 71 aa, Pinus taeda
MIIPVRCFTCGKVIGNKWDTYLDLLQADYTEGDALDALGLVRYCCRRMLMTHVDLIEKLLNYNTLERSETS

SEQ ID NO: 3794 - protein, 71 aa, Prunus persica
MIIPVRCFTCGKVIGNKWDTYLDLLQADYTEGDALDALGLVRYCCRRMLMTHVDLIEKLLNYNTLEKSENS

SEQ ID NO: 3795 - protein, 71 aa, Unknown
  Sequence found in Organisms: Coffea canephora, Populus trichocarpa, Camellia sinensis, Triphysaria pusilla
MIIPVRCFTCGKVIGNKWDTYLDLLQADYTEGDALDALGLVRYCCRRMLMTHVDLIEKLLNYNTLEKSEGS

SEQ ID NO: 3796 - protein, 74 aa, Zostera marina
MIIPVRCFTCGKVIGNKWDNYLDLLQADYSEGDALDALGLVRYCCRRMLMTHVDLIEKLLNYNTLEKNDPSANN

SEQ ID NO: 3797 - protein, 71 aa, Amborella trichopoda
  misc_feature (33)..(33): Xaa can be any naturally occurring amino acid
MIIPVRCFTCGKVIGNKWDTYLDLLQADYTEGXALDALGLVRYCCRRMLMTHVDLIEKLLNYNTLEKNETS

SEQ ID NO: 3798 - protein, 71 aa, Picea glauca
MIIPVRCFTCGKVIGNKWDTYLDLLQADYTEGDALDALGLVRYCCRRMLMTHVDLIEKLLNYNTLERSETN

SEQ ID NO: 3799 - protein, 71 aa, Unknown
  Sequence found in Organisms: Zea mays, Sorghum bicolor, Saccharum officinarum
MIIPVRCFTCGKVIGNKWDLYLDLLQADYSEGDALDALELFRYCCRRMLMTHVDLIEKLLNYNTLEKTETS

SEQ ID NO: 3800 - protein, 70 aa, Musa acuminata
MIIPVRCFTCGKVIGNKWDTYLDLLQADYTEGDALDALGLVRYCCRRMLMTHVDLIEKLLNYNTLEKTDS

SEQ ID NO: 3801 - protein, 71 aa, Catharanthus roseus
MIIPVRCFTCGKVIGNKWDSYLDLLQADYPEGDALDALGLVRYCCRRMLMTHVDLIEKLLNYNTLEKSEGT

SEQ ID NO: 3802 - protein, 71 aa, Unknown
  Sequence found in Organisms: Centaurea maculosa, Senecio madagascariensis
MIIPVRCFTCGKVIGNKWDTYLDLLQSDYTEGDALDALGLVRYCCRRMLMTHVDLIEKLLNYNTLEKSDTT

SEQ ID NO: 3803 - protein, 71 aa, Unknown
  Sequence found in Organisms: Artemisia annua, Taraxacum officinale, Senecio madagascariensis, Helianthus annuus
MIIPVRCFTCGKVIGNKWDTYLDLLQSDYTEGDALDALGLVRYCCRRMLMTHVDLIEKLLNYNTLEKSDTN

SEQ ID NO: 3804 - protein, 71 aa, Unknown
  Sequence found in Organisms: Ipomoea nil, Ipomoea nil
MIIPVRCFTCGKVIGNKWDEYLDLLQADYTEGDALDALGLVRYCCRRMLMTHVDLIEKLLNYNTLEKADGS

SEQ ID NO: 3805 - protein, 71 aa, Orobanche aegyptiaca
MIIPVRCFTCGKVIGNKWDTYLDLLQADYSEGDALDALGLVRYCCRRMMMTHVDLIEKLLNYNTLEKSEGT

SEQ ID NO: 3806 - protein, 71 aa, Pseudotsuga menziesii
MIIPVRCFTCGKVIGNKWDTYLDLLQADYTEGDALDALGLVRYCCRRMLMTHVDLIEKLLNYNTLERSEAN

SEQ ID NO: 3807 - protein, 71 aa, Unknown
  Sequence found in Organisms: Lactuca sativa, Helianthus annuus, Tragopogon dubius
MIIPVRCFTCGKVIGNKWDTYLDLLQSDYTEGDALDALGLVRYCCRRMLMTHVDLIEKLLNYNTLEKSDTS

SEQ ID NO: 3808 - protein, 71 aa, Elaeis guineensis
MIIPVRCFTCGKVIGNKWDTYLDLLQADYSEGDALDALGLVRYCCRRMLMTHVDLIEKLLNYNTLEKTDPN

SEQ ID NO: 3809 - protein, 71 aa, Beta vulgaris
MIIPVRCFTCGKVIGNKWDTYLDLLQADYTEGDALDALGLVRYCCRRMLMTHVDLIEKLLNYNTLDKSDTS

SEQ ID NO: 3810 - protein, 71 aa, Cycas rumphii
MIIPVRCFTCGKVIGNKWDTYLDLLQADYSEGDALDALALVRYCCRRMLMTHVDLIEKLLNYNTLEKSETN

SEQ ID NO: 3811 - protein, 71 aa, Linum usitatissimum
MIIPVRCFTCGKVIGHKWDTYLDLLQADYTEGDALDALGLVRYCCRRMLMTHVDLIEKLLNYNTLEKSEGS

SEQ ID NO: 3812 - protein, 71 aa, Malus domestica
MIIPVRCFTCGKVIGNKWDTYLDLLQADYTEGDALDALGLVRYCCRRMLMTHVDLIEKLLNYNTLEKSDAS

SEQ ID NO: 3813 - protein, 71 aa, Actinidia deliciosa
MIIPVRCFTCGKVIGNKWDMYLDLLQADYNEGDALDALGLVRYCCRRMLMTHVDLIEKLLNYNTLEKSEGS

SEQ ID NO: 3814 - protein, 71 aa, Nicotiana benthamiana
MIIPVRCFTCGKVIGNKWDEYLDLLQADYAEGDALDALNLVRYCCRRMLMTHVDLIEKLLNYNTLEKSEGT

SEQ ID NO: 3815 - protein, 71 aa, Camellia sinensis
MIIPVRCFTCGKVIGNKWDTYLDLLQADYTEGDALDALGLVRYCCRGMLMTHVDLIEKLLNYNTLEKSEGS

SEQ ID NO: 3816 - protein, 73 aa, Physcomitrella patens
MIIPVRCFTCGKVIGNKWDTYLDLLQADYSEGDALDALALVRYCCRRMLMTHVDLIEKLLNYNTLERNENTNN

SEQ ID NO: 3817 - protein, 71 aa, Fragaria vesca
MIIPVRCFTCGKVIGNKWDTYLDLLQADYTEGDALDALGLVRYCCRRMLMTHVDLIEKLLNYNTLEKSDNS

SEQ ID NO: 3818 - protein, 118 aa, Rhizophora mangle
MIIPVRCFTCGKVIGNKWDMYLDLLQADYMEGDALDALGLVRYCCRRMLMTHVDLIEKLLNYNTLENLIPVEAAYGSQRDLKAVVMDALAGYWHVCACVPMLVCFVTLPMSFLSLYFL

SEQ ID NO: 3819 - protein, 44 aa, Gossypium hirsutum
MIIPVRCFTCGKIIGNKWDTYLDLLQADYTEGDALDALGLVRYC

SEQ ID NO: 3820 - protein, 93 aa, Citrus sinensis
MGYVQEARENHVKKKVEEALRSKMKQKALKECDQYTSKYAQCASGRTFSVVWKCREQAKELNNCLHQYTNDAVLEEMKKEYMLQQDGKEAARV

SEQ ID NO: 3821 - protein, 84 aa, Euphorbia esula
  misc_feature (3)..(3): Xaa can be any naturally occurring amino acid
  misc_feature (5)..(8): Xaa can be any naturally occurring amino acid
  misc_feature (13)..(13): Xaa can be any naturally occurring amino acid
ARXQXXXXASDAXMIIPVRCFTCGKVIGNKWDTYLDLLQADYSEGDALDALGLVRYCCRRMLMTHVDLIEKLLNYNTLERSEGS

SEQ ID NO: 3822 - protein, 137 aa, Triticum aestivum
  misc_feature (128)..(128): Xaa can be any naturally occurring amino acid
MIIPVRCFTCGKVIGNKWDLYLDLLQADYSEGDALDALELFRYCCRRMLMTHVDLIENCSTTTHWRRPRQLSEQAYHAPESTTVSAVSYILVGGMLSLLYQGEDVVSVNCFCSRHSRTDMHFIYPHLXILIDIITAN

SEQ ID NO: 3823 - protein, 157 aa, Triticum aestivum
  misc_feature (148)..(148): Xaa can be any naturally occurring amino acid
VHNLLHDQTIRVPAAAAAAKMIIPVRCFTCGKVIGNKWDLYLDLLQADYSEGDALDALELFRYCCRRMLMTHVDLIENCSTTTHWRRPRQLSEQAYHAPESTTVSAVSYILVGGMLSLLYQGEDVVSVNCFCSRHSRTDMHFIYPHLXILIDIITAN

SEQ ID NO: 3824 - protein, 101 aa, Cucumis melo
GYQKGVWAKPLGTLEGEVGGIVGRRQKRVKMIIPVRCFTCGKVIGNKWDHYLDLLQADYSEGDALDALGLVRYCCRRMLMTHVDLIEKLLNYNTLDKSDTS

SEQ ID NO: 3825 - protein, 71 aa, Unknown
  Sequence found in Organisms: Brassica napus, Brassica rapa, Raphanus sativus
MIIPVRCFTCGKVIGNKWDTYLDLLQADYTEGDALDAIGLVRYCCRRMLMTHVDLIEKLLNYNTLEKSDAN

SEQ ID NO: 3826 - protein, 71 aa, Cleome gynandra
MIIPVRCFTCGKVIGNKWDTYLDLLQADYSEGDALDALGLVRYCCRRMLMTHVDLIEKLLNYNTLEKSDNS

SEQ ID NO: 3827 - protein, 71 aa, Cleome spinosa
MIIPVRCFTCGKVIGNKWDTYLDLLQADYSEGDALDALGLVRYCCRRMLMTHVDLIEKLLSYNTLEKSDNT

SEQ ID NO: 3828 - protein, 71 aa, Unknown
  Sequence found in Organisms: Solanum melongena, Capsicum annuum
MIIPVRCFTCGKVIGNKWDEYLDLLQADYSEGDALDALNLVRYCCRRMLMTHVDLIEKLLNYNTLEKSEGS

SEQ ID NO: 3829 - protein, 71 aa, Unknown
  Sequence found in Organisms: Guizotia abyssinica, Zinnia violacea
MIIPVRCFTCGKVIGNKWDTYLDLLQSDYTEGDALDALGLVRYCCRRMLMTHVDLIEKLLNYNTLEKSDNS

SEQ ID NO: 3830 - protein, 71 aa, Unknown
  Sequence found in Organisms: Cucumis sativus, Cucumis melo, Momordica charantia
MIIPVRCFTCGKVIGNKWDHYLDLLQADYSEGDALDALGLVRYCCRRMLMTHVDLIEKLLNYNTLDKSDTS

SEQ ID NO: 3831 - protein, 71 aa, Unknown
  Sequence found in Organisms: Castanea mollissima, Quercus alba
MIIPVRCFTCGKVIGNKWDMYLDLLQSDYSEGDALDGLGLVRYCCRRMLMTHVDLIEKLLNYNTLERNETT

SEQ ID NO: 3832 - protein, 71 aa, Podocarpus macrophillus
MIIPVRCFTCGKVIGNKWDQYLDLLQADYLEGDALDALGLVRYCCRRMLMTHVDLIEKLLNYNTLERTDAN

SEQ ID NO: 3833 - protein, 71 aa, Unknown
  Sequence found in Organisms: Solanum lycopersicum, Solanum tuberosum, Solanum phureja
MIIPVRCFTCGKVIGNKWDEYLDLLQADYAEGDALDALNLVRYCCRRMLMTHVDLIEKLLNYNTLEKSEGS

SEQ ID NO: 3834 - protein, 71 aa, Salvia sclarea
MIIPVRCFTCGKVIGNKWDMYLDLLQADYSEGDALDALLLVRYCCRRMLMTHVDLIEKLLNYNTLEKSEGS

SEQ ID NO: 3835 - protein, 71 aa, Antirrhinum majus
MIIPVRCFTCGKVIGNKWDTYLDLLQADYSEGDALDALHLVRYCCRRMLMTHVDLIEKLLNYNTLEKSEGS

SEQ ID NO: 3836 - protein, 71 aa, Unknown
  Sequence found in Organisms: Manihot esculenta, Ricinus communis
MIIPVRCFTCGKVIGNKWDTYLDLLQADYSEGDALDALGLVRYCCRRMLMTHVDLIEKLLNYNTLERSEGS

SEQ ID NO: 3837 - protein, 72 aa, Adiantum capillus-veneris
MIIPVRCFTCGKVIGNKWDTYLDLLQADYTEGDALDALGLVRYCCRRMLMTHVDLIEKLLQYNTLERNESNQ

SEQ ID NO: 3838 - protein, 71 aa, Juglans hindsii x Juglans regia
MIIPVRCFTCGKVIGNKWDTYLDLLQSDYSEGDALDALGLVRYCCRRMLMTHVDLIEKLLNYNTLEKNENS

SEQ ID NO: 3839 - protein, 71 aa, Centaurea maculosa
  misc_feature (61)..(61): Xaa can be any naturally occurring amino acid
MIIPVRCFTCGKVIGNKWDTYLDLLQSDYTEGDALDALGLVRYCCRRMLMTHVDLIEKLLXYNTLEKSDTS

SEQ ID NO: 3840 - protein, 71 aa, Zamia vazquezii
  misc_feature (30)..(30): Xaa can be any naturally occurring amino acid
  misc_feature (60)..(60): Xaa can be any naturally occurring amino acid
MIIPVRCFTCGKVIGNKWDTYLDLLQADYXEGDALDALGLVRYCCRRMLMTHVDLIEKLXNYNTLEKSDTN

SEQ ID NO: 3841 - protein, 71 aa, Medicago truncatula
MIIPVRCFTCGKVIGNKWDSYLDFLQADYTEGDALDALGLVRYCCRRMLMTHVDLIEKLLNYNTMEKHEAN

SEQ ID NO: 3842 - protein, 71 aa, Glycyrrhiza uralensis
MIIPVRCFTCGKVIGNKWDTYLDLLQADYTEGDALDALGLVRYCCRRMLMTHVDLIEKLLNYNTLDKSDPN

SEQ ID NO: 3843 - protein, 71 aa, Medicago truncatula
MIIPVRCFTCGKVIGNKWDSYLDFLQADYTEGDALDALGLVRYCCRRMLMTHVDLIEKLLNYNTMEKAEAS

SEQ ID NO: 3844 - protein, 71 aa, Nicotiana tabacum
MIIPVRCFTCGKVIGNKWDEYLDLLQADYSEGDALDALNLVRYCCRIMLMTHVDLIEKLLNYNTLEKSEGT

SEQ ID NO: 3845 - protein, 71 aa, Carica papaya
MIIPVRCFTCGKVIGNKWDTYLDLLQADYSEGDALDALGLVRYCCRRMLMTHVDLIEKLLNYNTLEKSDNA

SEQ ID NO: 3846 - protein, 71 aa, Mimulus guttatus
MIIPVRCFTCGKVIGNKWDSYLDLLQADYSEGDALDALLLVRYCCRRMLMTHVDLIEKLLNYNTLEKSEGS

SEQ ID NO: 3847 - protein, 71 aa, Bruguiera gymnorhiza
MIIPVRCFTCGKVIGNKWDMYLDLLQADYIEGDALDALGLVRYCCRRMLMTHVDLIEKLLNYNTLDKSDTS

SEQ ID NO: 3848 - protein, 102 aa, Helianthus annuus
  misc_feature (7)..(7): Xaa can be any naturally occurring amino acid
AGMPGLXRSGPHYTQKHPFHLEFVKAKTRANMIIPVRCFTCGKVIGNKWDTYLDLLQSDYTEGDALDALGLVRYCCRRMLMTHVDLIEKLLNYNTLEKSDTS

SEQ ID NO: 3849 - protein, 71 aa, Acacia harpophylla
MIIPVRCFTCGKVIGNKWDTYLDLLQADYSEGDALDALGLVRYCCRRMLMTHVDLIEKLLNYNALDKSEPS

SEQ ID NO: 3850 - protein, 71 aa, Unknown
  Sequence found in Organisms: Brassica napus, Zea mays, Brassica juncea, Brassica oleracea, Brassica rapa, Raphanus sativus
MIIPVRCFTCGKVIGNKWDAYLDLLQLDYTEGDALDALNLVRYCCRRMLMTHVDLIEKLLNYNTLEKSDNS

SEQ ID NO: 3851 - protein, 71 aa, Unknown
  Sequence found in Organisms: Cryptomeria japonica, Sequoia sempervirens, Taxus baccata
MIIPVRCFTCGKVIGNKWDQYLDLLQADYPEGDALDALGLVRYCCRRMLMTHVDLIEKLLNYNTLERSDAN

SEQ ID NO: 3852 - protein, 71 aa, Unknown
  Sequence found in Organisms: Arabidopsis thaliana, Arabidopsis lyrata
MIIPVRCFTCGKVIGNKWDQYLDLLQLDYTEGDALDALQLVRYCCRRMLMTHVDLIEKLLNYNTLEKSDNS

SEQ ID NO: 3853 - protein, 71 aa, Lotus japonicus
MIIPVRCFTCGKVIGNKWDPYLDLLQSDYSEGDALDALGLVRYCCRRMLMTHVDLIEKLLNYNTLDKSDTS

SEQ ID NO: 3854 - protein, 71 aa, Brachypodium distachyon
MIIPVHYFTCGKVIGNKWDHYLDLLQADYTEGAALDTLGLVRYCCRRMLMTHVDLIEKLLNYNTLEKTESS

SEQ ID NO: 3855 - protein, 71 aa, Cicer arietinum
MIIPVRCFTCGKVIGNKWDSYLDFLQADYTEGDALDALGLVRYCCRRMLMTHVDLIEKLLNYNSLEKVDAS

SEQ ID NO: 3856 - protein, 71 aa, Trifolium pratense
MIIPVRCFTCGKVIGNKWDSYLDFLQADYTEGDALDALGLVRYCCRRMLMTHVDLIEKLLNYNSLEKHDAN

SEQ ID NO: 3857 - protein, 71 aa, Thellungiella halophila
MIIPVRCFTCGKVIGNKWDTYLDLLQADYTEGDALDAIGLVRYCCRRMLMTHVDLIEKLLNYNTMEKSDPN

SEQ ID NO: 3858 - protein, 71 aa, Glycine max
MIIPVRCFTCGKVIGNKWDTYLDLLQADYSEGDALDALGLVRYCCRRMLMTHVDLIEKLLNYNTLDKSDLN

SEQ ID NO: 3859 - protein, 71 aa, Glycine max
MIIPVRCFTCGKVIGNKWDTYLDLLQADYSEGDALDALGLVRYCCRRMLMTHVDLIEKLLNYNTLDKSDPN

SEQ ID NO: 3860 - protein, 80 aa, Ceratodon purpureus
CRCWTDLALALDQGEVGFCWVQRFTMIIPVRCFTCGKVIGNKWDTYLDLLQRTIPRVMPWTPWLCPVLLPPHADDPCGSH

SEQ ID NO: 3861 - protein, 74 aa, Lactuca sativa
GTKMIIPVRCFTCGKVIGNKWDTYLDLLQSDYTEGDALDALGLVRYCCRRMLMTHVDLIEKLLNYNTLEKSDTS

SEQ ID NO: 3862 - protein, 75 aa, Cenchrus ciliaris
MIIPVRCFTCGKVIGNKWDAYLDLIQADYNEGDAMDALGVIRYCCRRMLMTHVDLIEKLLNYNTLEKKAEEEAAN

SEQ ID NO: 3863 - protein, 75 aa, Pennisetum glaucum
MIIPVRCFTCGKVIGDKWDAYLDLIQADYNEGDAMDALGLIRYCCRRMLMTHVDLIEKLLNYNTLEKKPEDEAAN

SEQ ID NO: 3864 - protein, 77 aa, Vigna unguiculata
GNSQKKMIIPVRCFTCGKVIGNKWDSYLDLLQADYSEGDALDALGLVRYCCRRMLMTHVDLIEKLLNYNSLDKSDPS

SEQ ID NO: 3865 - protein, 57 aa, Tamarix hispida
MIIPVRCFTCGKVIGNKWDTYLDLLQADYSEGDALDALGLVRYCCRRMLMTHVDLIE

SEQ ID NO: 3866 - protein, 96 aa, Gossypium hirsutum
HEERGKAKFEVEATQKVTELDDNSSSLLHLRERSWVTNGTLILIFSRPIIPERDALDALGLVRYCCRTMLMTHVDLIEKLLNYNTLENRIQLREHV

SEQ ID NO: 3867 - protein, 87 aa, Triphysaria pusilla
MIIPVRCFTCGKVIGNKWDTYLDLLQADYTEGDALDALGLVRYCCRRMLMTHVDLIEKLLNYNSLFLLLPISICDFVCPVFITCMFM

SEQ ID NO: 3868 - protein, 71 aa, Cajanus cajan
MIIPVRCFTCGKVIGNKWDAYLDLLQADYSEGDALDALGLVRYCCRRMLMTHVDLIEKLLNYNALDKSDPS

SEQ ID NO: 3869 - protein, 71 aa, Sciadopitys verticillata
MIIPVRCFTCGKVIGNKWDQYLDLLQADYPEGDALDALGLVRYCCRRMLMTHVDLIEKLLSYNTLERNDAN

SEQ ID NO: 3870 - protein, 71 aa, Glycine max
MIIPVRCFTCGKVIGNKWDTYLDLLQADYSEGDALDALGLVRYCCRRMLMTHVDLIEKLLNYNALDKSDPN

SEQ ID NO: 3871 - protein, 71 aa, Unknown
  Sequence found in Organisms: Castanea mollissima, Quercus alba
MIIPVRCFTCGKVIGNKWDTYLDLLQSDYSEGDALDGLGLVRYCCRRMLMTHVDLIEKLLNYNTLERNDNT

SEQ ID NO: 3872 - protein, 71 aa, Unknown
  Sequence found in Organisms: Phaseolus coccineus, Vigna unguiculata
MIIPVRCFTCGKVIGNKWDTYLDLLQADYSEGDALDALGLVRYCCRRMLMTHVDLIEKLLNYNALDKSDPS

SEQ ID NO: 3873 - protein, 72 aa, Selaginella moellendorffii
MIIPVRCFTCGKVIGNKWDTYLDLLQADYPESEALDALGLVRYCCRRMLMTHVDLIEKLLNYNTLERNENNQ

SEQ ID NO: 3874 - protein, 71 aa, Arachis hypogaea
MIIPVRCFTCGKVIGNKWDAYLDLLQSDYSEGDALDALGLVRYCCRRMLMTHVDLIEKLLNYNTLDKSDPS

SEQ ID NO: 3875 - protein, 70 aa, Mesostigma viride
  misc_feature (60)..(60): Xaa can be any naturally occurring amino acid
MIIPVRCFTCGKVIGNKWDTYLDLLQADYSEGDALDALGLVRYCCRRMLMTHVDLIEKLXNYNTLERAQG

SEQ ID NO: 3876 - protein, 71 aa, Glycine max
MIIPVRCFTCGKVIGNKWDTYLDLLQSDYSEGDALDALGLVRYCCRRMLMTHVDLIEKLLNYNTLDKSDPS

SEQ ID NO: 3877 - protein, 71 aa, Raphanus sativus
  misc_feature (50)..(50): Xaa can be any naturally occurring amino acid
MIIPVRCFTCGKVIGNKWDAYLDLLQLDYTEGDALDALNLVRYCCRRMLXTHVDLIEKLLNYNTLEKSDNS

SEQ ID NO: 3878 - protein, 88 aa, Pennisetum glaucum
MIIPVRCFTCGKVIGDKWDAYLDLIQADYNEGDAMDALGLIRYCCRRMLMTHVDLIEKLSTTTRWRRSPKTKLPIKRTWHARMLVRHT

SEQ ID NO: 3879 - protein, 71 aa, Gnetum gnemon
MIIPVRCFTCGKVIGNKWDSYLDLLQADYSESDALDALGLIRYCCRRMLMTHVDLIEKLLNYNTLERSDAN

SEQ ID NO: 3880 - protein, 71 aa, Unknown
  Sequence found in Organisms: Arabidopsis thaliana, Arabidopsis lyrata
MIVPVRCFTCGKVIGNKWDTYLELLQADYAEGDALDALGLVRYCCRRMLMTHVDLIEKLLNYNTMEKSDPN

SEQ ID NO: 3881 - protein, 53 aa, Zea mays
  misc_feature (30)..(30): Xaa can be any naturally occurring amino acid
MIIPVRCFTCGKVIGNKWTSTSTSSRPTTXGRGCSGCLGIVPLLLQANAHDPG

SEQ ID NO: 3882 - protein, 76 aa, Lactuca sativa
GGETRMIIPVRCFTCGKVIGNKWDTYLDLLQSDYTEGDALDALGLVRYCCRRMLMTHVDLIEKLLNYNTLEKSDTS

SEQ ID NO: 3883 - protein, 75 aa, Aquilegia formosa
MIIPVRCFTCGKVIGNKWDTYLDLLQADYTEGDALDALGLVRYCCRRMLMTHVDLIEKLLNYNSITLLLSLFLSV

SEQ ID NO: 3884 - protein, 77 aa, Lactuca sativa
RGRETKMIIPVRCFTCGKVIGNKWDTYLDLLQSDYTEGDALDALGLVRYCCRRMLMTHVDLIEKLLNYNTLEKSDTS

SEQ ID NO: 3885 - protein, 78 aa, Artemisia annua
PFTFFYKQVHLFCLLISHRTKTRVYNLRRTKDDYSRSLFHLRLLETNGTRILIFFSLITLKEMLLMLWDLFVIVVEEC

SEQ ID NO: 3886 - protein, 98 aa, Solanum melongena
MIIPVRCFTCGKVIGNKWDEYLDLLQADYSEGDALDALNLVRYCCRRMLMTHVDLIEKLLNYNSKLPLLSPPCLYNYEQVLIFSLDEIDKCYVQVLLT

SEQ ID NO: 3887 - protein, 41 aa, Gossypium hirsutum
MIIPVRCFTCGKVIGNKWDTYLDLLQADYTEWFLTTSLPLS

SEQ ID NO: 3888 - protein, 78 aa, Fragaria vesca
QEERRRKMIIPVRCFTCGKVIGNKWDTYLDLLQADYTEGDALDALGLVRYCCRRMLMTHVDLIEKLLNYNTLEKSDNS

SEQ ID NO: 3889 - protein, 41 aa, Gossypium hirsutum
MIIPVRCFTCGKIIGNKWDTYLDLLQADYTEGFLTTSPPLS

SEQ ID NO: 3890 - protein, 71 aa, Cynodon dactylon
MILPVRCFPCGKVIGNQWDMYLDLLQAHYPEGDALDALNLVRYCCRRMLMTPVDLLEKLLNYHTLEKTETS

SEQ ID NO: 3891 - protein, 73 aa, Sorghum bicolor
MIIPVRCFTCGKVIGDKWDAYLELVQADYDEEDALTALNLNRYCCRRMLMTHVDLIEKLLNYNTLEKTTGTDS

SEQ ID NO: 3892 - protein, 79 aa, Chlamydomonas reinhardtii
MIIPVRCFTCGKVIGNKWDTYLDLLQAGYSEQEALDGLGLSRYCCRRMLMTHVDLIEKLLNYNTLERAAQAQGAQRTGQ

SEQ ID NO: 3893 - protein, 77 aa, Cucumis sativus
MIIPVRCFTCGKVIGNKWDTYLDLLQADYPEGEALDMLGLVRYCCRRMLMTHVDLIEKLLNYNSIIFISSLSLIYSL

SEQ ID NO: 3894 - protein, 1002 aa, Zea mays
MAMAPSTAAASTLLPVLLLIATATQCTAADSFSSQDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKQQQQQEGPHDSPPQQDLLSI

SEQ ID NO: 3895 - protein, 994 aa, Zea mays
AASTLLPVLLLIATATQCTAADSFSSQDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKQQQQQEGPHDSPPQQDLLSI

SEQ ID NO: 3896 - protein, 1007 aa, Oryza sativa
MALAGSMAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISGEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAATAMDAPSHGSGKEQDRSAEMQQQDGSRESPPQQDLLSI

SEQ ID NO: 3897 - protein, 1004 aa, Brachypodium distachyon
MAMAATPTFLLLVLIFLLATATCSTAAGSSPSNASLEAAALANLSAALADPSGYLSAHWTPVTPLCSWPRLSCDAAGSRVISLDLSALNLSGPIPAAALSSLTHLQSLNLSNNLFNSTFPEALIASLPNIRVLDLYNNNLTGPLPSALPNLTNLVHLHLGGNFFSGSIPGSYGQWSRIRYLALSGNELTGAVPPELGNLTTLRELYLGYFNSFTGGIPRELGRLRELVRLDMASCGISGTIPPEVANLTSLDTLFLQINALSGRLPPEIGAMGALKSLDLSNNLFVGEIPASFVSLKNMTLLNLFRNRLAGEIPGFVGDLPSLEVLQLWENNFTGGVPAQLGVAATRLRIVDVSTNKLTGVLPTELCAGKRLETFIALGNSLFGGIPDGLAGCPSLTRIRLGENYLNGTIPAKLFSLQNLTQIELHDNLLSGELRLEAGEVSPSIGELSLYNNRLSGPVPAGIGGLSGLQKLLIAGNILSGELPPAIGKLQQLSKVDLSGNRISGEVPPAIAGCRLLTFLDLSGNKLSGSIPTALASLRILNYLNLSNNALDGEIPASIAGMQSLTAVDFSYNGLSGEVPATGQFAYFNSTSFAGNPGLCGAFLSPCRTTHGVATSSAFGSLSSTSKLLLVLGLLALSIVFAGAAVLKARSLKRSAEARAWRITAFQRLDFAVDDVLDCLKDENVIGKGGSGVVYKGAMPGGAVVAVKRLLSAALGRSAGSAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDADFEAHVADFGLAKFLHGSNAGGSECMSAIAGSYGYIAPEYAYTLKVDEKSDVYSFGVVLLELIAGRKPVGEFGDGVDIVQWVRMVAGSTKEGVMKIADPRLSTVPIQELTHVFYVAMLCVAEQSVERPTMREVVQILTDLPGTTTSMSLPPPDLEEGREENQGHEQQQGEPHDSPAHQDLLSI

SEQ ID NO: 3898 - protein, 736 aa, Zea mays
NVGVTPKSYLLLGPKNSMQPSPTTSQLILLPVSLGSALPQPREMVALHLHAKQPTPRLLPVPPSHARTRTPTAAAVNVSHAAPPPDVVLDCKRLDGLMKSGRLGDALDLFDRMPRKNVVAWTTAISGCTRNGRPEAAATMFADMLESGVAPNDFACNAALAACAAAGALGLGEQVHSLAVRAGFAADAWIGSCLIELYSRCGSLRAAEEVFRRMEAPDVVGYTSLVSALCRNGELARAVDVLCQMTRQGLQPNEHTMTSMLAECPRGIGEQIHGYMLKVMGSQSVYASTALIDFYSRYGDFGTAKTVFENLESKNVVSWCSMMQLCIRDGRLDDALRVFSEMISEGVQPNEFAFSIALSACGSVCLGRQIHCSAIKRDLMTDIRVSNALLSMYGRSGFVSELEAVLGKIENPDLVSWTAAISANFQNGFSEKAVALLLQMHSEGFTPNDYAFSSGLSSCADLALLHQGRQLHCLALKLGCDFKVCTGNALINMYSKCGRIGSARLAFDVMDTHDVMSWNSLIHGLAQHGDANLALETFSEMCSSDWRPDDSTFLSVLVGCNHAGLVKEGETFFRQMTDRYGLTPTPSHYACMIDMLGRNGRFAEALRMIENMPFEPDVLIWKTLLASCKLHRNLDIGKLAADKLMELSERDSASYVLMSNLYAMHEEWRDAERVRRRMDEIGVKKDAGWSWIEVKNEVNTFVAGDMSHPDSTSIYQMLAELLVVMQDTDLDVHMQI

SEQ ID NO: 3899 - protein, 559 aa, Sorghum bicolor
MPRKNVVAWTTAISECTRNGWLEATAAMFADMLESGVAANDFACNAALAACAAASAHALSLDEQVHSLAVRAGFAADAWIGSCLIELYSRCGSLRAAEEVMGSQSVYASTALIDFYSRHGDFDMAETVFENLDSKNVVSWCSMMQLCIRDGRLEDALRVFSEMISEAVEPNEFAFSIALGACGFVCLGRQIHCSVIKCNLMTDIRVSNALLSMYGRSGFVSEIDAVLGKIENPDLVSWTAAISANFQNGFSEKAVALLLQMHSEGFTPNDYAFSSGLSSCADLALLDQGRQLHCLALKLGCDFKVCTGNALINMYSKCGQIGSARLAFDVMNLHDVMSWNSLIHGLAQHGAANLVLEAFSEMCSSGWQPDDSTFIAVLVGCNHAGLVKEGETFFRLMTDRYGLTPTPSHYACMIDMLGRNGRFDEALHMIENMPFEPDVLIWKTLLASCKLHKNLDIGKLATDKLMELSERDSASYVLMSNLYAMHEEWQDAERVRRRMDEIGVKKDAGWSWIEVKNEVCIVSFVRFFCAFEPSMRPAWAKENCRPAQTRWGAYYPHVT

SEQ ID NO: 3900 - protein, 689 aa, Zea mays
MACRATLLPLFLFLLVAPEPALATSGTIVFTTLGRSRYAFDVFALTIAPLSAASAELRLTDGASVNYNGNFAPSSSGPPSLLFVSERNGSLNLYLTPVPTSASARRRDALEEEEEDSAPPTPLLPWDPIALKDRPSLTPDGAHLVYVSTAEPAGAPRRSWAAVYSTSLAPGRATRRLTPRGVADFSPAVSPSGVWTAAASPGPRGWAGEVEDLRTDIYVFRTSDGSRRALAVPDGGWPTWADDTTVFFHRRDADGWYGVYRARLTFTDDDVASVVDRITPPGFHAFTPAASPGAPGLVAVATRRPGSDYRHIEVIDLSGGGGGANNRSAYYEVTRPVAPRAHHFNPFISPDGERVGYHRCRGSGNGDSPLLLESIKGPAPDTFSLFRIDGSFPSFSHDGKRIAFVGLPGLYVVNSDGSGGRRRVFSGNAFPTTWDWKRKGVIYTSVGPDFASESTEVDVVAVSLGDGDGDDPSVSIKKLTVGGENNAFPSPSPDGKWVVFRSGRSGHKNLYIMDAEDGEAGGIRRLTEGPWSDTMCNWSPDGEWIAFASDRHNPGGGSFAIYMVHPNGTGLRRVVHSADGGRTNHPWFSPDSKTLVFTSDYAAVSAEPISNPHHYQPYGEIFTVNIDGSGIRRLTHNSFEDGTPSWTPYHLKAEDVGETLQASGTCAFEDCHWLNIAARPDGLMCGKHA

SEQ ID NO: 3901 - protein, 687 aa, Panicum virgatum
MTPRATRLLLFLLVGLLVLAAPAPALAADGTIVFTTLGRSRYSFDIFALPIAPLSSSSSPAAEARLTDGASVNYNGNFAPSGDSLLFVSERNGTLNLYISPVPSASGSRREALEVPEAAPLTPLLPWDPIALKDRPSLTPDGANLVYVSTADPAEAPRRSWAAVYNTHLPSGSTRRLTPRGVADFSPAVSPSGEWTAAASPGPDGWGGEVEDLDTDIYVFRTPDGSRRTLAICDGGWPTWADETTLFFHRRDSDGWYGVYRAKISFAGDAGVSAASVERVTPPGFHAFTPAASPGAPGLVAVATRRPGSDYRHIEVIDVSGGGANAYFEVTRPVAPRVHHFNPFISPDGVRVGYHRCRGSGNGDSPLLLESIKSPAPDTFSLFRIDGSYPSFSHDGKRIAFVGLPGLFVVNSDGSGGRRRIFSGNAFPTAWGWKRKGVIYTSIGPDFASERTEVDVAAVSLGDDDDEEDSNISIKKLTVGGGNNAFPSPSPDGKWIVFRSGRSGHKNLYIMDAEDGEAGGIRRLTEGPWSDTMCNWSPDGEWIAFASDRHNPGSGSFAIYMVHPNGTGLRRVVHSADGGRANHPWFSPDSKSLVFTTDYAAVSAEPISNPHHYQPYGEIFTVNIDGSGIRRLTHNSFEDGTPAWTPYYLKPEDVGETLQASGTCAFEDCHWLNIDAQPHGLMCGRHA

SEQ ID NO: 3902 - protein, 354 aa, Zea mays
MLWVDKYRPKTLDKVTVHDQVAQNLRKFVSEQDCPHLLFYGPSGSGKKTLILALIKQMFGAGAEKVKLENKTWKIDTGTRTFEIELAMLSSAHHVEMTPSDAGFQDRYVVQEVIKEMAKNRPIDAKGKRAFKVLVLNEVDKLSREAQHSLRRTMEKYSSSCRLILCCNSSSKVTEAVRSRCLNVRVNAPSEDQIVQVLEFIGKKENLHLPAGFAARIAAQSNRNLRRAILFFETCKVQQYPFTSNQVAPPLDWEQYVSEIATDILTEQSPKRLFAVRQKFYELLVNCIPPESILKKLLAELLRKLDADLKHEICHWAAHYEHKMRLGSKAIFHLEAFVAKFMSVYKEFLVATFG

SEQ ID NO: 3903 - protein, 354 aa, Zea mays
MLWVDKYRPKTLDKVTVHDQVARNLRKFVSEQDCPHLLFYGPSGSGKKTLILALIKQMFGAGAEKVKLENKTWKIDTGTRTLEIELAMLSSAHHVEMNPSDAGFQDRYVVQEIIKEMAKNRPIDAKGRRAFKVLVLNEVDKLSREAQHSLRRTMEKYSSSCRLILCCNSSSKVTEAVRSRCLNVRVNAPSEDQIVQVLEFIGKKENLILPAGFAARIAAQSNRNLRRAILFFETCKVQQYPFTSNQVAPPLDWEQYVSEIATDILTEQSPKRLFDVRQKFYELLVNCIPPESILKKLLAELLRKLDADLKYEICRWAAHYEHKMRLGSKAIFHLEAFVAKFMSIYKEFLVATFG

SEQ ID NO: 3904 - protein, 354 aa, Panicum virgatum
MLWVDKYRPKTLDKVTVHDQVAQNLRKLVSEQDCPHLLFYGPSGSGKKTLILALIKQMFGAGAEKVRMENKTWKIDTGTRTLEIELAMLSSAHHVEMNPSDAGFQDRYVVQEVIKEMAKNRPIDAKGKRAFKVLVLNEVDKLSREAQHSLRRTMEKYSASCRLILCCNSSSKVTEAVRSRCLNVRVNAPSEDQIIQVLEFIGKKENLQLPAGFAARIAAQSNRNLRRAILFFETCKVQQYPFTSNQVAPPLDWEQYVSEISTDILTEQSPKRLYAVRQKFYELLVNCIPPESILKKLLAELLKKLDADLKHEICHWAAHYEHKMRLGSKAIFHLEAFVAKFMSIYKEFLVASFG

SEQ ID NO: 3905 - protein, 354 aa, Cenchrus ciliaris
MLWVDKYRPKTLDKVTVHDQVAQNLRKLVSEQDCPHLLFYGPSGSGKKTLILALIKQMFGAGAEKVKMENKTWKIDTGTRTLEIELAMLSSAHHVEMNPSDAGFQDRYVVQEVIKEMAKNRPIDAKGKRAFKVLVLNEVDKLSREAQHSLRRTMEKYSASCRLILCCNSSSKVTEAVRSRCLNVRVNAPSEDQIVQVLEFIGKKENLHLPAGFAARIAAQSNRNLRRAILFFETCKVQQYPFASNQVAPPLDWEQYVSEIATDILTEQSPKRLYAVRQKFYELLVNCIPPESILKKLLTELLKKLDADLKHEICRWAAHYEHKMRLGSKAIFHLEAFVAKFMSIYKEFLVATFS

SEQ ID NO: 3906 - protein, 354 aa, Oryza sativa
MLWVDKYRPKTLDKVTVHDQVAQNLKKLVAEQDCPHLLFYGPSGSGKKTLVMALIKQMFGAGADKVKMENKTWKIDTGSRNIEIELAMLSSAHHVEMNPSDAGFQDRYVVQEVIKEMAKNRPIDAKGKRAFKVLVLNEVDKLSREAQHSLRRTMEKYSASCRLILCCNSSSKVTEAVRSRCLNVRVNAPSEDQIVQVLEFIGKKENLQLPFGFAARIAAQSNRNLRRAILFFETCKVQQYPFTSNQVAPPLDWEQYVSEIAADIMKEQSPKRLFAVRQKFYELLVNCIPPESILKKLLAELLKKLDSDLKHEICHWAAHYEHKMRLGSKAIFHLEAFVAKFMSIYKEFLVSTFG

SEQ ID NO: 3907 - protein, 354 aa, Brachypodium distachyon
MLWVDKHRPKALDKVTVHEQVAQNLKKLVAEQDCPHLLFYGPPGSGKKTLIMALIKQMFGAGAEKVKMENKTWKIDTGTRTFDLELVMLSSSHHVEMNPSDAGFQDRYVVQEVIKEMAKSRPIDAKGKRAFKVLILNEVDKLSREAQHSLRRTMEKYSASCRLILCCNSSSKVTEAVRSRCLNVRVNAPTEDQIVQVLEFIGKKENLQLPFGFAARIAAQSNRNLRRAILFFETCKVQQYPFTSNQVPPPLDWEKYVSEIATDILSEQSPKRLYSVRQKFYELLVNCIPPESILKKLLSELMKKLDSDLKHEICHWAAHYEHKMRLGSKAIFHLEAFVAKFMSIYKEFLVATFG

SEQ ID NO: 3908 - protein, 354 aa, Triticum aestivum
MLWVDKHRPKTLDKVIVHEQVAQNLKKFVAEQDCPHLLFYGPPGSGKKTLIMALIKQMFGAGVEKVKMENKTWKIDTGTRAFDLELAMLSSSHHVEMNPSDAGFQDRYVVQEVIKEMAKSRPIDAKGKRAFKVLVLNEVDKLSREAQHSLRRTMEKYSASCRLILCCNSSSKVTEAVRSRCLNVRVNAPTEDQIVQVLEFIGKKENLQLPFGFAARIAAQSNRNLRRAILFFETCKVQQYPFSANQVAPPLDWEQYVSEIATEILSEQSPKRLYSVRQKFYELLVNCIPPESILKKLLTELMKKLDSDLKHEVCHWAAHYEHKMRLGSKAIFHLEAFVAKFMSIYKEFLCAAFG

SEQ ID NO: 3909 - protein, 354 aa, Hordeum vulgare
MLWVDKHRPKTLDKVIVHEQVAQNLKKFVAEQDCPHLLFYGPPGSGKKTLIMALIKQMFGAGVDKVKMENKTWKIDTGTRTFDLELAMLSSSHHVEMNPSDAGFQDRYVVQEVIKEMAKSRPIDAKGKRAFKVLVLNEVDKLSREAQHSLRRTMEKYSASCRLILCCNSSSKVTEAVRSRCLNVRVNAPTEDQIVQVLEFIGKKENLQLPFGFAARIAAQSNRNLRRAILFFETCKVQQYPFSANQVAPPLDWEQYVSEIATEILSEQSPKRLYSVRQKFYELLVNCIPPESILKKLLTELMKKLDSDLKHEVCHWAAHYEHKMRLGSKAIFHLEAFVAKFMSIYKEFLCAAFG

SEQ ID NO: 3910 - protein, 168 aa, Setaria italica
MEDEDAGPGGGGEASPPHHAAASGDRARDMAASPTSSRSVTQTVNGSHRFVISPRVWAWGGTSPARPSRWAGTSGRSTSTPTGRTPRTTPPTSPSSSPSRPRAPTCARSSSSRSSTRAARASTRCTPTSTAPSSLGRTPSSTADPCGAIKGSFGVLLLRHQIFLKMIA

SEQ ID NO: 3911 - protein, 354 aa, Aquilegia formosa
MLWVDKYRPKTLDKMIVHDDIAQHLKKLVTEQDCPHLLFYGPSGSGKKTLIMAVLRQMYGASAEKVKIENKTWKVDAGSRTLDLELTTLSSTNHVEINPSEAGFQDRYVVQEIIKEMAKNRPIDAKGKKGYKVLVLNEVDKLSREAQHSLRRTMEKYSASCRLILCCNSSSKVTEAVRSRCLNVRINAPTEEQIVKVLEFIGKKENLQLPPGFAARIAVQSNRSLRRAVLLFETCRVQQYPFTSIQAIPPMDWEQYVSEIASDIMQEQSPKRLFMVRGKLYELLINCIPPEIILKRLLSELLKKLDAELKHEVCHWAAYYEHRMRLGQKAIFHIEAFVAKFMSIYKAFLIATFG

SEQ ID NO: 3912 - protein, 354 aa, Ipomoea nil
  misc_feature (26)..(26): Xaa can be any naturally occurring amino acid
  misc_feature (55)..(55): Xaa can be any naturally occurring amino acid
  misc_feature (58)..(58): Xaa can be any naturally occurring amino acid
  misc_feature (170)..(170): Xaa can be any naturally occurring amino acid
MLWVDKYRPKTLDKIIVHQDVAQNLXKLVTEQDCPHLLFYGPSGSGKKTLIMALXRQXFGASADKVKAENKVWKIDAGTRTIDVELTTLSSTHHVELSPGDAGFQDRYVVQEVIKEMAKNRPIDTKGKKSFKVLVLNEVDKLSREAQHSLRRTMEKYSTSCRLILCCNSXSKVTEAVRSRCLNVRINAPKEEEIVKVLEFIGKKEGLQLPAGFAARIAEKSNRSLRRAILSFETCRVQQYPFTNNQAVPPMDWEEYVAEIASDIMKEQSPKRLFQVRGKLYELLSNCIPPDIILKRLLFELLKKLDSELKHEVCHWAAYYEHRMHLGQKAIFHLEAFVAKFMSIYKNFLVATFG

SEQ ID NO: 3913 - protein, 354 aa, Aristolochia fimbriata
MLWVDKYRPKTLDKVIVHEDIAQNLKKLVSEQDFPHLLFYGPPGSGKKTLIMGLLKQMFGPGADKVKIENKVWKIDAGSRTIDIELTTLSSSYHVELNPSDAGFQDRYIVQEIIKEMAKSRPIDTKGKKGFKVLVLNEVDKLSREAQHSLRRTMEKYSASCRLILCCNSSSKVTEAVRSRCLNVRVNAPTEEQIIKVLEFVGKKEGLQLPANFAAHIAAHSNRSLRRALLSFETCRVQQYPFSENQTVAPMDWEQYVSEIATDIVQEQSPKRLYLVRGKLYELLVHCIPPEIILKKLLSELLKKLDADLKHEVTHWAAYYEHRMRLGQKAIFHLEAFVAKFMSIYKGFLIAAFG

SEQ ID NO: 3914 - protein, 368 aa, Cichorium intybus
GDQQQSAHLPPHLQDALGGQYRPKSLDEVLVHEDVAQNLKKLVTEQDCPHLLFYGPPGSGKKTLIMALLRQMFGAGAEKVKVENKNWKVDAGSRTIDLELTTLSSTHHVELNPSDAGFQDRYIVQEIIKEMAKNRPIDTKGKKGFKVLVLNEVDKLSREAQHSLRRTMEKYSASCRLILCCDSSSKVTEAVRSRCLNVRVSAPKEDQIVKVLEFIGKKEGLQLPPGFAARIAEKSGRSLRRAILSFETCRVQQYPFTNNQVIPPMDWEEYVTEIAADIMKEQSPKRLFQVRGKLYELLVNCIPPEVILKRLLHELLKKLDSELKHEVCHWAAYYEHRMRLGQKAIFHIEAFVAKFMSIYKGFLIATFG

SEQ ID NO: 3915 - protein, 354 aa, Glycine max
MLWVDKYRPKTLDQVMVHTDIAHNLKKLVTEQDSPHLLFYGPSGSGKKTLIMALLRQMFGPGAEKVKVENRTWKIDAGSRSLDLELTTLSSANHIEMSPSDAGFQDRYIVQEVIKEMAKNRPIDTKGKKGFKVLVLNDVDKLSREAQHSLRRTMEKYSAYCRLILCCNSSSRVTEAIRSRCLNVRINAPSEEQIVQVLEFIGKKEGLQLPPGFAARIAEKSNRNLRRAILSFETCRVLQYPFTNKQAIPPMDWEEYISEIASDIMKEQSPKRLFQVRGKLYELLINCIPPEIILKRLLYELLRKLDAELKHEVCHWAAYYEYRMRLGQKAIFHIEAFVAKFMSIYKSFLIATFG

SEQ ID NO: 3916 - protein, 299 aa, Avena sativa
MLWVDKHRPKTLDKVLVHEQVAQNLKKLVAEQDCPHLLFYGPPGSGKKTLIMALIKQMFGAGAEKVKMENKTWKIDTGTRTFDLELAMLSSSHHVEMNPSDAGFQDRYVVQEVIKEMAKSRPIDAKGKRAFKVLVLNEVDKLSREAQHSLRRTMEKYSASCRLILCSNSSSKVTEAVRSRCLNVRVNAPSEDQIVQVLEFIGKKENLQLPFGFAARIATQSNRNLRRAILFFETCKVQQYPFSPNQVAPPLDWEQYVSEIATDILSEQSPKRLYSVRQKFYELLVNCIPPESILKKIVD

SEQ ID NO: 3917 - protein, 354 aa, Solanum melongena
MLWVDKYRPKTLDKVIVHQDVAQNLHKLVSEGDCPHLLFYGPSGSGKKTLIMALLRQIFGPSADKVKVENKIWKVDAGTRTIDVELTTLSSTHHVELNPSDAGFQDRYVVQEIIKEMAKNRPIDTKGKKGFKVLVLNEVDKLSREAQHSLRRTMEKYSASCRLILCSNSSSKVTEAVRSRCLNVRINAPMEEEIINVLEFIAKKEGLQFPQGFAARIVERSNRNLRRAILTFETCRVQQYPFTNNQSIPPMDWEQYVSEIASDIMKEQSPKRLFEVRGKLYELLTNCIPPEIILKKLLFELLKKLDSELKHEVSNCAAHYEHRMRLGQKAIFHLEAFVAKFMSIYKSFLISTFG

SEQ ID NO: 3918 - protein, 354 aa, Solanum phureja
MLWVDKYRPKTLDKVTVHQDVAQNLRKLVSEGDCPHLLFYGPSGSGKKTLIMALLRQIFGPSADKVKVENKIWKVDAGSRTIDVELTTLSSTHHVELNPSDAGFQDRYVVQEIIKEMAKNRPIDTKGKKGFKVLVLNEVDKLSREAQHSLRRTMEKYSASCRLILCSNSSSKVTEAVRSRCLNVRINAPMEEEIVSVLEFIAKKEELQFPQGFAARIVEKSNRNLRRAVLTFESCRVQQYPFTNNQTIPPMDWEQYVSEIASDIMKEQSPKRLFEVRGKLYELLTNCIPPEIILKRLLFELLKKLDSELKHEVSNWAAHYEHRMRLGQKAIFHLEAFVAKFMSIYKSFLISTFG

SEQ ID NO: 3919 - protein, 364 aa, Zea mays
MATQWFSNMVMDEPSFFHQWQSDTLLEQYTEQQIAVAFGQGEPVDHAVAAALATAMPMQLQQPAAAEQPHHRPRKAAKVNTSWDSCITEQGSPAADSSSPTILSFGGHTAFAKAEPTTHQPPSCAGYYGAAAAAAKAPKQEMMDAAAMPPFQQARPAKRSYDDMAAVAEAANAPSANTRPASQNQDHILAERKRREKLSQRFIALSKIVPGLKKMDKASVLGDAIKYVKQLQDQVKGLEDDARRRPVEAAVLVKKSQLSADDDEGSSCDENFVATEASGTLPEIEARVSDRTVLVRIHCENRKGVLIAALSEVERLGLSIMNTNVLPFTASSLDITIMAMAGDDFCWSVKDIVKKLNQAFKSSF

SEQ ID NO: 3920 - protein, 346 aa, Setaria italica
GDAVVLQHGDGRAELLPSVAVGRAAGAVHGAADRRGVRPGGGGPGRGGGADDAAAAAGAGGGAPSAQGGQGQHQLGLVHHGAGLPRGLILSFGGHAAAAAFAKAEAHQVPSAPYYGAPAKAPKQEVVDAGAPSFHQERQAKRSYDAMVAEAAKVPVPATTRPASQNQDHILAERKRREKLSERFIALSKIVPGLKKMDKASVLSDAIKYVKQLQDQVKGLEDEARRRPVEAAVLVKKSQLSADDDDGSSCDENFVGAEAAGTLPEIEARVSDRTVLVRIHCENRKGALIAALSEVERLGLTIMNTNVLPFTTSSLDITIMAMAGDDFCLSAKDIVKKLNQAFKSSF

SEQ ID NO: 3921 - protein, 349 aa, Panicum virgatum
MATQWFSNMVIDEPSFFHQWQSDGLLEQYTEQQIAVAFGQGEVEVDQALAAALMPLQQPTAAAAEHRPRKAAKVNTSWDSCITEQGSPADSSSPTILSFGGHAFAKAETHQLPSAPYCGAPAKAPKQEVVDAGATAFHQERPAKRSYDAMVAEVAKVPAPATTRPASQNQDHILAERKRREKLSQRFIALSKIVPGLKKMDKASVLGDAIKYVKQLQDQVKGLEDEARRRPVEAAVLVKKSQLSADDDDGSSCDENFVGTEAAGTLPEIEARVSDRTVLIRIHCENRKGALISALSEVERLGLTIMNTNVLPFTTSTLDITVMAMAGDDFCLSVKDIVKKLNQAFKSSF

SEQ ID NO: 3922 - protein, 359 aa, Oryza sativa
MATQWFSNMVMDEPSFFHQWQSDGLLEQYTEQQIAVAFGQAGEADAAAAAAAMMVQQQQYAAAAAAEHRPRKAAKVNTSWDSCITEQGSPADSSSPTILSFGGHADAAAAAAFASAGQAQSAPYYGGASAAALKPKQELDAAAAPFSQARPVKRSYDAMVAADVAKAPAAAASRPASQNQEHILAERKRREKLSQRFIALSKIVPGLKKMDKASVLGDAIKYVKQLQDQVKGLEEEARRRPVEAAVLVKKSQLSADDDDGSSCDENFDGGEATAGLPEIEARVSERTVLVKIHCENRKGALITALSEVETIGLTIMNTNVLPFTSSSLDITIMATAGENFSLSVKDIVKKLNQAFKLSL

SEQ ID NO: 3923 - protein, 277 aa, Zea mays
MAEMTVTVAAAKSTLRTCPGARRAAVLGRWMPLAPAAPANLKLFSPAVRVPRATSPAAVEDGSNTDIVPIPKVIIDQDSDPDATIVEITLGDRLGDLLDTMSALKNLGLNVVKASVCLDSTGKHIKFAITRAFTGRKIDDPELLEAVRLTIINNMIQYHPESSSQLAMGATFGPEAPTEEVDVDIATHIDIYDDGPERSLLVVETADRPGLLVDLVKIISDISINVQSGEFDTEGLLAKAKFHVSYRGRTLTEALQQVLCNSLRYFLRRPTTEDASF

SEQ ID NO: 3924 - protein, 280 aa, Pennisetum glaucum
MAEMAVTIVAAADGTLRPCTGVSVRSAAVLGRWRPLAPAAPAKLRLSSPAVRVPRAASPAAVEDGSNTDTVPIPKVIIDQDSDPDATIVEVTLGDRLGDLLDTMDALKNLGLNVVKASVSLDSTGKHNKFSITKTSTGRKIDDPELLEAVRLTIINNMIQYHPESSSQLAMGATFGPEAPAEQVDVDIATHIDIYADGPERSLLVVEAADRPGLLVDLVRIISDINITVQSGEFDTEGLLAKAKFHVSYRGKSLTEALKQVLSNSLCYSLRRPSTEDASF

SEQ ID NO: 3925 - protein, 283 aa, Oryza sativa
MAEMAVTAALRPCSGVSPAVSGTSHRRRRPAAWRALAPPPPHAGLRLSSPAVRVPRAASSAAVEDGSSSNTDTVPTPKVIIDQDSDPDATIVEITLGDRLGDLLDTMNALKNLGLNVVKASVCLDSTGKHIKLAITKLSTGRKIGEPELLEAVRLTIINNMIQYHPEASSQLALGATFGPEPPTELVDVDIATHIDIYDDGPDRSLLVVETADRPGLLVDLVKIIDDINITVQSGEFDTEGLLAKAKFHVSYRGKPLIKALQQVLANSLRYFLRRPTTEEGSY

SEQ ID NO: 3926 - protein, 879 aa, Oryza sativa
MFGDCQVLSSMAAMAGAASSADALFASPLIPNPALAGFMSSSAAMPFHHFSNAAATLIPKEEGLMGGLHVAKDEGMDLEMDMELSGGSGSAHLDGLLSFADVDDDHKPQHSGHDQPPDAAQPSGAAGGNAKKKRYHRHTAHQIQQMEALFKECPHPDDKQRLKLSQELGLKPRQVKFWFQNRRTQMKAQQDRADNVILRAENENLKSDNFRLQAAIRNVVCPNCGHAAVLADMSYEEQQLRIENARLKDELDRLACIATRYGGGGGRQPVLSTSALSCISAPPPVLMPPLDLDMNVYSRHFAEQAPVMGCGDLIPPPVVPQHDGAAAYMGAMMAPVQEQDKQLVVDLAATAADQLARMCRAGEPLWVRQRGAEVMAVEEHARMFSWPVDGAKQGDGGAVARAEGTRDNAVVIMNSINLVDAFLDANKWMELFPSIVCKARTIQIINHGAASGHLGSGTLLLMQAEVQFLSPLVAAREVVFFRYCVHNADEGSWAIVDFPAEGFEEGLLQASVVRCRRRPSGCIIQDMPNGYSRVVWVEHMEMVGEEKPLQPVFRDYVASGAAFGATRWLSILQRQCERLASELARNIADLGVIRTPEARTNMMKLSQRMITTFCANISASGTQSWTALSDSTQDTIRVTTRKNTEPGQPSGVILTAVSTSWLPFTHQQVFELLADEQQRCQLEILSNGGSLHEVAHIANGSHPRNCISLLRINAASNSSQNVELLLQESSTHPDGGSLVVFATVDVDAIQVTMSGEDPSYIPLLPLGFAIFPATSPSPAAAPTISSSTTTTTGNGNGETSSTPPRNSSSNNNNADELLPPNGCLLTVGMQVLASAVPSAKLNLSSVTAINSHVCNAIHQITAALKSSAGGAGGEPASDQ

SEQ ID NO: 3927 - protein, 139 aa, Saccharum officinarum
MLHPLLAAVTAAASSSFVSPPRRVPASPGRRRRPGGFAVRCAPNGGGVTADDTKSKLKVGSPIVILEAPVMLKTAASVPSLRHNSGQVKAGDVGRIMARKPKDVWVVRLAVGSYLLDGKFFSPLDSNDGDDDEPQAQDE

SEQ ID NO: 3928 - protein, 139 aa, Zea mays
MPHPLLAAVSAAVYSSFISPPRRVPASLGRRRPAGVAVRCAPNGGGVPAAGDTKAKLKVGSPIIIVEAPVMLKTAASVPSLRHNSGQVKPGDVGRIMARKPKDVWVVRLAVGSYLLDGKFFSPLDSDNGDDGEPQAQDE

SEQ ID NO: 3929 - protein, 136 aa, Sorghum bicolor
MMRLLTGADQRDKSRGGGGVGFVFSPRSVDAFGSTVIAEGADDARQLYWVHAWTVGPDGVITQLREYFNTDLTVTLLSGAAASAKKADIAGAPRKQQDAASSSFSSPSAAAGPKCLWQSRRGDSAHKSLPGLVLAI

SEQ ID NO: 3930 - protein, 132 aa, Panicum virgatum
MMRLLTGAEKGSGGFVFSPRSVDAFGSTVIAEGADDARQLYWVHAWTVGPDGVITQLREYFNTDLTVTLLSGAASAKNAAIAAAPPKQDAASSSSSSAPSAGASSSTGPKCLWQSRRADRAHKSLPGLVLAI

SEQ ID NO: 3931 - protein, 440 aa, Zea mays
MERYHPSEVYELFVRHMNTPRVVVDNGVCATATLVQVHSARKHGVLLEAVAALSDHGVCVRKGYISSDDGRWFMDVFHVTDAAGRKVADADADALLARLESSLSADALPPRTPPAAAAGTPTLLELVGADRPGLLSEVFAVLHDLRCDIADARAWTHGGRVAALVFVRDEDTGAPIDDAARVRRVESRLRHVLRGGALGARMVRADAAAVNMDRRLHQLLNEDGEAESRADQATAVAVQDWGERGYSVLTVSCRDRPKLLFDVVCTLTDLDYVVYHGTFDTDGDHAQQEFYIRRLDGRPISSAAERRRVIQCLQAAIERRASEGVRLELRITDRRGLLAYVTRVFRENSLSVTHAEITTRGDMAMNVFHVTDVAGRPADPKTIDEVIQRIGTESLRVDEERWPRLCLTEGDAGRGGAGIFSLGSLVKKNLASLGLIRSCS

SEQ ID NO: 3932 - protein, 444 aa, Pennisetum glaucum
MERCHPCEVYELFVRHMNTPRVAVDNGVCATATLVQVHSARKHGVLLEAVAALSDHGVCVRKGYISSDDGRWFMDVFHVTDAAGRKVADADALLARLESSLSADALPPRTPPAAAAGAHTLLELVGADRPGLLSEVFAVLHDLRCDIVDARAWTHGGRVAALVFVRDEETGAPIDDAARVRRVESRLRHVLRGGARGARTVLADAEAVNMDRRLHQLLNEDGEAGSRADQAEAPTTTAVAVQDWGERGYSVVTVSCRDRPKLLFDVVCTLTDLDYVVYHGTFDTDGDHAQQEFYIRRLDGRPISSAAERRRVIQCLQAAIERRASEGVRLELRITDRRGLLAYVTRVFRENSLSVTHAEIATRGDMAMNVFHVTDVAGRPADPKTIDDVIQKIGTESLRVDEERWPRLCSTEGDAGRGGGAGIFSLGSLVKKNLVSLGLIRSCS

SEQ ID NO: 3933 - protein, 486 aa, Zea mays
MERYNPSEVYELFVRHMNNPRVVVDNGACATATLVQVHSARKHGVLLDAVAALSDHGVCVRKGYISSDDGRWFMDVFHVVDAAGGKVADAGALLARLESSLSADALPPRPPPAAAGAGTPTLLELVGADRPGLLSEVFAVLHDLRCGTVDARAWTHAGRVAALVFVRDEETGSPIDDAARVRRVESRLRHVLRGGALGARMVRADASAVNMDRRLHQLLNEDGEAGSRADRAESEAEAPTPTAVAVQDWVERGYSVVTVSCRDRPKLLFDVVCTLTDLDYVVYHGTFHTDDDHARQEFYIRRLDERPISSATERRRVIQCLEAAIERRASEGVRLELRITDRRGLLAYVTRVFRENSLSVTHAEITTRGRHGHERVPRHRRGRPTRGPQDHRRGDPEDRHGEPPGGRGAVAAPVLDGGRRWPRRRRCGDLLAREPCQEEPGQSWPHKILLVRTRSMGGMCSMGSLCKYGMVHGLVCKWSRGLNRRF

SEQ ID NO: 3934 - protein, 450 aa, Zea mays
MERYNPSEVYELFVRHMNNPRVVVDNGACATATLVQVHSARKHGVLLDAVAALSDHGVCVRKGYISSDDGRWFMDVFHVVDAAGGKVADAGALLARLESSLSADALPPRPPPAAAGAGTPTLLELVGADRPGLLSEVFAVLHDLRCGTVDARAWTHAGRVAALVFVRDEETGSPIDDAARVRRVESRLRHVLRGGALGARMVRADASAVNMDRRLHQLLNEDGEAGSRADRAESEAEAPTPTAVAVQDWVERGYSVVTVSCRDRPKLLFDVVCTLTDLDYVVYHGTFHTDDDHARQEFYIRRLDERPISSATERRRVIQCLEAAIERRASEGVRLELRITDRRGLLAYVTRVFRENSLSVTHAEITTRGDMAMNVFHVTDVAGRPADPKTIDEVIQRIGTESLRVDEERWPRLCSTEGDAGRGGGGAGIFSLGSLVKKNLVSLGLIRSCS

SEQ ID NO: 3935 - protein, 442 aa, Oryza sativa
MERYHPSEVYELFVRHMNTPRVVVDSGVCATATLVQVHSARKHGMLLEAVAALSEHGVCVRKGYISSDDGRWFMDVFHVTDAAGRKVADADALLARLESSLSAEALPRAAAGGPAAEGLTLLELVGADRPGLLSEVFAVLHDLRCNTVEARAWTHGGRVAALVFVRDEETGAPIDDAARVRRIESRLRHVLRGGARCARTVLADPSAAGNLDRRLHQLLKEDGEADSRGAAPMTAVAVQDWGERGYSVVTVSCRDRPKLLFDVVCTLTDLDYVVYHGTFDTDGDHAQQEFYIRRSDGRPISSEAERQHVIRCLQAAIERRASEGVRLELRISDRRGLLAYVTRVFRENGLSVTHAEITTRDDMAMNVFHVTDVAGRPADPKTIDEVIQRIGTESLRVDEERWPRLCSAEGDAAGRGGGGGLFSLGSLVKKNLFSLGLIRSCS

SEQ ID NO: 3936 - protein, 454 aa, Brachypodium distachyon
MERFHPSEVYEHFVRHMNTPRVVVDNGVCETATLVQVHSARKNGVLLEAVAALSDHGVCVRKGYISSDDGRWFMDVFHVTDAAGRKVADADKLLARLESSLAAAAATADALPRPAGCDSSPAQNEGLSLLELIGVDRPGLLSEVFAVLHDLRCSIVDAKAWTHGGRVAALVFVRDEDTGAPIDDAARTRRIESRLRYVLRGGARGARTILVDAAAVGNLDRRLHQLLNEDREADGRPAADRPTTTAVAVQEWGERGYSVVTVSCRDRPKLLFDVVCTLTDLDYVVYHGTFDTDGDHAQQEFYIRRLDGQPISSAAERQRVIQRLQAAIERRASEGVRLELSIKDRRGLLAYVTRVFRENSLSVTHAEITTRGDKALNVFHVTDVAGRPADPKAIDEVIHGIGTESLRVDEERWPRLCSTQGDAGRDGGAGGGLFSLGSLVKKNLYNLGLIRSCS

SEQ ID NO: 3937 - protein, 131 aa, Zea mays
MYTWQLKPRTRNGDLNPYSIYKLTHAPSHIYTRIPWSTCPPLIASSRAGSYEAKTDQVLLDKAPEREDPRTAAAAASVALRRAQARPPLLVHPEALRADPLDHLVDGLGVRGSAGHVGDVEHVHGHVAPWW

SEQ ID NO: 3938 - protein, 188 aa, Zea mays
MVGRKPMRRRRSDRQPPPQSFGATARPSSPRSFDSTTFATTAVATDLDELLLTAPPPSASEPRSFSYAVKQQCWEKAERVPGRDPERWRRDALGNIVFRKLVGCPGCLCHDYDHIVPYSKGGKSTLENCQVLQATVNRSKGNKTEISKSELIQKSAYCRVSGRDMDLVELSAYGNVRRGPDSGGCKIQ

SEQ ID NO: 3939 - protein, 185 aa, Setaria italica
MVGRKPMRRRRDRQPPPPPQSFGATARPTSPRSSASAAAVAADLDELLLTAPPSSASEPRSFPYAVKQQCWEKAERVPGRDPERWRRDALGNIVFRKLVGCPGCLCHDYDHIVPYSKGGKSTLENCQVLQATVNRSKGNKTEISKSELIQKSAYCRVSGRDMDLVELSAYGNVRRGPDSGGCKIQ

SEQ ID NO: 3940 - protein, 188 aa, Brachypodium distachyon
MVGRKPMRRRRADHPPPPPSQSFGATARPNSPRSPTSASAASVSADLDGLLLTAPPPSASEPRSFSYAVKQQCWEKAEKVPGRDPERWRRDALGNMVFRKLVGCPGCLCHDYDHIVPYSKGGKSTLENCQVLQATVNRSKGNKTEISKSELAQRSAYCRVSGRDMDLFELSAFGNVRRGPDSGGCKIQ

SEQ ID NO: 3941 - protein, 171 aa, Zea mays
MVGRKPMRRRRSDRQPPPQSFATTAVATDLDELLLTAPPPSASEPRSFSYAVKQQCWEKAERVPGRDPERWRRDALGNIVFRKLVGCPGCLCHDYDHIVPYSKGGKSTLENCQVLQATVNRSKGNKTEISKSELIQKSAYCRVSGRDMDLVELSAYGNVRRGPDSGGCKIQ

SEQ ID NO: 3942 - protein, 132 aa, Avena sativa
MVGRKPMRRRRADHPPPQSFGATARPTSPRSSTSASAVADLDDLLHTAPPSSASEPRSFSHAVKQQCWEKAEKVPGRDPERWRRDALQHRLPQARGLPWLPLPRLRPYPPLLQGREEHIGELPGFTGYCESI

SEQ ID NO: 3943 - protein, 180 aa, Hordeum vulgare
MVGRKPMRRRRADHPPPPQSFGATARPTSPRSSTSASAVADLDELLHTPSASEPRSFPHAVKQQCWEKAEKVPGRDPERWRRDALGNIVFRKLVGCPGCLCHDYDHILPYSKGGKSTLENCQVLQATVNRSKGNNTEISKSELAQRSAYCRVSGRDMDLFEVSAFGNVRRGPDSGGCKIQ

SEQ ID NO: 3944 - protein, 194 aa, Cynodon dactylon
AGGEEATWVGRKPMRRRRSERTPPPPPPPASSFGATARPTSPRYSTSAVAADLDDLLLTAPPPSASEPRSFPYAVKQQCWEKAERVPGRDPERWRRDALGNIVFRKLVGCPGCLCHDYDHIVPYSKGGKSTLENCQVLQATVNRSKGNKTEVSKSELIQKSTYCRVSGRDMDLVELSAYGNVRRGPDSGGCKIQ

SEQ ID NO: 3945 - protein, 187 aa, Oryza sativa
MVGRKPLRRRRHDAPPSPPLFGATPRPTSPRSSSASVAAVAEELDGLLLTAPRPSASSSEPRSFPYVVKQRCWEKAERVAGRDPERWRRDALGNVVFRKLVGCPGCLCHDYDHIVPYSKGGKSTLENCQVLQATVNRSKGNKTELSKSELIQKSAYCRVSGRDMDLLELSAYGNVRRGPDSGGCRIQ

SEQ ID NO: 3946 - protein, 180 aa, Triticum aestivum
PRVRMRRRRADHPSPPPPQSFGATARPTSPRSSTSASAVANLDELLYTPSASEPRSFPHAVKQQCWEKAEKVPGRDPERWRRDALGNIVFRKLVGCPGCLCHDYDHIVPYSKGGKSTLENCQVLQATVNRSKGNNTEISKSELAQRSAYCRVSGRDMDLFELSAFGNVRRGPDSGGCKIQ

SEQ ID NO: 3947 - protein, 194 aa, Triticum aestivum
  misc_feature (38)..(38): Xaa can be any naturally occurring amino acid
RHCDGTPPDRKIMVGRKPMRRRRADHPPPPPPQSFGAXARPTSPRSSTSASAVADLDELLYTPSASEPRSFPHAVKQQCWEKAEKVPGRDPERWRRDALGNIVFRKLVGCPGCLCHDYDHIVPYSKGGKSTLENCQVLQATVNRSKGNNTEISKSELAQRSAYCRVSGRDMDLFELSAFGNVRRGPDSGGCKIQ

SEQ ID NO: 3948 - protein, 537 aa, Zea mays
MLRKSGTQRQQPALWRRCRSLRQIKQVHALMVLQGFLSDSSALRELIFASAVGVRGGTAHARLVFDRIPHPDRFMYNTLIRGAAHSDAPRDAVSIYARMARHSADCDLMTLRPDKRTFPFVLRACAAMGAGETGAQVHAHVVKAGCESDAFVRNALIGMHATLGDLGAAAALFDGEAREDAVAWSAMISGFARRGDIGAARELFDESPVKDLVSWNVMITAYAKLGDMAPARELFDGAPDRDVVSWNAMISGYVRCGSRKQAMELFEQMQAMGEKPDTVTMLSLLSACADSGDLDAGRRLHGFLSGRFSRIGPTTALGNALIDMYAKCGSMTSALEVFWLMQDKNVSTWNSIIGGLALHGHATESIAVFRKMLQGNVKPDEITFVAVLAACSHGGMVDKGHEYFSLMQQRYRIEPNIKHYGCMVDMLSRGGLLKEAFEFIGTMKIEPNPVIWRTLLGACRIHGEIELAEHANRELLKARSDASGDFVLLSNIYASVGEWPGSENMRKLMDDSGVNKEAGRAVIDSSSKDLMRSSRLF

SEQ ID NO: 3949 - protein, 500 aa, Zea mays
MVLQGFLSDSSALRELIFASAVGVRGGTAHARLVFDRIPHPDRFMYNTLIRGAAHSDAPRDAVSIYARMARHSADCDLMTLRPDKRTFPFVLRACAAMGAGETGAQVHAHVVKAGCESDAFVRNALIGMHATLGDLGAAAALFDGEAREDAVAWSAMISGFARRGDIGAARELFDESPVKDLVSWNVMITAYAKLGDMAPARELFDGAPDRDVVSWNAMISGYVRCGSRKQAMELFEQMQAMGEKPDTVTMLSLLSACADSGDLDAGRRLHGFLSGRFSRIGPTTALGNALIDMYAKCGSMTSALEVFWLMQDKNVSTWNSIIGGLALHGHATESIAVFRKMLQGNVKPDEITFVAVLAACSHGGMVDKGHEYFSLMQQRYRIEPNIKHYGCMVDMLSRGGLLKEAFEFIGTMKIEPNPVIWRTLLGACRIHGEIELAEHANRELLKARSDASGDFVLLSNIYASVGEWPGSENMRKLMDDSGVNKEAGRAVIDSSSKDL

SEQ ID NO: 3950 - protein, 410 aa, Setaria italica
MGAGGTGAQVHAHVVKAGCESDAFVRNALIGMHASCGDLGVAASLFDSGARGDAVAWSAMISGCARRGDIGAARELFDESPVKDLVSWNVMITAYAKRGEMALARELFDRVPDRDVVSWNAMISGYVRSGSHRHAIELFEQMQCVGEKPDTITVLSLLSACADSGDLDVGQRLHSYLSERFSRTGLTTVLGNALIDMYAKCGSMKCAHEVFWSMRDKDVSTWNSIIGGLALHGHVNESIDLFEKMLKGNVKPDEITFVAVLVACSHGGMVDKGHKYFNLMQQQYRIEPNVKHFGCMVDMLSRAGLLKEAFEFIDTMKVEPNSVIWRTLLGACRIHGEVELAEHANLELLKARSDASGDYVLLSNIYASVGEWLGSEKMRKLMDDTGVNKEAGRAVIDGSSKDLMQSSRQF

SEQ ID NO: 3951 - protein, 553 aa, Brachypodium distachyon
MEESHDMPVTAFFPLAGLHKYVAIFVIVLSWILVHRWSLRNQKGPKSWPVIGATLEQLRNYYRMHDWLVEYLSKYRTVTVDMPFTSYTYIADPVNVEHVLKTNFNNYPKGEVYRSYMDVLLGDGIFNADGELWRKQRKTASFEFASKNLRDFSTIVFREYSLKLSSILSQACKTGKVVDMQELFMRMTLDSICKVGFGVEIGTLSPDLPENSFAQAFDAANIIVTLRFIDPLWRLKKLLRVGSEALLEQSIKLVDEFTYSVIRRRKAEIVQARASGKQEKIKHDILSRFIELGEAGVDNDNGGGISLFGDDKGLRDVVLNFVIAGRDTTATTLSWFTYMAMTHPPVAEKLRRELAAFESDRAREEGISLIPFFSDSDGPENQSSFAARVAQFAALLTYDGLGKLTYLHACVTETLRLYPAVPQDPKGVAEDDVLPDGTKVKAGGMVTYVPYSMGRMEYNWGPDAGCFRPERWIGEDGGFRNASPFKFTAFQAGPRICLGKDSAYLQMKMALAILFRFYRFEILEGHPVKYRMMTILSMAHGLKVRVSRAPALV

SEQ ID NO: 3952 - protein, 232 aa, Zea mays
MASSLLLRPRALLPPHPIPSSSRRPLPAPRVQLQGSIQEKPGLPAKSDGERRRPAGTRLYSLAPYPLLLAALLPGAEPVTAVFAPFVELVKTWDLPGWLVHWGHPGNMAVVLFAMGGYGTYLGFRIKLSDDLEEKAKAKDLHPKLLAGMFFFFALGATGGITALLTSDKPIFESPHAVTGVIGLALLTIQSVLPKLFEGNPGLRTTHGLLGSGIMTLFLIHAALGLQLGISF

SEQ ID NO: 3953 - protein, 240 aa, Zea mays
MVAVSTATMASSLLLRPRALLPPHPIPSSSRRPLPAPRVQLQGSIQEKPGLPAKSDGERRRPAGTRLYSLAPYPLLLAALLPGAEPVTAVFAPFVELVKTWDLPGWLVHWGHPGNMAVVLFAMGGYGTYLGFRIKLSDDLEEKAKAKDLHPKLLAGMFFFFALGATGGITALLTSDKPIFESPHAVTGVIGLALLTIQSVLPKLFEGNPGLRTTHGLLGSGIMTLFLIHAALGLQLGISF

SEQ ID NO: 3954 - protein, 224 aa, Panicum virgatum
MASSLLLRPRASFRRALPPPPPSSRRALPAPRVQAASTKQEQPGRPAGTRLYSLAPYPLLLAALLPGAEPVTAVFAPFVELVKTWDLPGWLVHWGHPGNMAVVLFAMGGYGTYLGFRIKLSDDPEEKAKAKDLHPKLLAGMFFFFALGATGGVTALLTSDKPIFESPHAVTGVIGLALLTIQSILPKLFEGNPGLRTTHGLLGSGIMTLFLIHAALGLQLGISF

SEQ ID NO: 3955 - protein, 207 aa, Saccharum officinarum
MASSLLLRPRAVLPPHPSSSSSGRRPFPAPRAQLQANIQHKPGLTARSDGERRQPAGTRLYSLAPYPLLLAALLPGAEPVTAVFAPFVELVKTWDLPGWLVHWGHPGNMAVVLFAMGGYGTYLGFRIKLSDDLEEKAKAKDLHPKLLAGMFFFFALGATGGITALLTSDKPIFESPHAVTGVIGLALLTIQSILPKLFEGNPGLRTT

SEQ ID NO: 3956 - protein, 208 aa, Saccharum officinarum
MASSLLLRPRAVLPPHPSSSSSGRRPFPAPRAQLQANIQHKPGRLTARSDGERRQPAGTRLYSLAPYPLLLAALLPGAEPVTAVFAPFVELVKTWDLPGWLVHWGHPGNMAVVLFAMGGYGTYLGFRIKLSDDLEEKAKAKDLHPKLLAGMFFFFALGATGGITALLTSDKPIFESPHAVTGVIGLALLTIQSILPKLFEGNPGLRTT

SEQ ID NO: 3957 - protein, 523 aa, Zea mays
MPPHGGMLAYAALALAALRLLLSYKSALYALRRLWRCADEWAQAYQYHEVPRFAGAQCGCDGAENPLFRKVAAYVAALPSLEDADAACVVSSASRTNGGLSLQLGPGHTARDTYLGARLAWTSAGGERLVLRVRRHDRSRVLRPYLQHVESVAEEMEQRRRELRLFANTAVDATTGAPRWASAPFTHPATLDAVAMDPDLKARVRADLESFLKGRAYYHRLGRVWRRSYLLYGPPGTGKSTFAAAMARFLGYDVYDVDLSRADAAGDDLRALLLHTTPRSLVLVEDLDRYLQGGGGDAEARAARVLSFMDGIASCCGEERVMVFTMRGGKDAVDAAVVRPGRLDVHIQFTLCDFEAFKALASNYLGLKDHKLYPQVEEGFHAAGARLSPAELGEIMLANRASPSRALRSVITKLQRVASGGAAPPRNPAHRRNTSWSGAWTGQQWEDQAQPARASAVSVEVDETAAGAPATCGGVFGKEAPMREFKKLYGLIKVRSRREGAGAVPLEGDAHGPPTPGNHDRER

SEQ ID NO: 3958 - protein, 523 aa, Oryza sativa
MLLGAMSGGGVVVAVAVAYAALAVVALRMALSYKSALYAVRRLWRWADEWAQAYQYHEVPRFACDGGGAENPLFRKAAQYVAVLPSLEDADAASVLSSASRTNGGFSLQLGPGHTARDAFLGARLAWTNRGDVLVLRVRRHDRTRVLRPYLQHVESVADEMELRRRELRLFANTGVDGSTGTPRWASAPFTHPATLDTVAMDPDLKARVRADLENFLKGRAYYHRLGRVWRRSYLLYGPLGTGKSTFAAAMARFLGYDIYDVDLSRAGSDDLRALLLHTTPRSLILVEDLDRFLQGGGAGDAEARAARVLSFMDGVASCCGEERVMVFTMRGGKEGVDAAVVRPGRLDVHIHFTLCDFEAFKALASNYLGLKDHKLYPQVEESFHGGARLSPAELGEIMLANRSSPSRALRNVITKLQHVSGAAAAPRPPHRRNTSWSGAGGPWEEQAARASADAADGGEEAITATAACGVFAKDAPMREFKKLYGLIKIRSRKEGSSGFMPLHGGEAPSPANGRGSEHDKER

SEQ ID NO: 3959 - protein, 455 aa, Zea mays
MDPCPFVRVLVGNLALKMPASASPATPRASGSGVHPTAARCHCRIRLNKMPYQTASAPLLPATEDGPASCTAAFAAAFHVSKADLDRAAARPAAALLLAARRRRTARLKVAVYAGRGGGVSASCGGGGATSGRLLGKVVLPLDLRAAMAKPVVFHSGWVAVGSRRGKAAAAASSSARAQLSITVRAEPDPRFVFQFDGEPECSPQVLQVKGSMKQPMFTCRFSCRSSSDLRSRSVQSDPGARNWLAKLGSERERAGKERKGWSVTVHDLSGSPVALASMVTPFVASPGTDHVSRSSPGAWLILRPADGTWAPWGRLECWRGRGDTLGYRFELVPGHATGGAGVCVAEASVPASRGGRFAIDLTAAAQPFWCSSSGDMGHGIWPFGGFVMSAAVQGEGRCSRPTVEVGVAHVGCAEDAAAFVALAAAVDLSMDACRLFSCKLRRELSTASRAEFLR

SEQ ID NO: 3960 - protein, 455 aa, Zea mays
MDPCPFVRVLVGNLALKMPASASPATPRASGSGVHPTAARCHCRIRLNKMPYQTASAPLLPATEDGPASCTAAFAAAFHVSKADLDRAAARPAAALLLAARRRRTARLKVAVYAGRGGGVSASCGGGGATSGRLLGKVVLPLDLRAAMAKPVVFHSGWVAVGSRRGKAAAAASSSARAQLSITVRAEPDPRFVFQFDGEPECSPQVLQVKGSMKQPMFTCRFSCRSSSDLRSRSVQSDPGARNWLAKLGSERERAGKERKGWSVTVHDLSGSPVALASMVTPFVASPGTDHVSRSSPGAWLILRPADGTWAPWGRLECWRGRGDTLGYRFELVPGHATGGAGVCVAEASVPASRGGRFAIDLTAAAQPFWCSSSGDMGHGIWPFGGFVMSAAVQGEGRCSRPPVEVGVAHVGCAEDAAAFVALAAAVDLSMDACRLFSCKLRRELSTASRAEFLR

SEQ ID NO: 3961 - protein, 507 aa, Zea mays
MEAAAASSLWGGLNSGIMLSLLAVVWAMLWQALQGLQLQQYFGRHSRRLSRRLASILDPDLTVTVAEYDGGRMRRSDAFKEAKAYLERATREARGGVRHLKAEPDKDPDRLLLSMDDDEEITDEFRGATVTWRACTAPPREDSAPAYFWGRAPRADRRFYRLFFAERHRDLVLGDYLTHVRREGRAVMVKNRQRKLFTNISGDGSWDSDGVWSHVVFEHPKTFATLAMDPDKKKEVMDDLDAFRNGKDYYARVGKAWKRGYLLYGPPGTGKSTMIAAMANHLDYDVYDIELTSVRTNTDLRKLFIETTSKSIIVVEDIDCSLDLTGKRKKKNKKEEDGENKKDGTTTKQQEEDKEKEDEKAGGSKVTLSGVLNFIDGLWSACGGERIIVFTTNHVEKLDPALIRRGRMDKHIEMSYCCVQAFKFLAKVYLDVDDHPRFDAVAALLREVDMTPADVAENLTPKAPGEDADSCLAALVEALEKAKEDALAKKAKGKEEAGSADELDDEE

SEQ ID NO: 3962 - protein, 512 aa, Zea mays
MEAAAASSLWGGLNSGIMLSLLAVVWAMLWQALQGLQLQQYFGRHSRRLSRRLASILDPDLTVTVAEYDGGRMRRSDAFKEAKAYLERATREARGGVRHLKAEPDKDPDRLLLSMDDDEEITDEFRGATVTWRACTAPPREDSAPAYFWGRAPRADRRFYRLFFAERHRDLVLGDYLTHVRREGRAVMVKNRQRKLFTNISGDGSWDSDGLWSDSVWSHVVFEHPKTFATLAMDPDKKKEVMDDLDAFRNGKDYYARVGKAWKRGYLLYGPPGTGKSTMIAAMANHLDYDVYDIELTSVRTNTDLRKLFIETTSKSIIVVEDIDCSLDLTGKRKKKNKKEEDGENKKDGTTTKQQEEDKEKEDEKAGGSKVTLSGVLNFIDGLWSACGGERIIVFTTNHVEKLDPALIRRGRMDKHIEMSYCCVQAFKFLAKVYLDVDDHPRFDAVAALLREVDMTPADVAENLTPKAPGEDADSCLAALVEALEKAKEDALAKKAKGKEEAGSADELDDEE

SEQ ID NO: 3963 - protein, 464 aa, Zea mays
MARSGREAEPGEEERKLVLGKYELGRLLGQGTFAKVYYARDLSAGAGTGHSCSVAIKVIDKARLRRTEGMVEQLRREISIMRMVRHPNVVGIREVLASRSRVFVVMEYARGGELFAKVARGRLDEDHARRYFQQLVAAVGFCHRRGVAHRDLKPENLLLDEAGRLKVTDFGLAALPEQLRHDGLLHTQCGTPAYVAPEVLRKRGYDGARADLWSCGVVLYVLLCGFLPFQHDNYVKLYQKIFKADYQVPPWVSGDARRLIARLLVVDPAKRASIAEIMCTPWFRKGFVPPVLSPPVTPKKQQLDEGAALFDNDDDDNSNSNHSGATSPRSCNAFQLISSMSSGFDLSGLFESEQKTATVFTARAPAATVVEKLESVARALGFEVTRGKGWKVRMEAKAEGTNGRLAATAEVLEVAVDVTVVEFVHDAGDALDFNKFCAVDVRPGLTEIVWAWQGDSPAAAVGTA

SEQ ID NO: 3964 - protein, 461 aa, Zea mays
MARSRREGEAGGEERKLVLGKYELGRLLGQGTFAKVYYARDLSAAAGTGSTSVAIKVIDKARLRRMEGMVEQLRREISIMRMVRHPNVVGIREVLASRSRVFVVMEYARGGELFAKVARGRLTEDHARRYFQQLVAAVGFCHRRGVAHRDLKPENLLLDEDGRLKVTDFGLAALPEQLRHDGLLHTQCGTPAYVAPEVLRKRGYDGARADLWSCGVVLYVLLCGFLPFQHDNCAKMYQRIFKAEYQVPPWVSGDARRLIARLLVVDPAKRASIPEVMCTPWFRKGFVPPVLSVSPPMTPKKRLDGDDDGGGALFDSSSNSGATSPRSCNAFQLISSMSSGLDLSGLFENEQKAATVFTARAPAATVVEKLESAARALGFETTRGKGWKVRMEAKAGGTNGRLAVTAEVLEVAVDVAVVEFAHDAGDALDFNKFCAVDVRPGLAEIVWAWQGDSPAAVVGTA

SEQ ID NO: 3965 - protein, 461 aa, Zea mays
MARSRQEGEAGGEERKLVLGKYELGRLLGQGTFAKVYYARDLSAAAGTGSTSVAIKVIDKARLRRMEGMVEQLRREISIMRMVRHPNVVGIREVLASRSRVFVVMEYARGGELFAKVARGRLTEDHARRYFQQLVAAVGFCHRRGVAHRDLKPENLLLDGDGRLKVTDFGLAALPEQLRHDGLLHTQCGTPAYVAPEVLRKRGYDGARADLWSCGVVLYVLLCGFLPFQHDNCAKMYQRIFKAEYQVPPWVSGDARRLIARLLVVDPAKRASIPEVMCTPWFRKGFVPPVLSVSPPMTPKKRLDGDDDGGGALFDSSSNSGATSPRSCNAFQLISSMSSGLDLSGLFENEQKAATVFTARAPAATVVEKLESAARALGFETTRGKGWKVRMEAKAGGTNGRLAVTAEVLEVAVDVAVVEFAHDAGDALDFNKFCAVDVRPGLAEIVWAWQGDSPAAVVGTA

SEQ ID NO: 3966 - protein, 992 aa, Zea mays
MDSRPRETDAPGDPANGAAPPLAAAVTAATGDVEIIRPRNDKRGYRRVVLPNSLECLLISDPDTDKAAASMNVSVGYFCDPDGLEGLAHFLEHMLFYASEKYPEEDSYSKYIAEHGGSTNAFTSSEHTNFYFDVNSDSLHDALDRFAQFFIKPLMSPDATLREIKAVDSENQKNLLSDPWRMSQLQKHLCAENHPYHKFSTGNWNTLEVKAKEKGLDTRLELIKFYDSHYSANLMQLVVYGKDSLDNLQNLVENKFCDIRDVGRKPFSFPGHPCTPEHLQVLVKAVPIKQGHTLRILFPITPNIRCYKEGPCKYISHLIGHEGEGSLFYVLKKLGWAMSLEAGEGDWSHDFSFFCVVIQLTDVGQEHMEDTLGLLFRYIKLLQNSGTPKWIFDELQAICETGFHYRDKSPPINYVVNISSNMQIFPPKDWLIASSVPSKFSPDAIQNVLNELTPETVRIFWESKKFEGKTKLAEPWYGTSYSVEVVPPSIIQKWVGKAPEEDLHLPKRNIFIPSDLSLRSVEEKVSFPAMLRKTQFSRLWYKPDTMFFTPKAYIKMDFHCPLSQSSPESAVLTDVFTRLLMDYLNDYAYDAQVAGLYYVVKPNDTGFQVTMVGFNDKMRTLLETVIGKIAEFEVKADRFSVIKEAMTKEYENFKFRQPYQQVLYYCSLILEDQTWPWDEEFSALSHLEASDLGIFLPHLLSKTFIECYFAGNIEPNEANNIVQHVEDVLFNAPISACKPLSPSQHLAKRIVKLEKGLRYYYPAMCSNHQDENSALLHYIQTHQDNVKQNVLLQLLALVGKQPAFHQLRSVEQLGYIALLRQRNDSGVRGLQFIIQSTVKDPANLDARVENFLNMFESNVYNMSDAEFKSNVSALIDMKLEKYKNIREESAFFYGEISEGTLKFDRKEAEVAALRELKKEELVGFFNDHVKVNAPQKKILSIQVYGGLHSAEYETIVQNAPPPPSCEITDIYGFRRSRPLYGSFRGGVGQMKL

SEQ ID NO: 3967 - protein, 467 aa, Panicum virgatum
MDSRPRETDAPGDPANGAAPPPAAAVAAAATGGVEITKPRNDKREYRRVVLPNALECLFISDPDTDKAAASMSVSVGYFCDPDGLEGLAHFLEHMLFYTSEKYPIEDSYSKYIAEHGGSTNAFTTTERTNFYFDVNSDSLHDALDRFAQFFIKPLMSPDAVHREIKAVDSENQKNLLSDPWRMSQLQNHLCDENHPYHKFGTGNWDTLEVKAKEKGLDTRLELIKFYDSHYSANLMKLVVYGKDSLDNLQNLVENKFCDIRDIGRKPFSFPGHPCSSEHLQILVKAVPIKQGHTLRILWPITPNVRCYKEGPCKYISHLIGHEGEGSLFYILKKLGWAISLEAGEGDWSYDFSFFSVVIRLTDEGQEHMEDAVGLLFRYITLLQTSGTPKWIFDELQTICETGFHYRDKGPPIHYVVNISSNMQIFPPEDWLIAASMPSKFSPDAIQNILNELTPENVKDILGIEKV

SEQ ID NO: 3968 - protein, 988 aa, Oryza sativa
MDSRPPETDAPAEAVPPAAAAAAAAAGDVEITRPRNDKRGYRRVVLPNDLECLLVSDPDTDKAAASMNVSVGYFCDPEGLEGLAHFLEHMLFYASEKYPIEDSYSKYITEHGGSTNAFTTCEHTNFFFDVNHDCLNDALDRFAQFFIKPLLSADATLREIKAVDSENQKNLLSDPWRMNQLQNHISLESHPYHKFGTGNWDTLEVKPKEKGLDTRLELIKFYDSHYSANLMQLVVYGKESLDNLQTLVENKFCGVRNTGRERFSFPGHPCSSEHLQVLVKAVPIKQGHTLRILWPITPNIRHYKEGPCKYVSHLIGHEGEGSLFYVLKKLGWAMSLEAGEGDWSYEFSFFSVVIKLTDVGHEHMEDIVGLLFRYITLLQTSGTLKWIFDELQTICETGFHYRDKGPPIHYVANISSNMQIYPPEDWLIASSVPSKFSPDAIQGILNELTPDNVRIFWESKKFEGQTNLTEPWYGTSYSVEAVPPSIIQKWVEKAPVEDLHMPKPNIFLPSDLSLKNAEEKASFPCMLRKTLFSRVWYKPDTMFFTPKAYIKMDFHCPLSRSSPESSVLTDVFTRLLMDYLNDYAYDAQVAGLYYGVRPNDTGFQITMVGYNDKMRTLLETVIGKIAEFEVKADRFSVIKETITKEYENFKFRQPYQQAFYYCSLILEEQTWAWDEELAAVSQIEASDLEKFLPHLLGKTFIESYFAGNMEPGAVKGVMQHVEDILFNAPVSLCKALPSSQHLTKRIVKLERGLRYYYPALCLNHQDENSCLLHYIQIHQDDLKKNVILQLLALVAKQPAFHQLRSVEQLGYITLLRQKNDSGVRGLQFIIQSTVKDPANLDARVEAFLTMFEGTLYQMPDTEFKSNVNALIDMKLEKYKNIREESAFFWGEISEGTLKFDRKEVEVAALRDLKKEELIEFFNNHVKVNAPQKKILSIQVYGGLHSSEYEKIVHDEPRPNSYQITDIFNFRRSRPLYGSYKGGVGQMKL

SEQ ID NO: 3969 - protein, 987 aa, Triticum aestivum
  misc_feature (13)..(13): Xaa can be any naturally occurring amino acid
  misc_feature (26)..(26): Xaa can be any naturally occurring amino acid
  misc_feature (308)..(308): Xaa can be any naturally occurring amino acid
MDSRLREVDAPAXPADGAAALATAKXEVEVTKPRNDRRGYRRVVLPNALECLLISDPDTDKAAASMNVSVGYFCDPDGMEGLAHFLEHMLFYASEKYPIEDSYSKYISEHGGSTNAFTASEHTNFYFDVNNDSLDDALDRFAQFFIKPLMSPDATLREIKAVDSENQKNLLSDPWRMSQLQKHLCSNNHPYHKFSTGNWDTLEVKPKEKGLDTRAELINFYDSHYSANLMQLAVYGKESLDNIQTLVESKFCDIKNVGRKHFSFPGHPCSSKDLQILVKAVPIKQGHTLRILWPITPNVRHYKEGPCXYVSHLIGHEGEGSLFYILKKLGWAMSLEAGEGDWSYDFSFFSVVIQLTDVGHEHMEDVVGLLFRYITLLQTSGTPKWIFDELLAICETGFHYRDKSPPSNYVVNISSNMQIFPPEDWLIASSVPSKFSPDAIQKVLNELTTENVRIFWESKLFEGHTDLTEPWYGTSYCVEAVPPSIMQKWVENAPNEDLHLPKPNIFIPTDLSLKNVEEKTSFPCMLRKTLFSRLWYKPDTMFFTPKVFIKMDFHCPLSNSSPESSVLTDVFTRLLMDYLNDYAYDAEVAGLYYAVRPNDTGFQVTMVGYNDKMRTLLDTVIGKIADFEVKIDRFSVIKETMTKGYENFKFRQPYQQAMYNCTLILEEQTWPWDEELAALSNLEARNLEDFLPRMLAKTFIECYFAGNIEPSEAESVVQHIEGILFNSSTSVCKSLPPSQHLTKRIVKLERGLRYYYPAMCLNQQDENSSLLHYIQIHQDDLKQNVLLQLLAVVAKQPAFHQLRSVEQLGYIALLRQRNDSGVRGLQFIIQSTVKDPSNLDARVEAFLKMFEVTLHEMPDAEFKSNVNALIDMKREKYKNIREESAFFWGEISQGTLKFDRKETEIAALEELKKEELIEFFDNHVKVGAPEKKILSIQIYGGLHSSEYEKIIHDAPPPHSHRITDIFSFRRSRPLYGSFRGGAGQMKL

SEQ ID NO: 3970 - protein, 987 aa, Hordeum vulgare
MDSRLREVDVPSEPAGGASAPAIAKVEVEVTKPRNDRRGYRRVVLPNALECLLISDPDTDKAAASMNVSVGYFCDPDGMEGLAHFLEHMLFYASEKYPIEDSYSKYIAEHGGSTNAFTTSEHTNFYFDVNNDSLDDALDRFAQFFIKPLMSPDATLREIKAVDSENQKNLLSDPWRMSQLQKHLCSNNHPYHKFSTGNWDTLEVKPKEKGLDTRAELINFYDSHYSANLMQLVVYGKDSLDNIQTLVESKFCDIKNVGRKHFSFPGHPCSSKDLQILVKAVPIKQGHTLRILWPITPNVRHYKEGPCKYVSHLIGHEGEGSLFYILKKLGWAMSLEAGEGDWSYEFSFFSVVIQLTDVGQEHMEDVVGLLFRYITLLQTSGTPKWIFDELLSICETGFHYRDKSPPMNYVVNISSNMQIFPPEDWLIASSVPSKFSPDAIQKVLNELTTENVRIFWESKLFEGQTDLTEPWYGTSYSVEAVPPSIMQKWVENAPNEDLHLPKPNIFIPTDLSLKNVEEKASFPCMLRKTPFSRLWYKPDTMFFTPKVFIKMDFHCPLSNSSPESSVLTDVFTRLLTDYLNDYAYDAEVAGLYYAVRPNDTGFQVTMVGYNDKMRTLLDTVIGKIADFEVKIDRFSVIKETITKGYENFKFRQPYQQAMYNCTLILEEQTWPWDEELAALSNLEARNLEDFLPRMLAKTFIECYFAGNIEPSEAESVVQHIEGTLFNSSTSVCKSLPPSQHLTKRIVKLERGLRYYYPAMCLNQQDENSSLLHYIQIHQDDLKQNVLLELLAVVAKQPAFHQLRSVEQLGYIALLRQRNDSGVRGLQFIIQSTVKDPSNLDARVEAFLKMFEVTLHEMPDAEFKSNVNAVIDMKREKYKNIREESAFFWGEISQGTLKFDRKEAEVAALGELKKEELIEFFDNYVKVGAPEKKILSIQIYGGLHASEYEKIVHDVPPPHSHRITDIFSFRRSRPLYGSFKGGAGQMKL

SEQ ID NO: 3971 - protein, 987 aa, Brachypodium distachyon
MDSRPREGDAPTEPADGGAPPATAKVEVEITKPRNDKREYRRVVLPNALECLLISDPDTDKGAASMNVSVGYFCDPDGMEGLAHFLEHMLFYASEKYPIEDSYSKYIAEHGGSTNAFTSSEHTNFYFDVNSDCLDDALDRFAQFFIKPLMSSDATLREIKAVDSENQKNLLSDPWRMSQLQKHLCSNNHPYHKFSTGNWDTLEVKPKEKGLDTRLELIRFYDSHYSANLMQLVVYGKESLDKIQTLVENKFFDIKNVERKPFSFPGHPCASKDLQILVKAVPIKQGHTLKILWPITPNIRHYKEGPCKYVSHLIGHEGEGSLFYILKKLGWAMSLGSGEGDSNYEFAFFSVVIQLTDVGHEHMEDIVGLLFRYIALLQTSGTPKWIFDELLAICETGFHYRDKSPPIHYVVNLSSNMQIFPPEDWLIASFVPSKFSPDAIQKVLDELTPENVRIFWESKKFEGQTNLIEPWYGTSYCVEAVPPSIIQKWIEKAPKEDLHLPKPNIFIPTDLSLKNVEDKANFPCVLRKTPFSRLWYKPDTMFSTPKVYIKMDFHCPLAHSSPESSVLTDVFTRLLMDYLNEYAYDAQVAGLYYVVGPNDTGFQVTMVGYNDKMRTLLETVIGKIAEFEVRVDRFSVVKETMTKQYENFKFLQPYQQAMDYCRLILEDQTWPWDEELAVLSNLGANDLEIFWPHMLAKTFIECYFAGNIEPGEAKGVIQHVEDTLFNSPIGVCKSLLPSQHLTKRIVKLERGLKYYYPVMGLNHQDENSSLLHYIQIHQDDLKQNVLLQLLALVAKQPAFHQLRSVEQLGYITLLRQRNDSGVRGLQFIIQSTAKDPFSLDARVEAFLTMFEGTLYQMPDAEFMSNVNALIDMKLEKYKNIREESAFFWGEISEGTLNFGRKEAEVAALRELKKDELIEFFNNHVKVNAPEKKILSVQVYGGLHSSEYEKILHDAPPPHSHRITDIFSFRRSRPLYGSFKGGVSQMKL

SEQ ID NO: 3972 - protein, 113 aa, Setaria italica
APGDPANGAAPPPPTGDVEITKPRNDKRGYRRVVLPNALECLLISDPETDKAAASMNVSVGYFCDPDGLEGLAHFLEHMLFYASEKYPVEDSYSKYIAEHGGSTNAFTSSLLF

SEQ ID NO: 3973 - protein, 987 aa, Triticum aestivum
MDSRLREVDAPAEPADGAAALATAKAEVEVTKPRNDRRGYRRVVLPNALECLLISDPDTDKAAASMNVSVGYFCDPDGMEGLAHFLEHMLFYASEKYPIEDSYSKYIAEHGGSTNAFTTSEHTNFYFDVNNDSLDDALDRFAQFFIKPLMSPDATLREIKAVDSENQKNILSDPWRMSQLQKHLCSNNHPYHKFSTGNWDTLEVKPKEKGLDTRAELINFYDSHYSANLMQLAVYGKESLDNIQTLVESKFCDIKNVGRKHFSFPGHPCSSKDLQILVKAVPIKQGHTLRILWPITPNVRHYKEGPCRYVSHLIGHEGEGSLFYILKKLGWAMSLEAGEGDWSYDFSFFSVVIQLTDVGHEHMEDVVGLLFRYITLLQTSGTPKWIFDELLAICEMGFHYRDKSPPSNYVVNISSNMQIFPPEDWLIASSVPSKFSPDAIQKVLNELTTENVRIFWESKLFEGHTDLTEPWYGTSYCVEAVPPSIMQKWVENAPNEDLHLPKPNIFIPTDLSLKNVEEKTSFPCMLRKTLFSRLWYKPDTMFFTPKVFIKMDFHCPLSNSSPESSVHTDIFTRLLMDYLNDYAYDAEVAGLYYAVRPNDTGFQVTMVGYNDKMRTLLDTVIGKIADFEVKIDRFSVIKETITKGYENFKFQQPYQQAMYNCTLILEEQTWPWDEELAALSNLEARNLEDFLPRMLAKTFIECYFAGNIEPSEAESVVQHIEGILFNSSTSVCKSLPPSQHLTKRIVKLERGLRYYYPAMCLNQQDENSSLLHYIQIHQDDLKQNVLLQLLAVVAKQPAFHQLRSVEQLGYIALLRQRNDSGVRGLQFIIQSTVKDPSNLDARVEAFLKMFEVTLHEMPDAEFKSNVNALIDMKREKYKNIREESAFFWGEISQGTLKFDRKETEIAALEELKKEELIEFFDNHVKVGAPEKKILSIQIYGGLHSSEYEKIIHDAPPPHSHRITDIFSFRRSRPLYGSFKGGAGQMKL

SEQ ID NO: 3974 - protein, 314 aa, Zea mays
MAYRALEVTLLSAKDLKRVNLISRMEVYAVVSISGDPLTRQCTQPDPYGGRHPSWNTSFRFNVPPTAATATGCLHVLLRTERALGDRDVGEVIVPLADILATAGGASDPGPRPPQLASYQVRKVHRCEPRGVLNVSYRLGPIVGQQAAPLARADEAAAAFVGYPVVPRQYYPAPYAYLPSPLSLAPGPSPPAQAAGGRDTLALHPPSPYSLPAATYPPAASAYPQQAAAGPGRNALPAPASEESNGKLDFGVGLGAGLVSGAIGGMLVASDVMMSDAAAYNSGYRAGLADGGAAAVYRSSYRVPDKVEAKRAAV

SEQ ID NO: 3975 - protein, 272 aa, Saccharum officinarum
  misc_feature (67)..(67): Xaa can be any naturally occurring amino acid
  misc_feature (114)..(114): Xaa can be any naturally occurring amino acid
MAAPPQTIALAGLILLNCVLAVAALCLHVLGRRRPRQQVPPPPLEAAAAGEAEEEEGGGEERPQNQXRRRRARRKRQQQEQEEEGAAAAEGGGHVADGDRDAAAKAALLPRRPXFPLASVAGPLQRRINARYDDLARASEAQCLTIEQVNEFVNCLIDARNELLQRYENVQRSFKIKKAMLSNHRNYRSSYERLFEQVRRLETERDNLKKDAAIYNYIQERLQKSAAYKMIMELSAMEMEAQEISFEELLAKEKEDTVFWQRNGKLRSFSSK

SEQ ID NO: 3976 - protein, 157 aa, Triticum aestivum
RVRPAEGRARTGSIAHASDRSISITRIASDHHHHESTMGGGHDMHGHNGGVKGYVSNLVHGGGGGGHGHGYGGGHGHGYGGHGQGYGHAYPPPAAAGAYPPPHGGYPPAAAYPAHSAHYGHMGSYHSSHSHGGGHHGGYGGKHKGGMFGGGKFRKWK

SEQ ID NO: 3977 - protein, 120 aa, Triticum aestivum
MGGGHDMHGHNGGVKGYVSNLVHGGGGGGHGHGYGGGHGHGYGGHGQGYGHAYPPPAAAGAYPPPHGGYPPAAAYPAHSAHYGHMGSYHSSHSHGGGHHGGYGGKHKGGMFGGGKFRKWK

SEQ ID NO: 3978 - protein, 118 aa, Saccharum officinarum
MGGGHDMHGHNGGVKGYVSNLVHGGGGGGGHGHGYGGHGHGNGHGQGYAHGYPPPAAAGAYPPPHGGYPPAAYPAHSAHYGHMGSYHSSHSHGGGHHGSYGGKHKGGMFGGGKFRKWK

SEQ ID NO: 3979 - protein, 119 aa, Saccharum officinarum
MGGGHDMHGHNGGVKGYVSNLVHGGGGGGGGHGHGYGGHGHGNGHGQGYAHGYPPPAAAGAYPPPHGGYPPAAYPAHSAHYGHMGSYHSSHSHGGGHHGSYGGKHKGGMFGGGKFRKWK

SEQ ID NO: 3980 - protein, 121 aa, Saccharum officinarum
MGGGHDMHGHNGGVKGYVSNLVHGGGGGGGGGSHGHGYGGHGHGYGHGQGYTHGYPPPAAAGAYPPPHGGYPPAAYPAHSAHCGHTGSYHSSHSHGGGHHGSYGGKHKGGMFGGGKFRKWK

SEQ ID NO: 3981 - protein, 118 aa, Saccharum officinarum
MGGGHDMHGHNGGVKGYVSNLVHGGGGGHGHGYGGHGHGNGHGHGQGYTHGYPPPAAAGAYPPPHGGYPPAAYPAHSAHYGHMGSYHSSHSHGGGHHGSYGGKHKGGMFGGGKFRKWK

SEQ ID NO: 3982 - protein, 122 aa, Saccharum officinarum
MGGGHDMHGHNGGVKGYVSNLVHGGGGGGGGGSHGHGYGGHGHGNGHGQGYAHGYPPPAAAGAYPPPHGGYPAPPTPRTQRTTGIWGRTTAATAMAAATTAATAASTRAACSAAASSGSGSE

SEQ ID NO: 3983 - protein, 510 aa, Setaria italica
MGSGDLSSDMKRTVLGLTLWVWIAIGVVALLVAILLMICIWVASRRRTKRTMDSLRQTQIPIYSKEIPVDRVAGRSLAQTMHEREQSSFPPPDKYANREPAGATLGHLALSKSSDHDNMSQGSSVCNVDRAASVHSGEDGSSGPRRKPNSPAAFVSASPLVGLPEFSHLGWGHWFTQRDLELATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMCQRGVFSWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRGPVDYSRSSNEVNLVEWLKTMVANRRAEEVADPSLEVRPSIRSLKRALLVALRCVDPDSEKRPKMGQVVRMLESEEVPYREDRRNRRSRTGSMDIESIAEGSNSAEFGKKVERTGSATSDRSQP

SEQ ID NO: 3984 - protein, 512 aa, Zea mays
MGSGDLSSEMERTVLGLTLWVWIAIGVVALLVAILLMICIWVASRLRTKRTMDSLRQTQIPIYSKEIPIDRVGGRSLAQTMHEREQPSLPPPDKYANREPAGAAVGHLALSKSSDHDNMSQGSSVCNADRAGTGSMHSGEDGSSGPRRKPNSPAAFVSASPLVGLPEFSHLGWGHWFTQRDLELATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMHQRGVFSWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRNPVDYSRSSNEVNLVEWLKTMVANRRAEEVADPSLEARPSIRALKRALLVALRCVDPDSEKRPKMGQVVRMLESEEVPYREDRRNRRSRTGSMDIESIAEGSNSAEFGKKVERTGSSISDRSQP

SEQ ID NO: 3985 - protein, 509 aa, Oryza sativa
MGSSDLSSEMRRTVLGLTLWVWIAIGVVALLVAILLMICIWMASRRKTKRTMDNLRQTQIPIFSKEIPVDRVGGRSLAQTMHEREQPSFPPQDKHTNREPGKTLGHMALSKSSEPDNMSQGSSVCNVDRAGSVHSGEDGSTGHGRKPYSPAAFVSASPLVGLPEFSHLGWGHWFTLRDLELATNRFSRENVLGEGGYGVVYRGRLVNGTEVAIKKIFNNMGQAEKEFRVEVEAIGHVRHKNLVRLLGYCVEGVNRMLVYEFVNNGNLEQWLHGAMRQHGVFSWENRMKVVIGTAKALAYLHEAIEPKVVHRDIKSSNILIDEEFNGKVSDFGLAKLLGSDKSHITTRVMGTFGYVAPEYANTGMLNEKSDVYSFGVLLLETVTGREPVDYSRSGNEVNLVEWLKIMVANRRAEEVVDPILEVRPTVRAIKRALLVALRCVDPDSEKRPKMGQVVRMLESEEVPYREDRRNRRSRTGSMDIESIAEGSNSTEFANKVERTGSSTSDRSQS

SEQ ID NO: 3986 - protein, 511 aa, Brachypodium distachyon
MGSTDLNSEMTRTVLGLTLWIWIAIGVVALLVAILLMICIWVASRRRTKRTIDNMTQTQIPIYSKEIPVDRVGGGRSLAQTMHEREQPSFPPQDKHANREPGKTPGHMALSKSSDHDNMSQGSSVCNVDRGGSVHSGEDGSSGQHGRKPYSPAAFVSASPLVGLPEFSHLGWGHWFTLRDLEFATNRFSKENVLGEGGYGVVYRGRLVNGTDVAIKKIFNNMGQAEKEFRVEVEAIGHVRHKNLVRLLGYCVEGVNRMLVYEFVNNGNLEQWLHGAMRQHGVFSWENRMKVVIGTAKALAYLHEAIEPKVVHRDIKSSNILIDDEFNGKVSDFGLAKMLGSDKSHITTRVMGTFGYVAPEYANTGMLNEKSDVYSFGVLLLETVTGRDPVDYSRSANEVNLVEWLKMMIANRRAEEVVDPILEVRPTIRALKRALLIALRCVDPDSEKRPKMGQVARMLESEEVPYREDRRNRRSRTGSMDIESITEGSNSAEFANKVERTGSSRSDRSQS

SEQ ID NO: 3987 - protein, 511 aa, Hordeum vulgare
MVSTGLSSEMTRKVLGLTLWVWIAIGVVALLVAILLMICIWAASRRKTKRTMENLSQTQIPIYSKEIPVDRVGGGRSLAQTMHEREQPSLPTQDKHAANREPGKAAGHMALSKSSDHDNVSQGSSVCNVDRVGSVHSGEDAGSGKGRKPYSPAAFVSASPLVGLPGFSHLGWGHWFTLRDLEFATSRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMRQHGVFTWDNRMKVVIGTAKALAYLHEAIEPKVVHRDIKSSNILIDDEFNGKVSDFGLAKMLGSDKSHITTRVMGTFGYVAPEYANTGMLNEKSDVYSFGVLLLETVTGRDPVDYSRSANEVNLVEWLKMMIANRRAEEVVDPILEVRPTIRALKRALLIALRCVDPDSEKRPKMGQVARMLESEEVPFREDRRNRRSRTGSMDIESITEGSNSAEFASKVERTGSSRSDRSQS

SEQ ID NO: 3988 - protein, 511 aa, Triticum aestivum
MVSTGLSLEMTKKVLGLALWVWIAIGVVALLVAILLMICIWAASRRKTKRTMENLSQTQIPIYSKEIPVDRVGGGRSLAQTMHEREQPSFPTQDKHAVSREPGKTVGHMALSKSSDHDNVSQGSSVCNVDRVGSVHSGEDGGSGHGRKPYSPAAFVSASPLVGLPEFSHLGWGHWFTLRDLEFATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMRQHGVFTWDNRMKVVIGTAKALAYLHEAIEPKVVHRDIKSSNILIDDEFNGKVSDFGLAKMLGSDKSHITTRVMGTFGYVAPEYANTGMLNEKSDVYSFGVLLLETVTGRDPVDYSRSSNEVNLVEWLKMMIANRRAEEVVDPILEVRPTIRALKRALLIALRCVDPDSEKRPKMGQVARMLESEEVPFREDRRNRRSRTGSMDIESITEGSTSAEFAIKVERTGSSRSDRSQT

SEQ ID NO: 3989 - protein, 511 aa, Triticum aestivum
MVSTGLSLEMTKKVLGLALWVWIAIGVVALLVAILLMICIWAASRRKTKRTMENLSQTQIPIYSKEIPVDRVGGGRSLAQTMHEREQPSFPTQDKHAVSREPGKTVGHMALSKSSDHDNVSQGSSVCNVDRVGSVHSGEDGGSGHGRKPYSPAAFVSASPLVGLPEFSHLGWGHWFTLRDLEFATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMRQHGVFTWDNRMKVVIGTAKALAYLHEAIEPKVVHRDIKSSNILIDDEFNGKVSDFGLAKMLGSDKSHITTRVMGTFGYVAPEYANTGMLNEKSDVYSFGVLLLETVTGRDPVDYSRSSNEVNLVEWLKMMIANRRAEEVVDPILEVRPTIRALKRALLIALRCVDPDSEKRPKMGQVARMLESEEVPFREDRRNRRSRTGSMDIESITEGTNSAEFAIKVERTGSSRSDRSQT

SEQ ID NO: 3990 - protein, 133 aa, Triticum aestivum
MVSTGLSLEMTKKVLGLALWVWIAIGVVALLVAILLMICIWAASRRKTKRTMENLSQTQIPIYSKEIPVDRVGGGRSLAQTMHEREQPSFPTQDKHAVNREPGKTVGHMALSKSLDHDNVSQGSSVCNGGPGW

SEQ ID NO: 3991 - protein, 430 aa, Panicum virgatum
  misc_feature (88)..(88): Xaa can be any naturally occurring amino acid
  misc_feature (277)..(277): Xaa can be any naturally occurring amino acid
  misc_feature (414)..(414): Xaa can be any naturally occurring amino acid
  misc_feature (417)..(417): Xaa can be any naturally occurring amino acid
MHEREHPSFPPQDKHASRDPAGATLGHMALSKSSDHDNMSQGSSVCNVDRAASVHSGEDGSSGPRRKPNSPAAFVSASPLVGLPEFSXLGWGHWFTQRDLELATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMRQRGVFTWENRMKVVTGTAKALAYLHEAIEPKVVHRDIKSSNILIDDEFNGKVSDFGLAKLLGSDKSHITTRVMGTFGYVXPEYANTGMLNEKSDVYSFGVLLLETVTGRGPVDYSRSSNEVNLVEWLKTMVASRRAEEVADPSLEVRPSIRSLKRALLVALRCVDPDSEKRPKMGQVVRMLESEEVPYREDRRNRRSRTGSMDIESIAEGSNSAEFXKKXERTGSATSDRSQP

SEQ ID NO: 3992 - protein, 474 aa, Zea mays
MAAAAGGTGGCGCHIVAVPFPGRGHVNAMMNLSRLLAARGAAVTFVVTEEWLGLIRSSSAAAAAEPAGIRIRTIPNVIPSEHGRAANHSGFLDAVATEMEAPFDRLLDGLEGPPPAALVADAYVPWVVGVGNRRGVPVWSLFPMSAAFFFAYYHFDRLPAWLTNSEHAPESGETIGNSDQRLGHYIAGQASSSIRLSDLEPLIHNKRTVKHILTTISSIRNAQSLLFTTMYELEASVIDSLRSVLSCPVYPIGPCVPYMMLEDHTVSSGKVARQGDYFTWLDSQPVNSVLYVSLGSFVSVSASQLEEIALGLIASEVRFLWILREQSPRVQELFSGINNGMILPWCEQLEVLCHHSVGGFMTHCGMNSTLEGVFAGVPMLALPLFFDQPIDGRLIVEEWKIGLAVRDWASKGGLIGREDIARAVKKLMSSDETGTKALRERALELKEASRRAVNEGGSSYCNLSSLMETVCTPK

SEQ ID NO: 3993 - protein, 193 aa, Setaria italica
MAAAAAGDEPRVRGCHIVAMPFPGRGHVNAMMNLSRLLAARGAAVTFVVTEEWLGLIRSSSSSTAVGVRLRSIPNPSEHGRAADHSGFLDAVATEMEAPFERLLDGLEGPPPAALVADAYVPWVVGVGNRRGVPVWPLFPMAASFFFAYYHYDRLPTWLTGDGKHAPDSGEVVDNSDQRLMHYISSFKFNKIV

SEQ ID NO: 3994 - protein, 483 aa, Oryza sativa
MGSTGRDAEVTRGDFPDGFVFGVATSAYQIEGARREGGKGDNIWDVFTENKERILDGSSGEVAVDHYHRYKEDIELMASLGFRAYRFSISWPRIFPDGLGKNVNEQGVAFYNDLINFMIEKGIEPYATLYHWDLPHNLQQTVGGWLSDKIVEYFALYAEACFANFGDRVKHWITINEPLQTAVNGYGIGHFAPGGCEGETARCYLAAHYQILAHAAAVDVYRRKFKAVQGGEVGLVVDCEWAEPFSEKTEDQVAAERRLDFQLGWYLDPIYFGDYPESMRQRLGDDLPTFSEKDKEFIRNKIDFVGINHYTSRFIAHHQDPEDIYFYRVQQVERIEKWNTGEKIGERAASEWLFIVPWGLRKLLNYAAKRYGNPVIYVTENGMDEEDDQSATLDQVLNDTTRVGYFKGYLASVAQAIKDGADVRGYFAWSFLDNFEWAMGYTKRFGIVYVDYKNGLSRHPKASARWFSRFLKGDDAENKADMN

SEQ ID NO: 3995 - protein, 489 aa, Brachypodium distachyon
MGSTGRDEEAVAAAEVTRADFPEGFIFGVATSAYQIEGARKEGGKGDSIWDVFADNKEHILDGTSGEVAVDHYHRYKEDIELMAKLGFGAYRFSISWSRIFPDGLGKEINEQGVAFYNNLIDFMIEKGIQPYATLYHWDLPHNLQQTMGGWLSDKIVEYFALYAEACFANFGDRVKHWMTINEPLQTSVNGYGIGIFAPGVCEGAAAEPFLAAHHQILAHAASVDVYRRKFKAVQGGQVGFVIDCEWAEPFSDKMEDQAAAARRIDFQLGWYLDPIYFGDYPESMRQRLGDHLPKFSEKERELIRNKIDFIGLNHYTSRFIAHQQDPQAIHFYQVQQMERIEKWNTGEGIGERAASEWLLIVPWGLRKAINYIVKKYNNPVIYVTENGMDDEDDQSAPLDQVLNDTKRVGFFKGYVGAVAQAIKDGADIRGYFAWSFLDNFEWAMGYTKRFGLVYVDYKDGLSRHPKASAMWFSRFLNGEAADIKPDTN

SEQ ID NO: 3996 - protein, 1007 aa, Zea mays
MTVTARGRSGGAGMGEKGGAPGLGFLSLDRMRVLLPPLRLPEKLSARTLRTHLFTNYRMRKVRDSSSWLIPLWVSSWVLVASLIYLCMSYQAVGKRRESLASMCDERARMLQDQFNVSMNHLQALAILVSTFHHSKTPSAIDQKTFARYAERTAFERPLTSGVAYGVRVTHAEREQFERQQGWSIKKMYSSKTKNQSQGPGNAEDAEVREPAEEYAPVIFAQDAYKHVISFDLLSGADDRDNVLRARESGKGVLTAPFKLLNNRLGVIFTYAVYKYELPANARPQERIQAAIGYLGGIFDIEALVDKLLHQLAGKQSIMVNVYDTTNERPISMYGSNDTGSGMCQVSTLNFGDPSRKHVMHCRFIQSPPWPWMAITTSIGTLVIALLIGYIVHATAKRIARVEDDFQEMSLLKKRAEDADIAKSQFLATVSHEIRTPMNGVLGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMKGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKEAITLLKPPHNFDACFMDIQMPEMDGFEATKRIRVMERDLNEQIERGEAPPECVGVRQWRTPILAMTADVIQATHEQCLKSEMDGYVSKPFEGEQLYREVARFFLNQDQVQ

SEQ ID NO: 3997 - protein, 1007 aa, Zea mays
MTVTARGRSGGAGMGEKGGAPGLGFLSLDRMRVLLPPLRLPEKLSARTLRTHLFTNYRMRKVRDSSSWLIPLWVSSWVLVASLIYLCMSYQAVGKRRESLASMCDERARMLQDQFNVSMNHLQALAILVSTFHHSKTPSAIDQKTFARYAERTAFERPLTSGVAYGVRVTHAEREQFERQQGWSIKKMYSSKTKNQSQGPGNAEDAEVREPAEEYAPVIFAQDAYKHVISFDLLSGADDRDNVLRARESGKGVLTAPFKLLNNRLGVIFTYAVYKYELPANARPQERIQAAIGYLGGIFDIEALVDKLLHQLAGKQSIMVNVYDTTNERPISMYGSNDTGSGMCQVSTLNFGDPSRKHVMHCRFIQSPPWPWMAITTSIGTLVIALLIGYIVHATAKRIARVEDDFQEMSLLKKRAEDADIAKSQFLATVSHEIRTPMNGVLGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMKGEIGFSSKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKEAITLLKPPHNFDACFMDIQMPEMDGFEATKRIRVMERDLNEQIERGEAPPECVGVRQWRTPILAMTADVIQATHEQCLKSEMDGYVSKPFEGEQLYREVARFFLNQDQVQ

SEQ ID NO: 3998 - protein, 1007 aa, Zea mays
MTVTARGRSGGAGMEEKGDAPGLGFLGLDRMRVLLPPLRLPEKLSARALRTHLFTNYRMRKVRDSSSWLIPLWVLFWVLLASVICLWMSNQAVAKRRESLASMCDERARMLQDQFNVSVNHLQALAILVSTFHHSKTPSAIDQTTFARYAERTAFERPLTSGVAYGVRVTHAEREQFERQQGWSIKKMYSSKTKKQSQGPGNAEDAEVREPAEEYAPVIFAQDAYKHVISFDLLSGADDRDNVLRARESGKGVLTAPFKLLNNRLGVISTYAVYKYELPPNARPQERIQAAIGYLGGIFDIEALVDKLLHQLAGKQSIMVNVYDTTNDRRISMYGSNDTGSGMCQVSTLNFGDPSRKHEMHCRFIQSPPWPWMAITTSIGTLVIALLIGYIIYATAKRIARVEDDFQEMSVLKKRAEDADIAKSQFLATVSHEIRTPMNGVLGMLQMLMDTDLDTTQQDYVRTAQASGKALVSLINEVLDQAKIESGKLELEAVPFDLRTVCDDILSLFCGKAQEKGLELAVFVSDQVPQALIGDPGRIRQIITNLVGNSIKFTEKGHIYLTVHVVEEIMNCLEVETGTQSANTLSGYPVANRKRSWENFRVFSRELNSSEMPFAPIASDSISLIISVEDTGVGIPFDAQSRVFTPFMQVGPSIARIHGGTGIGLSISKCLVGLMRGEIGFASKPQVGSTFTFTAVLTRAHSSRNENKSSEFKGINALVVDHRPVRAKVTRYHLQRLGVQTELTTDLDQYISKINCGSQIAKLVLIDKETWLKESHSMPLLVTKLRNKDQPDSTKLFLLENPKSTAKSNSHIFREFNLNVIMKPLRASMLQVSLHRALGGIDKLHCRNGVLGNSTLGSLLHKKRILVVDDNIVNLKVAAGALKKYGAEVTCADSGKKAITQLKPPHSFDACFMDIQMPEMDGFEATKRIRVMERDLNEQIERGEAPPECAGLRQWRTPILAMTADVIQATHEQCLKSEMDGYVSKPFEGEQLYREVARFFQNQDQVQ

SEQ ID NO: 3999 - protein, 291 aa, Zea mays
MGSLYGKMILRVCLFFPMPTWSRVSDLISEHGRSLSQWIHLGGVKAFLDGSLGSSSALFHEPYEGDPDNYGLQMTDLDSLLNRTLESDKSGLQVAIHAIGDKANDILLDMVDKIVDLNGAKDRRFRIEHAQHLAPGAANRFGKHGTIASVQPDHLLDDADHAWSKIGVERSERSSYTFRSLLDGGAQLAFGSDWPISDINPLQAIRSAVFRKPPGWEVPWIPAERLTLDESLKAHTMSAAYACFLDHAVGSLSEGKYADFVVVPSTSWDEFSSDLPGHVLATYVSGRQAYP

SEQ ID NO: 4000 - protein, 235 aa, Zea mays
ADMVLANGTIYTADPARPFADAMSELKGPRTRELNLSGNVVLPGFIDSHVHFIDGGLQLARVPLRGVRSKDDLVARVKEAVRDKQPGQWILGGGWNDDFGGDGLPAAVWLDDISPDNPVWLSRMDGHMGVANSLAMKIAGIDKNTNDPIGGTIIRTTEGEPTGLLVNTAMKPIFDVIQNVSNHERREALLRASRHALMRGVTTVVDVGSYFPGASAEKTWQDFAEIYKWAHSMEK

SEQ ID NO: 4001 - protein, 570 aa, Oryza sativa
MSTRSAFLAAGVAIAAAIFLLRPASDLSRDLGEAVADMILANATIYTADPAMPFAEAMAVRAGRVLRVGGYYSVKELKGRHTMELNLSGNVVLPGFIDSHVHFIDGGLQLARVPLRGVTSKDDFINRVKEAVKDKHPGQWIFGGGWNNDFWGGDYPTAAWLDDISPDNPVWLSRMDGHMGIANSLAMRMAGINKNTNNPVGGTIMRTTEGEPTGLLVDAAMKLVFDVISEVSIHERRDALLRASRHALMRGVTTVVDVGSYFPGKSEKQVWQDFTDIYEWAHSVETMIMRVCLFFPMPTWSRVYDLIHEKGRMLSQWIHLGGVKAFLDGSLGSSSALFYEHYKDDPRSYGLQLVDMDYLLNTTLELDKSGLQIAIHAIGDKANDMLLDMYEKVVDLNGMKDHRFRIEHAQHLAPGAAKRFGKHGIIASVQPDHILDDANSAGKKIGIERAERSSYSFRSLLDGGAHLAFGSDWPVSDINPLQAIRTAVSRKPVGWEVPWIPAERLSLDDSLKAHTISAAYACFLDHVLGSLSEGKYADFVILPSTSWNEFGSDITDHVLATYVNGKQAYP

SEQ ID NO: 4002 - protein, 420 aa, Zea mays
MIYTAIDTFYLTEEQLRNSPSRKDGIDEATETVLRVYGCDLIQESGILLRLPQAVMATAQVLFHRFYCKKSFVRFSAKRVAASCVWLAGKLEESPRKSKHIIFVFHRMECRRENLPIEFLDVFSKKYSELRRDLIRTERHLLKEMGFICHVEHPHKFISNYLATLEAPPELTQEAWNLANDSLRTTLCVRFKSEVVACGVVYAAARRHRVPLPEDPPWWTVFDADEAGIQEVCSVLAHLYSLPKAQYIPVYKEYDSFTVKRISDPQALKESPARAVASDKGTPIPSSSNQEKDSVAKTIPNRVKEKSDDEGRHLPAEFDGKENLVVNSKIEKSDSGVDWSRERERERERSRGRERDARGRDSDHDSRGRDSDRERDRRRRSRDRSSGHSDKEKSRRHPSHDRVDYYSSHSSREKDRHRHH

SEQ ID NO: 4003 - protein, 417 aa, Pennisetum glaucum
MIYTAIDTFYLTDEQLRDSPSRKDGIDEATETALRIYGCDLIQESGILLRLPQAVMATAQVLFHRFYCKKSFVRFSAKRVAASCVWLAGKLEESPRKSKHIIFVFHRMECRRENLPIEYLDVFSKKYSELRHDLIRTERHLLKEMGFICHVEHPHKFISNYLVTLEAPDLTQEAWNLANDSLRTTLCVRFKSEVVACGVVYAAARRRGISLPEDPPWWTVFDADEAGIQEVCRVLAHLYSLPKAQYIPVYKDNDSFTIRRTPDPQASKDNPASLVVSDKGTPIPSSSSQEKDSVTKAAPNKVKEKSDDEGKPLPAELNGKQDPAVSLKNEKSESDVDRSRERERERSRGRDRDGRSRDSDRDSRGRDSDRERDRRRRSRERSSGHSDKEKSRHHSSRDRGDYYSSHPSREKDRRRHH

SEQ ID NO: 4004 - protein, 417 aa, Panicum virgatum
MIYTAIDTFYLTDEQLRDSPSRKDGISEATETALRVYGCGLIQESGILLRLPQAVMATAQVLFHRFYCKKSFVRFSAKRVAASCVWLAGKLEESPRKSKHIIFVFHRMECRRENLPIEYLDVFSKKYSELRHDLIRTERHLLKEMGFICHVEHPHKFISNYLVTLEAPELTQEAWNLANDSLRTTLCVRFKSEVVACGVVYAAARRRGIALPEDPPWWTVFDADEAGIQEVCRVLAHLYSLPKSEYIPVYKDNDSFTVRRTPEPQVSKESPASAVASDKGTPVPSSSSQEKDSVTKAAPDKVKEKSDDEGKALSAELNGKQDAAAKLKNEKSESGVDRSRERERERSKGRDRDGRGRDSDRDSRGRDSDRERDRRRRSRERSSGHSDKERSRHHSSRDRGDYYSSHSSREKDRHRHH

SEQ ID NO: 4005 - protein, 409 aa, Brachypodium distachyon
MIYTAIDTFYLTDEQLRDSPSRKDGIDEAAEASLRVYGCDLIQESGILLKLPQAVMATAQVLFHRFYCKKSFARFSAKRVAASCVWLAGKLEESPRRSKHIIFVFHRMECRRENLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEDPPWWTVFDADEAGIQEVCKVLAHLYSLPKAQYIPVYKDNDSFSVRRASDTQASKESPASAVASDRGTAVPSSSSQEKNSLTKAGPEKVKENSDNKDKPVPAELNGKGDQAVNSKSEKSESNVDRTEERERSRSRGRDRDSRGRDSDRDRERDRAKRHRSRDKTSGYSDKEKSRHRSSRDRGGYYSSGDKDRRRHH

SEQ ID NO: 4006 - protein, 427 aa, Oryza sativa
MIYTAIDTFYLTDEQLRDSPSRKDGIDEATETALRVYGCDLIQESGILLKLPQAVMATAQVLFHRFYCKKSFVRFSVKRVAASCVWLAGKLEESPRRSKHIIIVFHRMECRRENVPIEHLDVFSKKYSDLKHDLVRTERHLLKEMGFICHVEHPHKFISNYLATLEAPELTQEAWNLANDSLRTTLCVRFKSEVVACGVVYAAARRHGVPLPEDPPWWNVFDADEAGIQEVCRVLAHLYSLPKSQYIQVYKDNDSFTHRRTSDTNASKESPATTVASDKGTPVPSSSSQEKDALIKAGSDKVKEKGDDDGKTLPSEPNGKEGPAVNLKSEKSESNVDRSRERERDRSRGRDRDSRGRDSDRDSKGRDSDRERERDREADRDRQRRHHSKDRSSGYSDKEKSRHRSSRDRGDHYSSHSSRDKDRHRRQ

SEQ ID NO: 4007 - protein, 108 aa, Brachypodium distachyon
MMYTAIDTFYLTDEQLRDSPSRKDGIDEAAEASLRVYGCDLIQESGILLKLPQAVMATAQVLFHRFYCKKSFARFSAKRVAASCVWLAGKLEESPRRSKHIIFVFHRM

SEQ ID NO: 4008 - protein, 453 aa, Cenchrus ciliaris
  misc_feature (257)..(257): Xaa can be any naturally occurring amino acid
  misc_feature (409)..(411): Xaa can be any naturally occurring amino acid
  misc_feature (418)..(424): Xaa can be any naturally occurring amino acid
MIYTAIDTFYLTDEQLRDSPSRKDGIDEATETALRVYGCDLIQESGILLRLPQAVMATAQVLFHRFYCKKSFVRFSAKRVAASCVWLAGKLEESPRKSKHIIFVFHRMECRRENLPIEYLDVFSKKYSELRHDLIRTERHLLKEMGFICHVEHPHKFISNYLVTLEAPELTQEAWNLANDSLRTTLCVRFKSEVVACGVVYAAARRRGISLPEDPPWWTVFDADEVGIQEVCRVLAHLYSLPKSQYIPVYKDNDSFXIRRTPDPQASKESPASLVASDKGTPIPSSSSQEKDSVTKAAPNKVKEKSADEGKPLPAELNGKQDPAVNLKNEKSESDVDRSRERERERSRGRDRDGKSRDSDRDSRGRDSDRERDRRRRSRERSSGHSDKEKSRHHSSRDRGDYYSSHSSXXXDRRRHHXXXXXXXVISSLYMTMAFPWQHLFYTWILYKLNKNV

SEQ ID NO: 4009 - protein, 409 aa, Triticum aestivum
TAIDTFYLTDEQLRDSPSRKDGIDEAAETTLRVYGCDLIQESGILLRLPQAVMATAQVLFHRFYCKKSFARFSAKRVAASCVWLAGKLEESPRRSKHIIFVFHRMECRRENLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEEPPWWTVFDADEAAIQEVCRVLAHLYSLPKAQYIPVYKDNDSFSVRRALDTHASKESPASAVASDRGTPVPSSSSQEKNSLAKAGREKVKENSDTKDKLLPAELNGKGDQAVNSKSDRSEPNVDRAEERERSRSRGRERDRDIRGRDSDHERERDRAKRHRSRDKSSGYSDKEKSRHRSSRDRAGYYSSGDKDHRHRRH

SEQ ID NO: 4010 - protein, 116 aa, Hordeum vulgare
MIYTAIDTFYLTDEQLRDSPSRKDGIDEAAETTLRVYGCDLIQESGILLRLPQAVMATAQVLFHRFYCKKSFARFSAKRVAASCCGWLASWRRVQEDQSISYLSSIEWNAGEKTYQ

SEQ ID NO: 4011 - protein, 410 aa, Hordeum vulgare
MIYTAIDTFYLTDEQLRDSPSRKDGIDEAAETTLRVYGCDLIQESGILLRLRQAVMATAQVLFHRVYCKKSFARFSAKRVAASCVWLAGKLEESPRRSKHIIFVFHRMECRRENLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEEPPWWTVFDADEAAIQEVCRILAHLHSLPKAQYIPVYKDNDSFSVRRALDTHASKESPASAVASDRGTPVPSSSSQEKNSLTKAGREKVKENSDTKDKPLPAELNGKGGQAANSKSERSEPNVDRAEERERSRSRGRDRDIRGRDSDHERERDRAKRHRSRDKSSGYSDKEKSRHRSSRDRAGYYSSGDKDHRHRRH

SEQ ID NO: 4012 - protein, 339 aa, Triticum aestivum
PPPCPPATLPPPAPSSVAASPPLPYPSLSRRPPLRASPYPLFHGAPPRGGGGCPDWRPSAWGDRGGTAIDTFYLTDQQLRDSPSRKDGIDEAAETTLRVYGCDLIQESGILLRLPQAVMATAQVLFHRFYCKKSFARFSAKRVAASCVWLAGKLEESPRRSKHIIFVFHRMECRRENLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEEPPWWTVFDADEAAIQEVCRVLAHLYSLPKAQYIPVYKDNDSFSVRRALDTHASKESPASACC

SEQ ID NO: 4013 - protein, 71 aa, Avena sativa
MIYTAIDTFYLTDEQLRDSPSRKDGIDEAAETTLRVYGCDLIQESGILLRLDGHRTSTVSPFLLQEIICTI

SEQ ID NO: 4014 - protein, 220 aa, Zea mays
MKIAWGKKSKVKKQSVVVSTIPGLPFGAGSDNDEVETEEKSDANTNCPGTKPVETAELLQSQGDKLAEEGKYHEALAKWEAALILMPDNAILHEQKAQVLLEVGDAWRALTAATRATELDPFWPEAWVTLGRAQLNFGEPDSAILTFDKALAMKPDYTDAKADRETAARLVKKRGQLHTSGLSANKRRFTVGEYPKEGGAEGEEKGKETAEQLQKITQEN

SEQ ID NO: 4015 - protein, 213 aa, Panicum virgatum
MKITWGKNAKMKRQPVLVSTKPGLPFGVDSDTDEADKEETAGASTNCPGTKPLDTAESLQRQGDKLAEEGKYHEALSRWEAALTLAPDNAILHEQKAQVLLEVGDAWHALTAATRATELDPLWPEAWVTLGRAQLNFGEPDSAILSFDKALVIKPDHDGAKADRETAVRLVKKRGQLHSSGLSTNKRRFTVGENSVKGAEGKEKADETAVQSG

SEQ ID NO: 4016 - protein, 213 aa, Panicum virgatum
MKIAWGKNAKMKRQPVVVSTKPGLPFGVDSDTDEAEKEETAGANTNCPGTKPLDTAESLQHLGDKLAEEGKYHEALCRWEAALTLAPDNAILHEQKAQVLLEVGDAWHALTAATRATELDPLWPEAWVTLGRAQLNFGEPDSAILSFDKALVIKHDHDGAKADRETAVRLVKKRGQLHSSGLSTNKRRFTVGENSVKGAEGEEKADETAVPSG

SEQ ID NO: 4017 - protein, 335 aa, Setaria italica
MKIAWGKNAKTKRQPVVVSTKPGLPFGVESDTEEAEKDETAGANTNCPGAKPLDTAESLQHQGDKLAEEGKYHEALSRWEAALTLAPDNAVLYEQKAQVLLEVGDAWHALTAGTRATELDPLWPEAWVTLGRAQLNFGEPDSAILSFDKALAIKPDHDDAKADRETAARLVKKRGQLHSSGLSANKRRFTVGEKENSDNGAEGEEKADETAVQSVHARKKRHLESGTLEKSKMWGKGKKRFGGGGGSEPAAKRQAAGDEGPSESAEDGTVVAEISKNKKVSVRSWKGKVYVDMREFYTKDGKTLPTKKGISLQLDQWKILRDNIKAIDEAIKENA

SEQ ID NO: 4018 - protein, 172 aa, Saccharum officinarum
EKSDANTNCPGTKPVETAVLIQSQGDKLAEEGKYHEALAKWEAALILTPDSAILHEQKAQVLLEVGDAWRALTAATRATELDPFWPEAWVTLGRAQLNFGEPDSAILTFDKALAIKPDYNDAKADRETAARLVKKRGQLHTSGLSANKRRFTVGEYPEKGAEGEEKGKETAV

SEQ ID NO: 4019 - protein, 215 aa, Setaria italica
MKIAWGKNAKMKRQPVVVSTKPSLPFGVESDTEEAEKDETAGANTNCPGAKPLDTAESLQHQGDKLAEEGKYHEALSRWEAALTLAPDNAVLYEQKAQVLLEVGDAWHALTAGTRATELDPLWPEAWVTLGRAQLNFGEPDSAILSFDKALAIKPDHDDAKADRETAARLVKKRGQLHSSGLSANKRRFTVGEKENSDNGAEGEEKADETAVQSG

SEQ ID NO: 4020 - protein, 160 aa, Saccharum officinarum
MAATTAYSTALLGGARLPAAGAAAPPSALLLPRRNLLSPLPLRLQDAAAPRLSLLRVKASSDDSSAASGDELIADLKAKWDAVENKSTVLTYAGGAVVALWLTSDIVGAINSVPLLPKIMELVGLGYTGWFVYRYLLFKESRKELADDIESLKKKIAGTE

SEQ ID NO: 4021 - protein, 160 aa, Saccharum officinarum
  misc_feature (105)..(105): Xaa can be any naturally occurring amino acid
MAATTAYSTALLGGARLPAAGAAAPPSALLLPRRNLLSPLPLRLQDAAAPRLSLLRVKASSDDSSAASGDELIADLKAKWDAVENKSTVLTYAGGAVVALWLTSXIVGAINSVPLLPKIMELVGLGYTGWFVYRYLLFKESRKELADDIESLKKKIAGTE

SEQ ID NO: 4022 - protein, 381 aa, Zea mays
MSVASVAALRTAGSGRRRGAGSQQTGLNGGRFLMMQRRELVTKAGIALAVSCSMATSPASANGAAQGLEILPFKADGYNFWTWRGRRIHYVEQGAGRPVVLIHGFGASAFHWRYNIPELAKKYKVYAIDLLGFGWSEKALVDYEATIWMEQVSDFLREIVKEPAVLVGNSLGGFTTLFTATEVPELVRGVVLLNSAGQFADPNKPAAAPAEEEEGGSALSRYIVQPLKEAFQRVVLGLLFWQSKQPARVEKVLKSVYIDPSNVDDYLVGSITAPAADPNAGEVYYRLMSRFMSNQSRYTLDRLLGKMSCPLLLLWGDLDPWVGPAKAARIQEFYADTAVVHLQAGHCPHDEAPEQANRALLEWLAALDARAKSAEPSLQTV

SEQ ID NO: 4023 - protein, 117 aa, Saccharum officinarum
  misc_feature (112)..(112): Xaa can be any naturally occurring amino acid
MSVASVAALRTAGSGRCRGAGSPQAGLNGGRFLMMQRRELVTKAGIALAVSCSMATSSASANGSAQGLEILPFKADGYNFWTWRGRRIHYVEQGAGQPIVLIHGFGASAFHXEVQHP

SEQ ID NO: 4024 - protein, 112 aa, Zea mays
MERMSSSLQYWVEEHKLSTIGAVWATAVGASVAYSRRRAPARATGMRLIHARMHAQALTLAVLGGAALAHHYHGKSTNAGKRQQQEDLDYGFYSQLPPATDADGNENERWSW

SEQ ID NO: 4025 - protein, 111 aa, Saccharum officinarum
MERMSSSVQSWVEEHKLSTIGAVWATAVGASVAYSRRRAPARATSLRLIHARMHAQALTLAVLGGAALAHHYYGNSGSSKKTQQEDLDYGFYSQLPPATDADGNENERWSW

SEQ ID NO: 4026 - protein, 111 aa, Saccharum officinarum
MERMSSSVQSWVEEHKLSTIGAVWATAVGASVAYSRRRAPARATSLRLIHARMHAQALTLAVLGGAALAHHYYGNCGSSKKRQQEDLDYGFYSQLPPATDADGNENERWSW

SEQ ID NO: 4027 - protein, 111 aa, Saccharum officinarum
MERMSSSVQSWVEEHKLSTIGAVWATAVGASVAYSRRRAPARATSLRLIHARMHAQALTLAVLGGAALAHHYYGNSGSSKKRQQEDLDYGFYSQLPPATDADGNENERWSW

SEQ ID NO: 4028 - protein, 89 aa, Zea mays
MERMSSSVQSWVEEHKLSSIGAVWATAVGASVAYSRRRAPARATSLRLIHARMHAQALTLAVLGGAALAHRYYGSSERRQRQEDLDYGF

SEQ ID NO: 4029 - protein, 109 aa, Zea mays
MERMSSSVQSWVEEHKLSSIGAVWATAVGASVAYSRRRAPARATSLRLIHARMHAQALTLAVLGGAALAHRYYGSSERRQRQEDLDYGFKSQLPPATDAEGNENERWSW

SEQ ID NO: 4030 - protein, 111 aa, Saccharum officinarum
MERMSSSVQSWVEEHKLSTIGAVWATAVVASVAYSRRRAPARATSLRLIHARMHAQALTLAVLGGAALAHHYYGNSGSSKKRQQEDLDYGFYSQLPPATDADGNENERWSW

SEQ ID NO: 4031 - protein, 111 aa, Saccharum officinarum
MERMSSSVQSWVEEHKLSTIGAVWATAVGASVAYSRRRAPARATSLRLIHARMHAQALTLAVLGGAALAHHYYGNSGSSKKRQQEDLDYGFYSQLPPATDADGNENDRWSW

SEQ ID NO: 4032 - protein, 111 aa, Saccharum officinarum
MERMSSSVQSWVEEHKLSTIGAVWATAVGASVAYSRRRAPTRATSLRLIHARMHAQALTLAVLGGAALAHHYYGNSGSSKKGQQEDLDYGFYSQLPPATDADGNENERWSW

SEQ ID NO: 4033 - protein, 84 aa, Zea mays
MERMSSSVQSWVEEHKLSSIGAVWRRRWARQWRTAGGGRRREPRACASSTPGCTPRRSRSPCSGEPRSRTAITAAARGGRGRRT

SEQ ID NO: 4034 - protein, 134 aa, Saccharum officinarum
MERMSSSVQSWVEEHKLSTIGAVWATAVGASVAYSRRRATSLRLIHARMHAQALTLAVLGGAALAHHYYGNSGSSKKRQQEELDYGFYSQLPPATDADGNENERWSWVHRSNSFHFTWSGEDSSQKTEGQTINY

SEQ ID NO: 4035 - protein, 123 aa, Saccharum officinarum
MERMSSSVQSWVEEHKLSTIGAVWATAVGASVAYSRRRATSLRLIHARMHAQALTLAVLGGAALAHHYYGNSGSSKKRQQEDLDYGFYSQLPPATDADGNRERALELVTPEQQLSLHLVWRRY

SEQ ID NO: 4036 - protein, 133 aa, Saccharum officinarum
  misc_feature (96)..(96): Xaa can be any naturally occurring amino acid
MERMSSSVQSWVEEHKLSTIGAVWATAVGASVAYSRRRAPARATSLRLIHARMHAQALTLAVLGGAALAHHYYGNSGSSKKRQQEDLDYGFYSQLXAGTDADGNENERWYWYHRNSMLQLTCFGEDTSMKTMD

SEQ ID NO: 4037 - protein, 107 aa, Saccharum officinarum
MERMSSSVQSWVEEHKLSTIGAVWATAVGASVAYSRRRATSLRLIHARMHAQALTLGVLGGAALAHHYYGNSGSSKNRLQEDLDYGFYSHLPPATDADGNENDRWIW

SEQ ID NO: 4038 - protein, 108 aa, Panicum virgatum
MERVSSSLQSWVEDHKLSTIGGVWATAVGASVAYSRRRAPQRATSMRLIHARMHAQALTLAVVGGAALMHYYNRSNSNKRKEDLDYDFYSQLPAATDADGNENERWSW

SEQ ID NO: 4039 - protein, 110 aa, Cynodon dactylon
MERMSSSVQFWVEEHKLATVGGVWATAIGASVAYSRRRTPQRATSLRLIHARLHAQALTLAVLGGAALAHHYYNGKNAGKNREADLDYDFYSQLPSATDADGNENERWSW

SEQ ID NO: 4040 - protein, 371 aa, Setaria italica
MARLAGLAALLLLLHLASAASASSNVLLGRKGSSVAAGQSAAAEEEEKAAASRFAVIFDAGSTGSRVHVFKFDSKLDLVPIGDDIEFFAKIKPGLSSYAGRPQEAASSILPLLEQAKKIVPTSLQKYTPLKLGATAGLRLIGDKKAEEILEAVQDLVHTKSKFQYNPKWITVLEGTQEGSYLWVALNYLLGKLGGDYSKTVGVIDLGGGSVQMAYAISTNAAANAPAVPDGKDPYITKEYLKGKDYNLYVHSYLYYGTFASRVEILKAKNGPFSRCVLRGFSGNYTYNGKEYDATASPEGAVYDKCREEIIKALNLSAPCETKNCSFNGVWNGGGGAGQDNLYVASFFFDKATQYGFIESEAPSAKSRHSK

SEQ ID NO: 4041 - protein, 243 aa, Sorghum bicolor
MACLAGSVGVAAILLVFHLASAGGSSSVDLGRKAGSIAAAADEQSPAVEEAASRGRYAVIFDAGSTGSRVHVFKFDKKLDLVPIGDDIEFFTKIKPGLSSFAGKPQEAANSILPLLEQAKEIVPLRLQKDTPLKLGATAGLRLIGDEKAEEILEAVRDLVHTKSKFQYNPKWITVLEGTQEGSYLWVALNYLLGKLGGDYSKTVGVIDLGGGSVQMAYAVSGMLLQMPQLYLMGRIHTLQRST

SEQ ID NO: 4042 - protein, 465 aa, Saccharum officinarum
MARLAGSVAALLLVVFHLVSATSGSSSGVVLGRKGSSIAAAQQSPAVEEAVSRVRGPTGRYAVIFDAGSTGSRVHVFKFDKELDLVPIGDDIEFFSKIKPGLSSFAGKPQEAADSILPLLEQAKKIVPLRLQKNTPLKLGATAGLRLIGDEKAEEILEAVRDLVHTKSKFQYNPKWITVLEGTQEGSYLWVALNYLLGKLGGDYSKTVGVIDLGGGSVQMAYAISTSAAANAPAVPDGKDPYITKEYLKGKDYNLYVHSYLYYGMSAVRVEILKAKNGTFSHCVLRGFSGTYSYNGKDYDATASPEGAVYDKCREEIIKALNLSAPCKAKNCTFNGVWNGGGGAGQDDLYVASFFFDKASQVGFIDSEAPSVKSTPSAFKTAAEKVCLLSADEAKAGYPDLYDVPYICMDLIYQYTLLVDGFGLAPTREITLVSRVKYGEFYVEAAWPLGTAIEAVAPKKMNQDA

SEQ ID NO: 4043 - protein, 359 aa, Zea mays
MDCGGALQLPPGFRFHPTDDELVMYYLLRKCGGLPLAAPVIAEVDLYKFDPWQLPEKAFGGEKEWYFFSPRDRKYPNGSRPNRAAGTGYWKATGADKPVGSPRPVAIKKALVFYAGKPPKGVKTNWIMHEYRLADVDRSAAARKKTNNALRLDDWVLCRIYNKKGVIERYDTVDDDDGDGAVAEDVKPVPAPAASKNPRASARVGAAAAAPMKVELPEYGGGYYDYDDLETPSAGMLCFDRPSAPAPADRDSNNSVPWTTHHTHTDNSSSGSERVLSPSPDLPDRDHAESQPAAAAAAAGWWPVGGDWGSAAEDGFMVDVDVDDGSSLFGPLSPGLFARVDAAAFGFGDMLASYLHKPF

SEQ ID NO: 4044 - protein, 1064 aa, Sorghum bicolor
MPVIAFAHFLYHSFKMNYIEKYCLSELCRYMPVIDSGGCVVKERKSIIVPAKGSKWADLLGSNPWRNIGYIELLADYKSVGHFAGNYTSEDQLLEFLKIHLHASDVPLIRPPNARFHTVSSPLTVDNTFLLLEWIRNIRSNGVTLPDQFLACVKEGSWLKTSVGYKPPNESFLSSANWGSLLQSGTSFIDIPMIDQQFYRNKLHMYKQELKAIGVRFEFKDASSYIGSRLMSMAASNVLTRDCVYSLLRLIRFLREKVLSPSQLIDSVKDGGWMKSTLGYRRPSDCIIKDSEWAVASCISDQPFLDVEFYGEGILSYKSELELLGVIVGFKNNYHLVIDNFKFRSSAITSESTVLILKCIRYVGSCQDFIRKLRDLKWVKTNVGFCAPNVSFLVDSEWECLVKIFKGVPIIDLGFYGSVISSYKEELKKAGLITRFEEASMAIANVFKRMVSESSLTKANVLALLLAYRQLRTHRPLPVELFNCMRTEKWIHTSLGFKSPSNTILFDNAWQYLSPIAILPFIDDGETCNGLGTDIYGYKDELRELGVIVEVKFGARFVLAGLSIPDDPFTMSKATILSFLECIKNYFTSATKPPKGFKDQISKKWLKTSLGYQCPDECILFDAKQCFLQMEDGPFIDEAFYGSDIASFKHHLAMIGVTVDVNCAQDLIARYLRNKKDTDTISRIYMYLKKCNWKPEKNNNNRNWIWIPKETEGGDWVSSKRCVLHDKNNLFGLKLHVLDKYYDRKLLDFFSLAFSVRHGPCSEDYCKLWATWESSVHELAISDCFAFWKFIATNWTKKTEELLSGCVKVPVCTDGKIILTNKENVFIPDDLLLADLFSKHPQQSLFIWYPSSTLPSMSRARFNSIYGSIGVRTISEAVAKNDSFTSANSHFKTAVLSKVIQVGLLQIVLAFLSNPNFDIPAKDRHQLVSCLLNVTIEETDEPITMAYSVSLSSGEMVEVKARRMLRWERENSKLYMQRSDGASSYEDKIELATYFAHEISHGLLFQMPDQISSLTELIKIGRLVDFQQAAVAFLLKSKNLQLFPEDEDFLNSSVLGGSKKPVDN

SEQ ID NO: 4045 - protein, 1398 aa, Zea mays
MEAALEAARAKDTKERLAGVERLHEALDAAARRGLTAAEVTALVDTCMDLTRDANFRIAQGGLQALSAAAVVAGDHFKIHLNALVPAAVERLGDGKQPVRDAARQLLITLMEVSSPTIIVERAGSYAWTHKSWRVREEFVRTVATAIGLFASTEISLQRVLLSPVLQLMNDSNQSVRDAAIYCIEEMYKHMGSQFHEELQRHNLPSYMLKEINSRLDKIEPKVRSSDTAMQYKAVESRSVSANPKRGSPRTKSTPRESTLYGGDTDVTENPVEPVKVHSEKELLREFEKIAATLSPEKDWSLRIAALQRIEALVYGGAIDYPSFLMLLKQLVPPLSNQLCDRRSSIVKQACHLLNILSKELLGDFEPCAELFIPMLFKLVVITVLVIAESADTCIKTILRNCKVARILPRIVDTAKNDRSAILRARCCEYALLILEYWADASEIQRSADLYEDMIKCCVADAMSEVRATARTCYRMFAKTWPERSRRLFMLFDPAIQRIINDEDGGVHKRYASPSLRDRVVQPSRASSHSSGTYVPGYGTSAIVAMDKSAAISSDSSFPSTNLRLSQSKTIGRSSERSLESVLSSSKEKVSAIESLLKGNSALLDSSLPTIPPSSRNGGSRLLETMTTHLPTKERSRSPYLSNMSSESMSGLSLPYSRRSSERLQEGGRMDESYDIRSTRRMPQMHFDRNYVDMPYRDASHRDSHNNNVPNFQRPLLRKQVMSRASASGRHSFDDSHVPSGDVPSYTDSLASLNDALSEGLSPSSDWVARVSAFEFIRNLLKQGQKGIQEITQNFEKVMKLFFRHLDDPHHKVAQAAFSTLAEIIPASKKPFESYVERILPYVFSRLIDPKELVKKPCSITLEVVGRTYAIDMLLPALVRSLDEQRSPKAKLAVLEFANKSFSKYTVDSDGYSNSGFLKLWLSKLAPLVNEKNAKLKEASISGIISVYSHFDSTAVLNFILSLSVEDQNLLRRALKIKTPRIEVDLVNYLQSKKERPRPKSYDQVDFGTSEDGYALTSKKSYPFGRFSSSSLDAEGGKMISSMHEPVLHNVSIGRTTSDMSMDHAIQSLESSTGAEVHLTRSREPKNNINSVVEAARSWTNYTEKTDASLDGETATSTPRLDVSRFVTSDGHNTVGSTTEESVQEGDMIVNLSSIKTSLQMDNGLSVPQLLYQISNDTEVSSSEKREALQQLVDASLDNNSSIWAKYFNQILKVVLEVLDDSDSSMRELALSLITEMLNYQKDAIEDSMEIVFEKLLHVTKDAVAKISNEANQCLNVLLAKYNPFTCLAITVPLLVSDDEKMLVVCINCLTKLVGRLSQEELIVQLPTFLPALFDAFNNQSPDVRKTVVFCLVDIYIMLGKAFAPYLEGLSSTQLRLVTIYANRISQARSGKPIDSNQ

SEQ ID NO: 4046 - protein, 1356 aa, Zea mays
MEAALEAARAKDTKERLAGVERLHEALDAAARRGLTAAEVTALVDTCMDLTRDANFRIAQGGLQALSAAAVVAGDHFKIHLNALVPAAVERLGDGKQPVRDAARQLLITLMEVSSPTIIVERAGSYAWTHKSWRVREEFVRTVATAIGLFASTEISLQRVLLSPVLQLMNDSNQSVRDAAIYCIEEMYKHMGSQFHEELQRHNLPSYMLKEINSRLDKIEPKVRSSDTAMQYKAVESRSVSANPKRGSPRTKSTPRESTLYGGDTDVTENPVEPVKVHSEKELLREFEKIAATLSPEKDWSLRIAALQRIEALVYGGAIDYPSFLMLLKQLVPPLSNQLCDRRSSIVKQACHLLNILSKELLGDFEPCAELFIPMLFKLVVITVLVIAESADTCIKTILRNCKVARILPRIVDTAKNDRSAILRARCCEYALLILEYWADASEIQRSADLYEDMIKCCVADAMSEVRATARTCYRMFAKTWPERSRRLFMLFDPAIQRIINDEDGGVHKRYASPSLRDRVVQPSRASSHSSGTYVPGYGTSAIVAMDKSAAISSDSSFPSTNLRLSQSKTIGRSSERSLESVLSSSKEKVSAIESLLKGVSMSGQNFSAARSTSLDLGVDPPSSRDPPVLLAAPASNVLSLQNSALLDSSLPTIPPSSRNGGSRLLETMTTHLPTKERSRSPYLSNMSSESMSGLSLPYSRRSSERLQEGGRMDESYDIRSTRRMPQMHFDRNYVDMPYRDASHRDSHNNNVPNFQRPLLRKQVMSRASASGRHSFDDSHVPSGDVPSYTDSLASLNDALSEGLSPSSDWVARVSAFEFIRNLLKQGQKGIQEITQNFEKVMKLFFRHLDDPHHKVAQAAFSTLAEIIPASKKPFESYVERILPYVFSRLIDPKELVKKPCSITLEVVGRTYAIDMLLPALVRSLDEQRSPKAKLAVLEFANKSFSKYTVDSDGYSNSGFLKLWLSKLAPLVNEKNAKLKEASISGIISVYSHFDSTAVLNFILSLSVEDQNLLRRALKIKTPRIEVDLVNYLQSKKERPRPKSYDQVDFGTSEDGYALTSKKSYPFGRFSSSSLDAEGGKMISSMHEPVLHNVSIGRTTSDMSMDHAIQSLESSTGAEVHLTRSREPKNNINSVVEAARSWTNYTEKTDASLDGETATSTPRLDVSRFVTSDGHNTVGSTTEESVQEGDMIVNLSSIKTSLQMDNGLSVPQLLYQISNDTEVSSSEKREALQQLVDASLDNNSSIWAKYFNQILKVVLEVLDDSDSSMRELALSLITEMLNYQKDAIEDSMEIVFEKLLHVTKDAVAKISNEANQCLNVLLAKYNPFTCLAITVPLLVSDDEKMLVVCINCLTKL

SEQ ID NO: 4047 - protein, 1443 aa, Oryza sativa
MEAALEAARAKDTKERLAGVERLHEALDAAARQRGLTAGEVTALVDTCMDLIRDANFRVAQGGLQALSAAAVVAGDHFKIHLNALVPAAVERLGDGKQPVREAARQLLITLMEVSSPTIIVERAGSYAWTHKSWRVREEFVRTVATAVGLFASTELPLQRVLLSPVLQLMNDSNQSVRDAAIYCIEEMYTHMGSQFHEELQRHNLPPYMLREINSRLERIEPKVPTSDGNIMQYKAVESRSVSVNPKRGSPRTKSTPRESTLFGGDTDITEKPVEPVRVHSEKELLREFEKIAATLVPEKDWSVRIAAMQRIEALVYGGAIDYPSFLMLLKQLVPPLSTQLSDRRSSIVKQACHLLNVLSKELLGDFEPCAELFIPMLFKLVVITVLVIAESADTCIKTILRNCKISRILPRIADTAKNDRSAVLRARCCEYALLILEYWADAPEIQRSADLYEDLIKCCVADAMSEVRATARSCYRLFAKTWPERSRRLFMSFDPAIQRTINDEDGGVHKRYASPSLRERVVQPSRSLSHASGTSALGYGTSAIVAMDKTAAISSDSSFSSNTLRLSQSKTVGRSSERSLESVLNSSKEKVSAIESLLKGVSISDRQNISATRSTSLDLGVDPPSSRDPPVPLAATASNHLSLQNSALLDSSVPSTINASARNGGSRLLESMTTQLGTRERSRSPYLGNISSESMTSLSLPFPRRSLERPQEGGRMDEGSDIRSTRRFPQTQNYVDMPYRDAIHRDSHNNHVPNFQRPLLRKQVMSRASASIRHSFDDSQVQSGDVSGYTDALASLSDALSEGLSPSSDWVVRVSAFEFIRNLLQQGQRGIQEITQNFEKVMKLFFRHLDDPHHKVAQAAFSTLAELIPACKKPFESYVERILPYVFSRLIDPKELVKKPCSSTLDVVGRTYAIDMLLPALVRSLDEQRSPKAKLAVLEFANKSFSKYTVDSEGYSNSGFLKLWLSKLAPLVHEKNAKLKEASISGIISVYSHFDSTAVLNFILNLSVEEQNLLRRALKQYTPRIEVDLVNYLQSKKDRPRPKSYDQADYGTSSEDGYALASKKSYPFGRYSSSSLDAEGGKWMNSVQESTPRNAPMARTTSDMSIDHTSQSIELDTGSEVLLTRSRESKNNTSSLVETARSWPNYPEKTDAPLDDETAISTPRLDLSHRAASDGHNAVGSTAEENVQEGDIAVKLSSIKTTLHADNELSIPQLLHQISNGTEVSSLEKREALQQLVKASVDNDISIWAKYFNQILTAVLEVLDDSDSSTREIALSLVAEMLNNQSGAMEESIEIVLEKLLHVTKDMVAKISNEANQCLNVLLAKYDPFRCLAVVVPLLVSDDEKTLVVCINSLTKLVGRLSEEELMNQLPTFLPALFDAFSNQSPDVRKTVVFCLVDIYIMLGKAFVPYLEGLNSTQLRLVTIYANRISQARSGAPIDANQ

SEQ ID NO: 4048 - protein, 1439 aa, Brachypodium distachyon
MEAALEAARAKDTKERLAGVERLHEALEAAARRGLTSAEVTALVDTCMDLTRDANFRVAQGGLQALSAAAVVAGDHFKIHLNALVPAAVERLGDGKQPVRDAARQLLITLMEISSPTIIVERAGSYAWAHKSWRVREEFVLTVATAVGLFASTELLMQRVLLSPVLQLMNDSNQSVREAAISCIEEMYKNMGSQFHEELQRHNLPPYMLKEINSRLDRIEPQVPSSDGAATKYKVAESRSLSVNPKRGSPKTKNTARESTLFGGDTDITEKPVEPIRVHSEKELLREFEKIAATLVPEKDWSVRIAAMQRIEALVYGGAIDYPSFLMLLKQLVPPLSTQLSDRRSTIVKQACHLLNVLSKELLGDFEPCAEQFIPMLFKLVVITVLVIAESADTCIKTILRNCKVARILPRVADTAKNDRSAVLRARCCEYALLILEYWADAPEIQRSADLYEDLIKCCVADAMSEVRATARTCYRMFTKTWPERSRRLFMLFDPAIQRTINDEDGVHKRYASPSLRERVVQPSRATSHASGTHIPGYGTSAIVAMDKSAAISSDPSLSLNNLRLSQSKTSSRISERSLESVLSSSKEKVSAIESLLKGVSISDRQNFSVARSTSLDLGVDPPSSRDPPIPLAAPASNHVSLQNSGLVDSTISSTRNGGSRLLDAMATQLGTKERSKSPYLSNVSSESTTGLSLPYLRRSSERLQDGGRMDESNDIRSTRRFPQMHMEKNYVDVPYRDAAAHRDSHNSNVPNFQRPLLRKQVMSRASASGRHSFDDSQVPSGDVARYTDTLASLHDALSEGLNPSSDWVARVSAFDFIRNVLQQGQKGIQEILQNFEKVMKLFFRHLDDPHHKVAQAAFSTLAEIIPACKKPFESYVERILPHVFSRLIDPKELVKKPCSLTLEIVGRLYAIDMLLPALVRSLDEQRSPKAKLAVLEFANKSFSKYTVDSEGYSNSGFLKLWLSKLAPLVNEKNAKLKEASISGIISVYSQFDSTAVLNFILSLSVEEQNLLRRALKQKTPRIEVDLVNYLQSKKERPRPKSYDQTDFGTSSEDGYAQTLKKSYPFGRYSSSSLDAEGGKKMNTVQQSTQHNVSMGRTTSDMSIDTSQSLEPATGTEVLLTRTRESKNHTSSIVEDNRSWTNYPEKTDAALDVETAIGTPRLDFSQFRTPDGHDAVGSATAKGVHEEDMVINLSSIKTNPLADNMLSIPQLLHQISNDTEVSTVEKHAALQQLIKASLGNDSSIWSKYFNQILTSVLEVLGDSDSSTRELALSLVAEMLNNQKDAMEESIEIVFEKLLHLTKDVVAKISNEANRCINVLLAKYDPFRCLAVVAPFFVSDDEKMLVVCINCLTKLVGHLSQEELINQLPAFLPALFDAFSNQSPDVRKSVVFCLVDIYIMLGKAFVPYLEGLSSTQLRLVTIYANRISQARSGAPIDADQ

SEQ ID NO: 4049 - protein, 685 aa, Zea mays
MEAVDKIAEPKDPFVLTAQKVQSSEPPIPIKASCEGNDSQQQEETDLPDDGEESFRSMDSSDEGVRSSFSGASHPPEPIDMDIMKTVYVAIDEKSEPPVSLVRGVSVKGPFIDDLSIRVTGAKANLVVGAGGAEGMAEERKVSASAVASVTTARSSQATSLPQDSEEKECVWDASLPPSGNVSPHSSIDSMGVVTAMSTLNSCTSTYKSETIAGEAMLNVERNCESVKGVRGDLLESAKTSMSRASDSSVVSDDSSWSHITGGASKPHKGNDPRWKAIHAVRTRDSVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPGKHFSEYAARFYAAEVLLALEYLHMLGVVYRDLKPENVLVRDDGHIMLSDFDLSLRCAVSPTLIRTSAFDSDPRRAGGSFCVQPACIEPTSACIQPACFLPKFFGQKSKKKTRKARSELGHNAGTLPELVAEPTSARSMSFVGTHEYLAPEIIKGEGHGSAVDWWTFGIFLHELLYGKTPFKGSGNRATLFNVVGQQLKFPESPSTSYSSRDLIRGLLVKEPQSRLGVKRGATEIKQHAFFEGVNWALIRCSTPPEVPRPVEAELPVKYGVAEAIGSNSKRVVGADVKSAGKYLDFEFF

SEQ ID NO: 4050 - protein, 690 aa, Brachypodium distachyon
MEIVDKIAEPKDPLVVTARKVQNLELPVIPIKASWKGKSSQQQDEKDLPDDGEESFRSMDSSDEGGRNSFSGASHPLEPIDMDLMKTVYVAIDEEKPEPPVCLVRGLSVKAPFIDDLSIRVTGMKANAVVCAGSAEGLAEERKMSGAAVASLATARSSQATETVSLPPDSEEKECVWDASLPPSGNVSPHSSIDSMGVVAAMSIVSSCSNTYKSEAIASETMFTVERNYGSVKGSVRGNSLESAKTSMSRASDSSGVSDDSSWSHITGGASKPHKGNDPRGKAIHAVRVRDGALGMSHFRLLKRLGCGDIGSVYLSELSGTRCYFAMKVMDKACLASRKKLNRAQTEREILQLLDHPFLPTLYTHFETDRFSCLVMEFCPGGDLHTLRQKQPGKHFSEYAARFYAAEVLLAIEYLHMLGVVYRDLKPENVLVRDDGHIMLSDFDLSLRCAVSPTLIRTSAFDSDPKRAGGSFCVQPTCMEPTSACIQPACFMPKLFGQKSKKKTRKTRSELGQSATNLPELLAEPTSARSMSFVGTHEYLAPEIIKGEGHGSAVDWWTFGIFLHELLYGKTPFKGSGNRATLFNVVGQQLRFPESPSTSYASRDLIRGLLAKEPQQRLGVKRGATEIKQHPFFEGVNWALIRCSTPPEVPRPVEAELPVKYGVSEAIPSNKRVVGADMKSGGKYLDFEFF

SEQ ID NO: 4051 - protein, 695 aa, Oryza sativa
MEIVDKIAEPKEPLMVTGRKVQSLEAPIPIKASWKGKSSQQQQQQQQDEKDFPADGEESFLSLDSSDEGGRSSFSGASHPLEPIDMDLMKTVYVAIDEEKSEQPVCLVRGVSAKGPFIDDLSICVTGMKANAVVGAGSADGLAEEMKVPGAAVPSLATARSSQATEAVSLPPDSEEKDCVWDASLPPSGNVSPHSSIDSMGVVTAMNTMSSCTSTYKSEAVSSEPVPTMERNCGSVKGSVRGDSLESAKTSMSRASDSSGVSDDSSWSNITGGASKPHKGNDPRWKAIHAVRTRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQAGKHFSEYAARFYAAEVLLALEYLHMLGVVYRDLKPENVLVRDDGHIMLSDFDLSLRCAVSPTLIRASAFDSDPRRAGGSFCVQPVCMEPTSVCIQPACFMPKLFGQKSKKKTKKTRSELGPSATTMPELVAEPTSARSMSFVGTHEYLAPEIIKGEGHGSAVDWWTFGIFLHELLYGKTPFKGSGNRATLFNVVGQQLRFPESPSTSYASRDLIKGLLVKEPQHRLGVKRGATEIKQHPFFEGVNWALIRCSTPPDVPRPVEAELPVKYGVAEAIGSNSKRMVGADMKSGGKYLDFEFF

SEQ ID NO: 4052 - protein, 692 aa, Triticum aestivum
MELVDKIAEPEDPLVVTARKVQSLEPPLPIPIKASWKGKTSQQQDEKDLPDDGEESFQSVDSSDEGGRSSFSGASHPLEPIDMDLMKTVYVAIDEEKPEPPVCLVRGLSAKGPFMDDLSLRVTGLKANAVVCAGSGEGLAEERKVSGAAVASLATARSSQATETVSLPPDSEEKDCVWDASLPPSGNVSPHSSIDSMGVVTAMSIASNRSNTYKSEAIASGTMLTVERNFGSVKSSVRGDSLESAKTSMSRASDSSGVSDDSSWSHITGGTSKPHKGNDPRGKAIHAVRIRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQKQPGKYFSEYAARFYAAEVLLAIEYLHMLGVVYRDLKPENVLVRDDGHIMLSDFDLSLRCAVSPTLIRTSAFDSDPRRAGGSFCVQPTCMEPTSACIQPACFIPKLFGQKSKKKTRKTRSELGQSAINLPELLAEPTSARSMSFVGTHEYLAPEIIKGEGHGSAVDWWTFGIFLHELLYGKTPFKGSGNRATLFNVVGQQLKFPESPSTSYAGRDLIRGLLAKEPQQRLGVKRGATEIKQHPFFEGVNWALIRCSTPPEVPRPVEAELPVKYGVSEAVASTNKRVVGADAKSSGKYLDFEFF

SEQ ID NO: 4053 - protein, 692 aa, Hordeum vulgare
MEIVDKIAEPEDPLVVTARKVQSLEPPLPIPIKASWKGKTSQQQDEKDLPDDGEESFQSVDSSDEGGRSSFSGASHPLEPIDMDLMKTVYVAIDEEKPEPPVPLVRGLSAKGPFIDDLSLRVTGMKPNAVVCAGSGEGLAEEMKVSGAAVASLATARSSQATETVSLPPDSEEKDCVWDASLPPSGNVSPHSSIDSMGVVTAMSIASNHSNTYKSETIASRTMLTVERNFGSVKSSVRGDSLESAKTSMSRASDSSGVSDDSSWSHITGGTSKPHKGNDPRGKAIHAVRIRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQKQPGKYFSEYAARFYAAEVLLAIEYLHMLGVVYRDLKPENVLVRDDGHIMLSDFDLSLRCAVSPTLIRTSAFDSDPRRAGGSFCVQPTCMEPTSACIQPACFMPKLFGQKSKKKTRKTRSELGQSAINLPELLAEPTSARSMSFVGTHEYLAPEIIKGEGHGSAVDWWTFGIFLHELLYGKTPFKGSGNRATLFNVVGQQLKFPESPSTSYAGRDLIRGLLAKEPQQRLGVKRGATEIKQHPFFEGVNWALIRCSTPPEVPRPVEAELPVKYGVSEAVASTNKRVVGADAKSGGKYLDFEFF

SEQ ID NO: 4054 - protein, 692 aa, Triticum aestivum
MEIVDKIAEPEDPLVVTARKVQSLEPPLPIPIKASWKGKTSQQQDEKDLPDDGEESFQSVDSSDEGGRSSFSGASHPLEPIDMDLMKTVYVAIDEEKPEPPVCLVRGLSGKGPFIDDLSLCVTGLKPNAVVCAGSGEGLAEERKVSGAAVASLATARSSQATETVSLPPDSEEKDCVWDASLPPSGNVSPHSSIDSMGVVTAMSIASNRSNTYKSEAIAGGTMLTVERNFGSVKSSVRGESLESAKTSMSRASDSSGVSDDSSWSHITGGTSKPHKGNDPRGKAIHAVRIRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQKQPGKYFSEYAARFYAAEVLLAIEYLHMLGVVYRDLKPENVLVRDDGHIMLSDFDLSLRCAVSPTLIRTSAFDSDPRRAGGSFCVQPTCMEPTSACIQPACFMPKLFGQKSKKKTKKTRSDLGQSAINLPELLAEPTSARSMSFVGTHEYLAPEIIKGEGHGSAVDWWTFGIFLHELLYGKTPFKGSGNRATLFNVVGQQLKFPESPSTSYAGRDLIRGLLAKEPQQRLGVKRGATEIKQHPFFEGVNWALIRCSTPPEVPRPVEAELPVKYGVSEAVASTNKRVVGADAKSGGKYLDFEFF

SEQ ID NO: 4055 - protein, 583 aa, Setaria italica
MEAVDKIAEPKDPLVLTARKVQSLEPPIPIKASWKGKNSQQQEEKDLPADGEESFRSLDSSDEGGRSSFSGASHPPEPIDMDIMKTVYVAIDEERSEPPVSLVRGVSMKGPFMDDLSIRVAGTKANLVVGAEGLAEERNVSGSAVASVATARSSQATSLPQDSEEKECVWDASLPPSGNVSPHSSIDSMGVVTAMSTLNSCASTYKSEAVASEGMLTVERNCESVKGVRGDLLESAKTSMSRASDSSGVSDDSSWSHITGGASKPHKGNDPRWKAIHAVRTRDSVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPGKHFSEYAARFYAAEVLLALEYLHMLGVVYRDLKPENVLVRDDGHIMLSDFDLSLRCAVSPTLIRTSAFDTDPRRAGGSFCVQPACMEPTSACIQPACFLPKLFGQKSKKKIRKTRSELGQNVGTLPELVAEPTSARSMSFVGTHEYLAPEIIKGEGHGSAVDWWTFGIFLHELLFGKTPFKGSGNRATLFNVVGQQLK

SEQ ID NO: 4056 - protein, 482 aa, Saccharum officinarum
MGSRFASHQLSNGLYVSGRPEQPKEKAPTICSTAMPYTGGDIKKSGELGKMFDLHVEKSRKSGPLGNAPSRNTSFGGAASNSGPVSNAGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASMKMRATSFAHNQAVTNLNTEDGYSIQGSFPKPILWAVILLFVMGFIAGGFILGAVHNAILLIVVVVIFGFVAALLIWNACWGRRGAIGFVNRYPDADLRTAKDGQYVKVTGVVTCGNFPLESSFQRVPRCVYTSTSLYEYRGWDSKAANTEHRRFTWGLRSMERHAVDFYISDFQSGLRALVKTGYGARVTPYVDESVIIDINPDNKDMSPEFLRWLRERNLSSDDRTMRLKEGYIKEGSTVSVMGVVQRNDNVLMIVPPSEPISTGCQWAKCVLPTNLDGLVLRCEDTSNIDVIPV

SEQ ID NO: 4057 - protein, 482 aa, Zea mays
MGSRFASHQLSNGLYVSGRPEQPKEKAPTICSTAMPYTGGDIKKSGELGKMFDLHVEKSRKSGPLGNAPSRNTSFGGAASNSGPVSNAGGRSNYSGSLSSSVPGAGGSARAKSNSGPLNKHGEPTKRSSGPQSGGVTPMARQNSGPLPPVLPTTGLITSGPISSGPLNSSGVPRKVSGPLDSAASMKMRATSFAHNQAVTNLNTEDGYSIQGSFPKPILWAVILLFVMGFIAGGFILGAVHNAILLIVVVVIFGFVAALLIWNACWGSRGAVGFVNRYPDADLRTAKDGQYVKVTGVVTCGNFPLESSFQRVPRCVYTSTSLYEYRGWDSKAANTEHRRFTWGLRSMERHAVDFYISDFQSGLRALVKTGYGARVTPYVDESVIIDINPDNKDMSPDFLRWLRERNLSSDDRTMRLKEGYIKEGSTVSVMGVVQRNDNVLMIVPPSEPISTGCQWAKCVLPTNLDGLVLRCEDTSNIDVIPV

SEQ ID NO: 4058 - protein, 482 aa, Zea mays
MGSRFASHQLSNGLYVSGRPEQPKEKAPTICSTAMPYTGGDIKKSGELGKMFDLHVEKSRKSGPLGNAPSRNTSFGGTASNSGPVSNAGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASMKMRATSFAHNQAVTNLNTEDGYSIQGSFPKPILWAVILLFVMGFIAGGFILGAVHNAILLIVVVVIFGFVAALLIWNACWGSRGGIGFVSRYPDADLRTAKDGQYVKVTGVVTCGNFPLESSFQRVPRCVYTSTGLYEYRGWDSKAANTEHRRFTWGLRSMERHAVDFYISDFQSGLRALVKTGYGARVTPYVDESVIIDIDPDNKDMSPEFLRWLRERNLSSDDRTMRLKEGYIKEGSTVSVMGVVQRNDNVLMIVPPSEPISTGCQWAKCVLPTNLDGLVLRCEDTSNIDVVPV

SEQ ID NO: 4059 - protein, 482 aa, Panicum virgatum
MGSRFPSHQLSNGLYVSGRPEQPKEKAPTICSNVMPYTGGDIKKSGELGKMFDLHVEKSRKSGPLGNAPSRNTSFGGAASNSGPVSNSGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASMKMRATSFAHNQAVTNLNTEDGYSIQGSFPKPILWAVILLFVMGFIAGGFILGAVHNAILLIVVVVIFGFVAALLIWNACWGRRGAIGFINRYPDADLRTAKDGQYVKVTGVVTCGNFPLESSFQRVPRCVYTSTTLFEYRGWDSKAANTEHRRFTWGLRSMERHAVDFYISDFQSGLRALVKTGYGARVTPYVDESVIIDINPDNKDMSPEFLRWLRERNLSSDDRIMRLKEGYIKEGSTVSVMGVVQRNDNVLMIVPPSEPISTGCQWAKCVLPTNIDGLVLRCEDTSNIDIIPV

SEQ ID NO: 4060 - protein, 482 aa, Pennisetum glaucum
MGSRFPSHQLSNGLYVSGRPEQPKEKAPTICSNVMPYTGGDIKRSGELGKMFDLHVEKSRKSGPLGNAPSRNTSFGGAASNSGPVSNSGGRSNYSGSLSSSVPGAGGSARAKSNSGPLNKHGEPTKRSSGPQSGGVTPMARQNSGPLPPVLPTTGLITSGPISSGPLNPSGAQRKISGPLDSASSMKMRATSFAHNQAVTNLNTEDGYTIQGSFPKPILWAVILLFVMGFIAGGFILGAVHNAILLIVVVVIFGFVAALLIWNACWGRRGAIGFVNRYPDADLRTAKDGQYVKVTGVVTCGNFPLESSFQRVPRCVYTSTSLYEYRGWDSKAANTEHRRFTWGLRSMERHAVDFYISDFQSGLRALVKTGCGARVTPYVDESVIIDINPDNKDMSPEFLRWLRERNLSSDDRIMRLKEGYIKEGSTVSVMGVVQRNDNVLMIVAPSEPISTGCQWAKCVLPTNIDGLVLRCEDTSNIDVIPV

SEQ ID NO: 4061 - protein, 180 aa, Pennisetum glaucum
MGSRFPSHQLSNGLYVSGRPEQPKEKAPTICSNVMPYTGGDIKRSGELGKMFDLHVEKSRKSGPLGNAPSRNTSFGGAASNSGPVSNSGGRSNYSGSLSSSVPGAGGSARAKSNSGPLNKHGEPTKRSSGPQSGGVTPMARQNSGPLPPVLPTTGLITSGPISSGPLNPSGAQRKNIWAT

SEQ ID NO: 4062 - protein, 482 aa, Oryza sativa
MGSRFPSHQLSNGLYVSGRPEQPKEKAPVICSTAMPYTGGDIKKSGELGKMFDLHVEKSRKSGPLGNQPSRNTSFGGAGSNSGPVSNALGRSNYSGSISSSVPGAGGSARAKSNSGPLNKHGEPGKKSSGPQSGGVTPMARQNSGPLPPVLPTTGLITSGPISSGPLNSSGAPRKVSGPLDPSVSMKMRATSFAHNPAVTNLNADDGYSIKGSIPKTILWMVILLFLMGFIAGGFILGAVHNPILLVVVVVIFCFVAALVIWNICWGTRGVTGFVSRYPDADLRTAKDGQYVKVTGVVTCGNFPLESSFQRVPRCVYTSTCLYEYRGWDSKAANTEHRQFTWGLRSMERHAVDFYISDFQSGLRALVKTGYGARVTPYVDESVVIDINPDNKDMSPEFLRWLRERNLSSDDRIMRLKEGYIKEGSTVSVMGVVQRNDNVLMIVPPSEPISTGCQWAKCILPTSLDGLVLRCEDTSNIDVIPV

SEQ ID NO: 4063 - protein, 482 aa, Brachypodium distachyon
MGSRFPSHQLSNGLYVSGRPEQPKEKSPVVCSAAMPYTGGDIKKSGELGKMFDLHAEKSRKSGPLGNQPSRNTSFGGAGSNSGPVSSAVGRSNYSGSISSAVPGTGGSARAKSNSGPLNKHGEPTKRSSGPQSGGVTPMARQNSGHLPPILPTTGLITSGPISSGPLNSSGAQRKVSGPLDSNVSMKMRATSFAHNQAVTNLNADAGFLIKASLPKPILWTAILLFVMGLIAGCFILAAVHNPILLVVVVVIFGFVAALLIWNICWGKRGVTKFVSCYPDADLRIAKDGEYVKVTGVVTCGNFPLESSFQRVPRCVYTSTCLYEYRGWDSKAANTQHRRFTWGLRSVERHAVDFYISDFQSGLRALVKTGYGARVAPYVDESVVIDINPENKDMSPEFLRWLRERNLSSDDRIMRLKEGYIKEGSTVSVIGVVQRNDNVLMIVPPSEPFSTGCQWTKCILPTSLDGLVLRCEDASNGDVIPV

SEQ ID NO: 4064 - protein, 482 aa, Oryza sativa
MGSRFPSHQLSNGLYVSGRPEQPKEKAPTICSTAMPYTGGDIKKSGELGKMFELHAVKSRKSGPLSNAPSRNASFGGAASNSGPVPNAGDRSNYSGSLSSSVPGASGSARAKSSSGPLNKHGEPVKRSSGPQSGGVTPMARQNSGPLPPMLPTTGLITSGPITSGPLNSSGAQRKVSGPLDSAASKKTRATSFSHNQAVTKITTEDSYSITGSLSKLILGAVGVLFVLGLIAGILILSAVHNAILLIVVLVLFGFVAALFIWNACWARRGVIGFVDRYSDADLRTAKDGQYIKVTGVVTCGNFPLESSYQRVPRCVYTSTTLHEYRGWDSKAANTQHHRFTWGLRSMEQHAVDFYISDFQSGLRALVKAGYGARVTPFVDESVIIDIDPDNKDMSPEFRRWLRERNLSSDDRIMRLKEGYIKEGSTVSVMGVVQKNDNVLMIVPPPEPISTGCQWAKCVLPRDLYGLVLRCEDTSNIDVIAV

SEQ ID NO: 4065 - protein, 482 aa, Brachypodium distachyon
MGSRFPSHQLSNGLYVSGRPEQPKEKSPVVCSTAMPYTGGDIKKSGELGKMFDLHAEKSRKSGPLGNQSSRNTSFGGAASNSGPVASAVGRPSYSGSISSAAPGTGGSARAKSNSGPLNRHGEPTKRSSGPQSGGVTPTTRQHSGPLPPILPTTGLITSGPISSGPLNSSGAPRKVSGPLDSTVSKKMRATSFAQNQAVTNLNEEDGYSIKDSLPKPIRWAIILLFLLGFIAGGLILGAVHNSILLLVVVVIFGFVAALLIWNICWGTRGVTGFVSRYPDADLRTAGDGQYVKVTGVVTCGNFPLESSFQRVPRCVYTSTCLYEYKGWDSKAANTQQRRFTWGLRSMERHAVDFYISDFQSGLRALVKTGYGARLTPYVDESVVIDINPENKDMSPEFLRWLRERNLSSDDCIMRLKEGYVKEGSTVSVIGVVQRNDNVLMIVPPSEPFSTGCHWAKCILPTSLNGLVLRCEDTSNGDVIPV

SEQ ID NO: 4066 - protein, 478 aa, Pennisetum glaucum
MGSRFPSHQLSNGLYVSGRPEQPKEKAPVICSSAMPYTGGDIKKSGELGKMFDLHRKSGPLGNQPSRNTSFSGAASNSGPVSNAVGRSNYSGSISSAVPGTGGSSRTKSNSGPLNKHGEPTKRSSGPQSGGVTPMARQNSGPLPPVLPTTGLITSGPITSGQMNSSGAQRKVSGPLDSSVSMKMRTASFAHNPAVTNLNAEDGYSIKGSIPAAIMWLVALLFVVGFVAGGFILAAIHNPTLLIVVVVIFAFVAALVTWNICWGTKGVTAFVRRYPDADLRTAKDGEYVKVTGVVTCGNLPLESSFQRVPRCVYTSTCLYEYRGWDSKAANTTHRRFTWGLRSMERHAVDFYISDFQSGLRAQVKTGFGARVTPYVDESVVIDINPDNKDMSPEFLRWLRGRNLSSDDRIMRLKEGYIKEGSTVSVMGVVQRNDNVLMIVPPAEPISTGCQWAKCMLPTSLDGLVLRCEDTSDMDVIPV

SEQ ID NO: 4067 - protein, 478 aa, Saccharum officinarum
MGSRFPSHQLSNGLYVSGRPEQPKEKAPVICSSAMPYTGGDIKKSGELGKMFDLHRKSGPLGNQPSRNTSFGGAANNSGPVSNAVGRSNYSGSISSAVPGTGGSSRTKSNSGPLNKHGEPTKRSSGPQSGGVTPMARQNSGPLPPVLPTTGLITSGPITSGQLNSSGAQRKVSGPLDSSVSMKMRTTSFAHNPAVTNLNVGDGYSIKGSIPTTIIWLVALLFLVGFVAGGFILAAIHNPILLIVVVVIFGFVAALVTWNICWGTKGVIGFISRYPDADLRTAKDGEYVKVTGVVTCGNLPLESSFQRVPRCVYTSTCLYEYRGWDSKAANTTHRRFTWGLRSMERHAVDFYISDFQSGLRALVRTGSGARVTPYVDESVVIDINPDNKDMSPEFLRWLRGRNLSSDDRIMRLKEGYIKEGSTVSVMGVVQRNENVLMIVPPAEPISTGCQWAKCILPASLEGLVLRCEDTSDLDVIPV

SEQ ID NO: 4068 - protein, 478 aa, Saccharum officinarum
MGSRFPSHQLSNGLYVSGRPEQPKEKAPVICSSAMPYTGGDIKKSGELGKMFDLHRKSGPLGNQPSRNTSFGGAANNSGPVSNAVGRSNYSGSISSAVPGTGGSSRTKSNSGPLNKHGEPTKRSSGPQSGGVTPMARQNSGPLPPVLPTTGLITSGPITSGQLNSSGAQRKVSGPLDSSVSMKMRTTSFAHNPAVTNLNVGDGYSIKGSIPTTIIWLVALLFLVGFVAGGFILAAIHNPILLIVVVVIFGFVAALVTWNICWGTKGVIGFISRYPDADLRTAKDGEYVKVTGVVTCGNLPLESSFQRVPRCVYTSTCLYEYRGWDSKAANTTHRRFTWGLRSMERHAVDFYISDFQSGLRALVRTGSGARVTPYVDESVVIDINPDNKDMLPEFLRWLRGRNLSSDDRIMRLKEGYIKEGSTVSVMGVVQRNENVLMIVPPAEPISTGCQWAKCILPASLEGLVLRCEDTSDLDVIPV

SEQ ID NO: 4069 - protein, 482 aa, Triticum aestivum
MGSRFPSHQLSNGLYVSGRPEQPKEKAPVVCSAAMPYTGGDIKKSGELGKMFDLHAEKSRKSGPLGNQPSRNTSFGGAASNSGPVSSAASRSNYSGSISAAVPGTGGSARAKSNSGPLNKHGEPTKRSSGPQSGGVTPMARQNSGHLPPILPTTGLITSGPISSGQLNSSGALRKVSGTLDSTVSMKMRATSSAYNPAVTNINEQNSYSIKASLPKPILWAAILLFAMGFIAGGFILAAVHNSILLVVVVVIFGFVAALLVWNICWGTRGMTRFVSRYPDADLRIAKDGEYVKVTGVVTCGNFPLESSFQRVPRCVYTSSCLYEYRGWDSKAANTQHRRFTWGLRSIERHAVDFYISDFQSGLRALVKIGYGARLIPYVDEAVVIDINPENKDMSPEFLRWLRERNLSSDDRIMRLKEGYIKEGNTVSVIGVVQRNDNVLMIVPPPEPFNTGCQWGKCLLPTSLDGLVLRCEDTSNGDVIPV

SEQ ID NO: 4070 - protein, 478 aa, Panicum virgatum
MGSRFPSHQLSNGLYVSGRPEQPKEKAPVMSSSAMPYTGGDLKKSGELGKMFDLHRKSGPLGNQPSRNTSFGGAASNSGPVSNAVGRSNYSGSISSAVPGTGGSSRTKSNSGSLNKHGEPTKRLSGPQSGGVTPMARQNSGPLPPVLPTTGLITSGPITSGQMNSSGAQRKVSGPLDPSVSMKMRTASFAHNPAVTNLNAEDGYSIKGSIPTAIMWLVALLFVVGFVAGGFILAAIHNPILLIVVVVIFGFVAALITWNICWGTKGVTRFVSRYPDADLRTAKDGEYVKVTGVVTCGNLPLESSFQRVPRCVYTSTCLYEYRGWDSKAANTTHRRFTWGLRSMERHAVDFYISDFQSGLRALVRTGFGARVTPYVDESVVIDINPDNKDMSPEFLRWLRGRNLSSDDRIMRLKEGYIKEGSTVSVMGVVQRNDNVLMIVAPAEPISTGCQWAKCMLPTSLDGLVLRCEDTSDMDVIPV

SEQ ID NO: 4071 - protein, 478 aa, Sorghum bicolor
MGSRFPSHQLSNGLYVSGRPEQPKEKAPVICSSAMPYIGGDIKKSGELGKMFDLHRKSGQLGNQPSRNTSFGGAGNNSGPVSNAVGRSNYSGSISSAVPGTGGSSRTKSNSGPLNKHGEPTKRSSGPQSGGVTPMARQNSGPLPPILPTTGLITSGPITSGQLNSSGAQRKVSGPLDSSVSMKMRATSFAHNPAVTNLNVGGGYSIKGSIPTTIIWLVGLLFLVGFVAGGFILAAIHNPILLIVVVVIFGFVAALVTWNICWGTKGVIGFISRYPDADLRTAKDGEYVKVTGVVTCGNLPLESSFQRVPRCVYTSTCLYEYRGWDSKAANTTHRRFTWGLRSMERHAVDFYISDFQSGLRALVRTGSGARVTPYVDESVVIDINPDNKDMSPEFLRWLRGRNLSSDDRIMRLKEGYIKEGSTVSVMGVVQRNENVLMIVPPAEPISTGCQWAKCILPASLEGLVLRCEDTSDLDVIPV

SEQ ID NO: 4072 - protein, 478 aa, Zea mays
MGSRFPSHQLSNGLYVSGRPEQPKEKAPVICSSAMPYTGGDIKKSGELGKMFDLHRKSGPLGNPPSRNTSFGGAAANSGPVSNAVGRSNYSGSISSAVPGTGGSSRTKSNSGPLNKHGEPTKRLSGPQSSGVNPMARQNSGPLPPVLPTTGLITSGPITSGQLNSSGAQRKVSGPLDSSVSMKMRVTSFAHNPAVTNINVGDGYSIRGSIPTTIIWLVALLFLVGFVAGGFILAAIHNPILLIVVVVIFGFVATLVIWNICWGRRGVIGFISRYPDADLRTTKDGEYVKVTGVVTCGNLPLESSFQRVPRCVYTSTCLYEYRGWDSKAANSTHHRFTWGLRSMERHAVDFYISDFQSGLRALVRTGSGARVSPYVDESVVIDINPDNKDMSPEFLRWLRGRNLSSDDRIMRLKEGYIKEGSTVSVMGVVQRNENVLMIVPPAEPISTGCQWAKCILPTSLDGLVLRCEDTSDLDVVPV

SEQ ID NO: 4073 - protein, 478 aa, Zea mays
MGSRFPSHQLSNGLYVSGRPEQPKEKSPVICSSAMPYTGGDIKKSGELGKMFDLHRKSGPLGNQTSRNTSFGGAASNSGPVSNAVGRSNYSGSISSAIPNTGGSSRTKTNSGPLNKHGEPTKRSSGPQSGGVTPMARQNSGPLPPVLPTTGLITSGPITSGQLNSSGAQRKVSGPLDSSVSMKMRTTSFAHNPAVTNLNVGDGYSIKGSIPTTIIWLVALLFLVGFVAGGFILAAIHNPILLIVVVVIFGFVAALVTWNICWGTRGVIDFIGRYSDVDLRTAKDGEYVKVTGVVTCGNLPLESSFQRVPRCVYTSTCLYEYRGWDSKAANATHRRFTWGLRSMERHAVDFYISDFQSGLRALVRAGSGARVTPYVDESVAIDVNPDNKDMSPEFLRWLRGRNLSSDDRTMRLKEGYIKEGSTVSVMGVVQRNENVLMIVPPAEPISTGCQWGKCVLPTSLEGLVLRCEDTSGLDVIPV

SEQ ID NO: 4074 - protein, 483 aa, Brachypodium distachyon
MGSRFPSHQLGNGLYVSGRPEQPKEKGPTMGSTVMPYTGGDIKKSGELGKMFDLHAEKSRKSGPLGNAPSRNTSFGGAASNSGPVSNAGGRSNYSGSLSSSVPGAGGSARAKSNSGPLNKHGEPAKRSSGPQSGGVTPMARQNSGPLPPMLPTTGLITSGPISSGPMNSSGAPRKKVSGSLDAAASMKTRATSFAHNQAVTNLTRDNDFSIKDSISKCLLYCLAGLIGTALIVGVFILVAVHNAIVLIVVVVMCGSIAALVTWNVWQGRRGVIGFVNRYPDTDLRTAKDGQYVKVTGVVTCGNFPLESSFQRVPRCVYTSTGLYEYRGWGSKTANTKHRQFTWGLRTMERHAVDFYISDFQSGLRALVKTGYGAPVTPYVDESVVIDINPENKDMSPEFLRWLRERNLSSDDRIMRLKEGYIKEGSTVSVMGVVQKNDSVLMIVPPREPISSGCQWTKCFLSSNLDGLVLRCEDTSNMDVIPV

SEQ ID NO: 4075 - protein, 483 aa, Hordeum vulgare
MGSRFPSHQLSSGLYVSGRPEQPKEKAPTFGSNVMPYTGGDTKKSGELGKMFELHAERSRKSGPLGNAPSRNPSFGGAASNSGPVSNAGGRSNYSGSLSSSVPGAGGSARAKSNSGPLNKHGEPVKRSSGPQSGGVTPMARQNSGPLPPMLPTTGLITSGPVTSGPLNSSGAPRRKVSGSLDPAASMKVRATSLAHNQAVTTLTSEGGFSVMGSISKWVFWLVITLLLFGFAVGLFILIAVHNAIVLIVVVAMIGSAAALVSWNVWRGRRGVLRFVNSCPDTDLRTAKDGEYVKVTGVVTCGNFPLESSFQRIPRCVYTSTRLYEYRGWDSKTANPKHRRFTWGLRTAERHAVDFYISDFQSGLRALVRTGSGARVTPYVDESVVIDVNPENKDMSPEFLRWLRERNLSSDGRKMRLKEGYIKEGSTVSVMGVVQKNESVLMIVPPSEPISSGCQWGTCFFPANLDGLVVRCEDTSDMDVIPV

SEQ ID NO: 4076 - protein, 483 aa, Triticum aestivum
MGSRFPSHQLSSGLYVSGRPEQPKEKAPTFGSNVMPYTGGDTKKSGELGKMFELHAERSRKSGPLGNAPSRNPSFGGAASNSGPVSNAGGRSNYSGSLSSSVPGAGGSARAKSNSGPLNKHGEPVKRSSGPQSGGVTPMARQNSGPLPPMLPTTGLITSGPVTSGPLNSSGAPRRKVSGSLDPAASMKARATSLAHNQAVTTLTSEDGFSVMGSISKWVFWLVITLLLFGFAVGLFILIAVNNAIVLIVVVAMIGSVAALVSWNVWRGRRGVLRFVNSCPDTDLRTAKDGEYVKVTGVVTCGNFPLESSFQRIPRCVYTSTRLYEYRGWDSKTANPKHRRFTWGLRTAERHAVDFYISDFQSGLRALVRTGSGARVTPYVDESVVIDVNPENKDLSPEFLRWLRERNLSSDGRKMRLKEGYIKEGSTVSVMGVVQKNESVLMIVPPSEPISSGCQWGSCFFPANLDGLVVRCEDTSDMDVIPV

SEQ ID NO: 4077 - protein, 483 aa, Triticum aestivum
  misc_feature (242)..(242): Xaa can be any naturally occurring amino acid
MGSRFPSHQLSSGLYVSGRPEQPKEKAPTFGSNVMPYTGGDTKKSGELGKMFELHAERSRKSGPLGSAPSRNPSFGGAASNSGPVSNAGGRSNYSGSLSSSVPGAGGSARAKSNSGPLNKHGEPVKRSSGPQSGGVTPMARQNSGPLPPMLPTTGLITSGPVTSGPLNSSGAPRRKVSGSLDPAASMKARATSLAHNQAVTTLTSEGGFSVMGSISKWVFWLVITLLLFGFAVGLFILIAVXNAIVLIVVVAMIGSVAALVSWNVWRGRRGVLRFVNSCPDTDLRTAKDGEYVKVTGVVTCGNFPLESSFQRIPRCVYTSTRLYEYRGWDSKTANPKHRRFTWGLRTAERHAVDFYISDFQSGLRALVRTGSGARVTPYVDESVVIDVNPENKDMSPEFLRWLRERNLSSDGRKMRLKEGYIKEGSTVSVMGVVQKNESVLMIVPPSEPISSGCQWGSCFFPANLEGLVVRCEDTSDMDVIPV

SEQ ID NO: 4078 - protein, 482 aa, Zostera marina
MGSRFPSHQLSNGLYVSGRPEQPKEKPVTMSSTAMPYTGGDIKKSGELGKMFDIHGEYSKSRKSGPITNAPSRTGSFGGATSNNTGRASYSSGPVGSGVPGSGTGGGSIRQKSNSGPLNRHGESIKKLSGPQSGCVTPMARQNSGPLAPMLPTTGLITSGPISSGPLNSSGAPRKVSGPLDSTGSLKLHSASIVHNQAVTNLSQEDEYSFRRSFPKPIFWAVILLFVMGFIAGGFILGAVHNAILLIVVVVLFGAVAALFTWNTCWGRRSITRFIAQYPDAELRTAKDGQYVKVSGVVTCGNVPLESSFQKIPRCVYISTSLYEHRGWESKAANPKHRRFTWGLRSMERHVVDFYISDFQSGLRALVKTGYGARVTPYVDESVVVDINPDNKDMSPQFLRWLRERNLSSDDRVMRLNEGYIKEGSTVSVMGVVQRNDNVLMIVPPSEPFSTGCQWENCTLPANLDGVVLRCEDISKIDVIPV

SEQ ID NO: 4079 - protein, 84 aa, Saccharum officinarum
MGFHLLAFVAARGLMQVFNLSAPLNLRLPLARHLPEAFAVLYGVLASHAAWLNDALARGAAWSHSGSRGGVDEYVRYAMLSISD

SEQ ID NO: 4080 - protein, 84 aa, Sorghum bicolor
MGFHLLAFVAARGLMQVFNLSAPLNRRLPLARHLPEAFAVLYGVLASHAAWLNDALARGAAWRHSGSRGGVDEYVRYAMLSISD

SEQ ID NO: 4081 - protein, 84 aa, Zea mays
MGFPLLAFVAARGLMQVFNLSAPLNLRLPLARHLPEAFAVLFGVLASHAAWLSDALARGAAWRHTGNRGGVDEYVRYAMLSISD

SEQ ID NO: 4082 - protein, 84 aa, Zea mays
MGFHLLAFVAARGLMQAFNLSAPLSLRLPLARHLPEALAVLYGVLAAQAAWLNGALARGAAWSHSGSRGGVDEYVRHAMLSVYD

SEQ ID NO: 4083 - protein, 209 aa, Zea mays
MASSLARLGAALPRARPRAATRTLPPPRWDAAALGASRRAAPNVCRCLVHSDVKVAPTSDFKDSSKSETWRIKMLYDGDCPLCMREVNMLRERNKSYGAIKFVDISSKDYSPDDNQGLDYETSMGRIHAVLSDGTVVTDVEAFRKLYEEVGLGWVYAVTKYEPVASMANAVYGLWAKYRMQITGRPPLEEIMASRRAAGECKDDKVCKM

SEQ ID NO: 4084 - protein, 210 aa, Setaria italica
MASSLARLGAALPRARPRPGARVLPPGRWDAAALGASRRAAPNVGRCQVHSDVKVAPTSDLKDGDNSSKNWRIKMLYDGDCPLCMREVNMLRERNKSYGAIKFVDISSKDYSPDDNQGLDYETVMGRIHAILSDGTIVTDVEAFRRLYEEVGLGWVYAVTKYEPVATMANAVYGVWAKYRMQITGRPPLEEIMASRKAAGECKDDKVCKM

SEQ ID NO: 4085 - protein, 209 aa, Oryza sativa
MASSLARMGAALPRVRPRAAARFPPPPGRWDSAAALRRAPVYGFRCQVHSDVKVGPSSGLKDGENSSGSWRIKMLYDGDCPLCMREVNMLRERNKSYGAIKFVDISSKDYSPQDNQNLDYETAMGRIHAILSDGTIVTDVEAFRKLYEEVGLGWIYAVTKYEPVAKVANAIYGVWAKYRMQITGRPPLEEIMESRKLAAECKDDKVCKM

SEQ ID NO: 4086 - protein, 210 aa, Avena sativa
MASSLARLGAALPRALPLAAAAARVPPRGGRWDSAASRPASLYAWRRQVHSDVKVSPAAEPKDVGNSSQNWRIKMLYDGECPLCMREVNMLRERNKSYGAINFVDISSKDYSAKDNHGLDYETAMGRIHAILSDGTIVTDVEAFRRLYEEVGLGWVYAVTKYEPVATIANAVYGVWAKYRMEVTGRPPLEEIFAARRQAGECKDDKACKM

SEQ ID NO: 4087 - protein, 215 aa, Brachypodium distachyon
MASSLARLGAALQPRARPLAAASRRILLPQGGRWDPAAAASRPASLYACKCQVHSNVKVSPPTSEVKDGGNSSQSWRIKMLYDGDCPLCMREVNMLRERNKSYGAINFVDISSKDYTPKDNQGLDYETAMGRIHAILADGTIVTDVEAFRRLYEEVGLGWVYAVTKYEPVSTIANAVYGVWAKYRMEVTGRPPLEEIFAARRQAGECKDDKACKM

SEQ ID NO: 4088 - protein, 463 aa, Zea mays
MLSLSHPHPHPAASTTAPRHQRTAPVWHRRRASHIAASAILLPGGGSTGGRGGPGDRRLPFTPPPMAPPGQLYQPFHPPPSPLPPSLRNLDLSERLQILRDRMGLWHEYAPLISSLSRDGFNPSSIQEATGISGVEQNCLVVASQVRDSLLDDRAAAFPPDLLPYFDSLGGPEVLYELRFLNARQRADAARHAIGYRLEPKGVRELARAMKGFPRWRGEEGWEAFSKDSPADCLAFARFRQSREAIDVQDRVAELERALQVVETESGRARVELELERARRKAAGEEEVDEEGEEDDAAASLRPGVTVVRLRYGEVAEATTVILLPVVRETDGVAAMESAPRRAKTDVGLGVVEVDRAWARWAVVPGWGPVAEAADDAVVVELADGRRLPWRMSDEEPVLVIANRSKKEVVEEGVYVLEREGRLVVERGKKLAEQGIAAAAAEVVIVVRPPKDEDDMVSDEEWD

SEQ ID NO: 4089 - protein, 206 aa, Setaria italica
MLSLSHPHTHPAAAPRHQRAPRPAVAATPASCRRRASHIAASAILLPGGGSTGGRGDRKLPFTPPPMAPPGQLYQPFHPPPSPLPSKFRTLDLTQRLEVLRERLGQWHEYAPLISALSRDGFTPSSIEEATSITGVEQNCLVVASQVRDSLLSETAAFPPDLLPYFDSYGGPDLLYELRFLNAPTPRSTPSTTASSPRACGSWRAP

SEQ ID NO: 4090 - protein, 577 aa, Zea mays
MRWSAFLWEAASGRRPGVSNLLLVVAAASSGGLVAYADSGSDAAVEQPQLPPRKKVVVLGTGWGGTTFLRNLDSRLYDVQVISPRNYFAFTPLLPSVTSGTVEPRSIVEPIRRVLEKKGGEIKFWEAECFKIDPQSKKIHCRSNVGTSLEGNGEFLVDYDYLVVAVGARTNTFNTPGVVENCHFLKEVEDAQKIRRSVMDCFERASLPFLNEEERKKNLHFVVVGGGPTGVEFAASLHDFVTEDLSKLYPSIQHLVKISLIEAADHILTMFDKRITNFAEDKFGRDGIDVKTGYKVVKVSKDDITMQNPATGDISVPYGMAVWSTGIGTRPFVVEFMKQIGQANRRVLATDEWLRVRECDGVYAIGDCATINQRKVMEDISEIFRVADKDKSGTLTVKEIQDILDDIYVRYPQVQLYLKSKQMNGIADLVRSAKGDAEKESVELNIEEFKKALSLVDSQVKFLPATAQVASQQGQYLARCFNKMKDAEENPEGPIRIRGEGRHRFRPFRYRHLGQFAPLGGEQTAAQLPGDWISIGHSSQWLWYSVYATKQISWRTRMLVVSDWTRRFIFGRDSSCI

SEQ ID NO: 4091 - protein, 567 aa, Panicum virgatum
GARRRPGVSNLLLVVAAASSGGLVAYADSGSDAAVEKPQLPQRKKVVVLGTGWGGTTFLRNLDSRMYDVQVISPRNYFAFTPLLPSVTSGTVEPRSIVEPIRRILEKKGGEIKFWEAECFKIDPQNKKIHCRSNIGTNLDGNGEFLADYDYLVVAVGARTNTFNTPGVVENCHFLKEVEDAQKIRRSVMDCFERASLPFLDEEERKKNLHFVVVGGGPTGVEFAASLHDFVTEDLSKLYPSIQHLVKISLIEAADHILTMFDKRITNFAEDKFGRDGIDVKTGYKVVKVSKDAITMQNPATGNISVPYGMAVWSTGIGTRPFIVEFMKQIGQGNRRVLATDEWLRVRECDGVYAIGDCATINQRRVMEDIAEIFRVADKDKSGTLTVKEIQDVLDDIYVRYPQVQLYLKSKQMNGIADLVRSAKGDAEKESVELNIEEFKKALSLVDSQVKFLPATAQVASQQGQYLARCFNKMKDAEEHPEGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 4092 - protein, 546 aa, Setaria italica
ASSGGLVAYADSGSDAAVEKPQLPQRKKVVVLGTGWGGTTFLRNLDTRLYDVQVISPRNYFAFTPLLPSVTSGTVEPRSIVEPIRRVLEKKGEEIKFWEAECFKIDPQNKKIHCRSNLGTNLDGNGEFLVDYVAVGARVNTFNTPGVVENCHFLKEVEDAQKIRRSVMDCFERASLPFLDEEERRKNLHFVVVGGGPTGVEFAASLHDFVTEDLSKLYPSIQHLVKISLIEAADHILTMFDKRITNFAEDKFGRDGIDVKTGYKVVKVSKDAITMQNPGTGDISVPYGMAVWSTGIGTRPFIVEFMKQIGQGNRRVLATDEWLRVRECDGVYAIGDCATINQRRVMEDISEIFRVADKDKSGTLTVKEIQDVLDDISMRYPQLQLYLKSKQMNGIADLVRSAKGDAEKESVELNIEEFKKALSLVDSQVKFLPATAQVASQQGQYLARCFNKMKDAEEHPEGPIRIRGEGRHRFRPFRYRHLGQFAPLGGEQTAAQLPGDWISIGHSSQWLWYSVYATKQISWRTRMLVVSDWTRRFIFGRDSSCI

SEQ ID NO: 4093 - protein, 580 aa, Brachypodium distachyon
MRWTAFVWDGATRAMKHRPTFTNLVLVLAASSGGGLVAYADSQSDGVVDMPQGPKKKKVVVLGTGWGGTTFLRNLDSKLYDVQVISPRNYFAFTPLLPSVTCGTVEPRSVVEPIRRILEKKGGDFKFWEAECFKIDPANKKIHCRSNAGTNLDGNGEFLVDYDYLVVAVGARSNTFNTPGVEENCHFLKEVEDAQKIRRSVMNCFEKASLPYLNEEEKKKNLHFVIVGGGPTGVEFAAELHDFVTEDLSKLYPSIQHLVKISLIEAADHILTMFDKRITNFAEDKFGRNGIDVKTGYKVVKVSKDAITMQNPATGDIAVPYGMAVWSTGIGTRPFIVDFMKQIGQANRRVLATDEWLRVRECDDIYAVGDCATINQRRVMEDIAEIFRVADKDKSGTLTVKEIQDILEDIYVRYPQVKLYMKSKQMNGIADLISTGEGDTKKENVELNIEEFKKALSLVDSQVKNLPATAQVAAQQGQYLARCFNKMPDAEENPEGPIRIRGEGRHRFRPFRYRHLGQFAPLGGEQTAAQLPGDWISIGHSSQWLWYSVYATKQISWRTRALVISDWGRRFIFGRDSSCI

SEQ ID NO: 4094 - protein, 576 aa, Hordeum vulgare
MRWTAFAWESASRAFNNRPTFTGLVVVLAASSGGGLVAYADSQPDQPQGFKKKKVVVLGTGWAGTTFLRNLDSKLYDVQVISPRNYFAFTPLLPSVTCGTVEPRSVVEPIRRILEKKGGDFKFWEAECFKIDPANKKIHCRSNVGTNLDGNGEFLVDYDYLVVAVGARSNTFNTPGVTENCHFLKEVEDAQKIRRSVMDCFEKASLPYLNEEERKKNLHFVVVGGGPTGVEFAAELHDFVTEDLSKLYPSIQHLVKISLIEAADHILTMFDKRITNFAEDKFGRDGIDVKTGYKVVKVSKDAITMQNPATGDIAVPYGMAVWSTGIGTRPFVVDFMKQIGQANRRVLATDEWLRVRECDDVYAVGDCATINQRRVMEDISEIFRVADKDKSGTLTVKEIQDILEDIYVRYPQVKLYMKSKQMNGIADLIRTGKGDTEKESVDLSIEEFKKALSLVDSQVKNLPATAQVAAQQGQYLATCFNKMQAAEENPEGPIRIRGEGRHRFNPFRYRHLGQFAPLGGEQTAAQLPGDWVSIGHSSQWLWYSVYATKQISWRTRALVISDWGRRFIFGRDSSGI

SEQ ID NO: 4095 - protein, 576 aa, Triticum aestivum
MRWTAFAWESASRAFNNRPTFTGLVVVLAASSGGGLVAYADSQPDQPQGFKKKKVVVLGTGWAGTTFLRNLDSKLYDVQVISPRNYFAFTPLLPSVTCGTVEPRSVVEPIRRILEKKGGDFKFWEAECFKIDPANKKIHCRSNMGTNLDGNGEFLVDYDYLVVAVGARSNTFNTPGVTENCHFLKEVEDAQKIRRSVMDCFEKASLPYLNEEERKKNLHFVVVGGGPTGVEFAAELHDFVTEDLSKLYPSIQHLVKISLIEAADHILTMFDKRITNFAEDKFGRDGIDVKTGYKVVKVSKDAITMQNPATGDITVPYGMAVWSTGIGTRPFVVDFMKQIGQANRRVLATDEWLRVRECDDVYAVGDCATINQRRVMEDISEIFRVADKDKSGTLTVKEIQDILEDIYVRYPQVKLYMKSKQLNGIADLIRTGKGDTEKESVELSIEEFKKALSLVDSQVKNLPATAQVAAQQGQYLATCFNKMQTAEENPEGPIRIRGEGRHRFNPFRYRHLGQFAPLGGEQTAAQLPGDWVSIGHSSQWLWYSVYATKQISWRTRALVISDWGRRFIFGRDSSGI

SEQ ID NO: 4096 - protein, 576 aa, Triticum aestivum
MRWTAFAWESASRAFNNRPTFTGLVVVLAASSGGGLVAYADSQPDQPQGFKKKKVVVLGTGWAGTTFLRNLDSKLYDVQVISPRNYFAFTPLLPSVTCGTVEPRSVVEPIRRILEKKGGDFKFWEAECFKIDPANKKIHCRSNMGTNLDGNGEFLVDYDYLVVAVGARSNTFNTPGVTENCHFLKEVEDAQKIRRSVMDCFEKASLPYLNEEERKKNLHFVVVGGGPTGVEFAAELHDFVTEDLSKLYPSIQHLVKISLIEAADHILTMFDKRITNFAEDKFGRDGIDVKTGYKVVKVSKDAITMQNPATGDITVPYGMAVWSTGIGTRPFVVDFMKQIGQANRRVLATDEWLRVRECDDVYAVGDCATINQRRVMEDISEIFRVADKDKSGTLTVKEIQDILEDIYVRYPQVKLYMKSKQLNGIADLIRTGKGDTEKESVELNIEEFKKALSLVDSQVKNLPATAQVAAQQGQYLATCFNKMQTAEQNPEGPIRIRGEGRHRFNPFRYRHLGQFAPLGGEQTAAQLPGDWVSIGHSSQWLWYSVYATKQISWRTRALVISDWGRRFIFGRDSSGI

SEQ ID NO: 4097 - protein, 357 aa, Oryza sativa
MRWTAFMWEGASRAFNHRPTFTNLVLVLGAASSGGLVAYADSNSDDVVGKPQGPPKKKIVVLGTGWGGTTFLRNLDSRLYDVQVISPRNYFAFTPLLPSVTCGTVEPRSVVEPIRRILEKKGGDIKFWEAECFKIDSSNKKIHCRSNIGTNLDGNGEFLVDYDYLVIAVGARSNTFNTPGVEENCFFLKEVEDAQKIRRNVMDCFERASLPYLDEEERKKNLHFVVVGGGPTGVEFAAELHDFVTEDLSKLYPSIQHLVKISLIEAADHILTMFDKRITEFAEDKFGRDGIDVKTGYKVVKVAKDAITMQNPATGDIAVPYGMAVWSTGIGTRPFISEFMKQIGQVPSKKLSSTLCS

SEQ ID NO: 4098 - protein, 502 aa, Pennisetum glaucum
LYDVQVISPRNYFAFTPLLPSVTSGTVEPRSIVEPIRRVLEKKGGEIKFWEAECFKIDPQNKKIHCRSNLGTNLDGNGEFLVDYDYLVVAVGARVNTFNTPGVVENCHFLKEVEDAQKIRRSVMNCFERASLPYLDEEERKKNLHFVVVGGGPTGVEFAASLHDFVTEDLSKLYPSIQHLVKISLIEAADHILTMFDKRITNFAEDKFGRDGIDVKTGYKVVKVSKDAITMQNPGTGDISVPYGMAVWSTGIGTRPFIVDFMKQIGQGNRRVLATDEWLRVLECDGVYAIGDCATINQRRVMEDISEIFRVADKDKSGTLTVKEIQDVLDDIYVRYPQVQLYLKSKQMNGIADLVRSAKGDAEKESVELNIEEFKKALSLVDSQVKFLPATAQVASQQGQYLARCFNKMKDAEENPEGPIRIRAEGRHRFRPFRYRHLGQFAPLGGEQTAAQLPGDWISIGHSSQWLWYSVYATKQISWRTRMLVVSDWTRRFIFGRDSSCI

SEQ ID NO: 4099 - protein, 334 aa, Zea mays
MAGSVSNGSGKSLARWLRENGFDDDAVARMSRRCRNLHSLDAGEAPGVWDYLLTGVKMERRKLRHVVAKCPKLLTLSVDGKLAPTVQCLATLQARPGEVAQAIAKFPQILFHSVEEKLCPLLAFFQTLGVSERQLAKLLMVNPRLISYSIEAKFSQTVGFLAGLGVDREGMIGKILTKEPYIMGYSVDKRLRPTAEFLKSEVGLQGPDLQRVVMTFPDILSRDVDKILRPNLAFLQSRGFSRDQVTALVAGYPPVLIKSIKHCLEPRIKFLVEEMGRDMGEVVDYPQFFRHGLKRSLEYRHKVLKQMNSSCSLSEMLDCNHKKFAMKFGLVAAV

SEQ ID NO: 4100 - protein, 334 aa, Zea mays
MAGSVSNGSGKSLARWLRENGFDDDAVARMSRRCRNLHSLDAGEAPGVWDYLLTGVKMERRKLRHVVAKCPKLLTLSVDGKLAPTVQCLATLQARPGEVAQAIAKFPQILFHSVEEKLCPLLAFFQTLGVSERQLAKLLMVNPRLISYSIEAKFSQTVGFLAGLGVDREGMIGKILTKEPYIMGYSVDKRLRPTAEFLKSEVGLQGPDLQRVVMTFPDILSRDVDKILRPNLAFLQSRGFSRDQVTALVAGYPPVLIKSIKHCLEPRIKFLVEEMGRDMGEVVGYPQFFRHGLKRSLEYRHKVLKQMNSSCSLSEMLDCNHKKFAMKFGLVAAV

SEQ ID NO: 4101 - protein, 1068 aa, Sorghum bicolor
MPTPVPAARQCLAPPAVTALDAAVASARRRAHAQTTSLHLIASLLAPTAAPLLRDALARARSAAYSPRLQLKALDLCFAVSLDRLPSTPTSSSASSSNDQHEPPVANSLMAAIKRSQANQRRNPDTFHFYHHHHQAAASPTPSSRVFADAGFRSNEIKVAILRPAPPVPLLARAGLPTRARPPPLFLCSFAAADDADVPSPAGAAPGEDNCRRIADILARGRNPMLVGVGAASAAADFANASPYRILPVGPASVNQNQTDLLAVATPGSGIIFSIGDLKDLVPDEADLQDAARRVVAEVTRLLETHRAAGRHTVWVMGWSATYETYLAFLSKFPLVDKDWELQLLPITAVRDARPCSRTRASSSSSKPRLLPCPMPATTSFMESFVPFGGFLCDPYEANSCPQALRCQQCNDRYEQEVATIIRGSGITAEAHQDGLPSMLQNGSMMGPNNGFDVLKVRDDQMVLSTKIQNLKKKWNEYCLRLHQGCNRINRDPCQLFRHHIDVRQINADLVLNLQVRQSKSDEPLQDRAVPSQHSNSSHCDNPEDHAAPSSAAPVATDLELATPRGSSSKDSSIALCKHVKDAEGSIQLMPKKVDDLNLKPHFSVQPYTCFRSSLNRDQTSPSALHSAASGGASAFGQWQRPSPLPAQSYDLSNYKLLMERLFKAVGRQEEALSAICASIERCRSMERRRGANKKNDIWFSFYGPDSIAKRRVGEALAELMHGGSENLIYLDLSLHDWGNPNFRGKRATDCIAEELRKKRHSVIFLDNIDRADCLVQESLIHAMETGRYKDLHGGRVADLNNSIVVLSTRMIQGCQDASLGMEEDNAFSEEKVVAARGHQLKIIVEPGTANIGEDPGGKVVVSSRHSLRNSQASLFSSSLSKRKLHISDGQEKTAESPSTSKRLHRRSSVPFDLNLPGDEAEAHDGDDDSSSSHENSSGDPEGSVGNLLRSVDESINFKPFDFGKLCEDILQEFSSTMSKTLGSRCRLEIDAVAMEQVVAAAWASDSHEKRPVRTWVEQVFARTLEQLKVRCKNLSSSTLRLVACEDEMPVKEDAFGAFLPSTIILDW

SEQ ID NO: 4102 - protein, 1120 aa, Zea mays
MPTPVPAARQCLSPPAVTALDAAVASARRRAHAQTTSLHLIASLLAPTAAPLLRDALARARSAAYSPRLQLKALDLCFAVSLDRLPSTPTSASTPTSHEPPVANSLMAAIKRSQANQRRNPDTFHFYHHQAAPTSPNAIKVDLSHLVLAILDDPLVSRVFADAGFRSNEIKVAILRPAPPVPLLGRLPTRARPPPLFLCSFAAADDADVPSPAPALAGAAPGEDNCRRITDILARGRNPMLVGVGAASAAADFAKASPYRIVPIGPASANNQAAPTTPTSGLIFSIGDLKDLVPDEADLQDAARRVVAEVTRLLETHRPAARQTQTVWVMGWSATYETYLAFLSKFPLVDKDWELQLLPITAVRDAGPAAGLVPPPPAPATTVAALSMPATTSFAESFVPFGGLLCDTYEANSLTTNFCPQALRCQHCNDRYEQEVASIIRGSGVTADAHQEGLPSLLQNGGMMGSNNEFDAVKVRDDQMVLSTKILNLEKKWNEYCVRLHQGCNRINRDPCQLFPHHIGVRVDRERCANPNQSAQTIALQRDIIKPCALSSPYTNITAKSISAPDQINADLVLNLQVRQSRSNEPLQSGVVPFQHINSSNYNKPEESSAAPVTTDLVLATPRGSSFKDSSSALCKRVEDIEETIQLMPNKVDDLNLKPPHLSIQPYTCSKSSSSNWEQTSPSALHSTSLGGTSAFGQWQRPSPLATQSFDLSNYKLLMEHLFKVVGRQEEALSAICASIVRCRSMERRRGANKKNDIWFSFYGPDSIAKRRVGVALAELMHGSSGNLIYLDLSLNDWGNPSFRGKRATDCIFEELRKKRRSVIFLDNIDKADCLVQESLIHAMETGRYKDLHGGRVTDLNDSIVVLSTRMIQGCQDASLGVEEGNAFSEEKAVAARGHQLKIIVEPGTTNIGGGNVVVSSRHSLGSSEASSYSSKRKLHISDGQEKTEESASTSKRLHRTSSIPFDLNLPGDDEEAHDDGDDDKSSGSHENYLEGSVGNLLRWVDGSINFKPFDFGKLCEDILQEFSNTTSKILGTRGCRLEIDAGAMEQVVAAAWASDSHENEKRPVRTWVEQVFGRSLEQVKMRCENLSSCTLRLVSCEVKEDGFGALLPSRIILDW

SEQ ID NO: 4103 - protein, 1135 aa, Zea mays
MPTPVPAARQCLSPPAVTALDAAVASARRRAHAQTTSLHLIASLLAPTAAPLLRDALARARSAAYSPRLQLKALDLCFAVSLDRLPSTPTSASTPTSVSASASASTSNDPQQHEPPVANSLMAAIKRSQANQRRNPDTFHFYHHQAAPTSPNAIKVDLSHLVLAILDDPLVSRVFADAGFRSNEIKVAILRPAPPVPLLGRLPTRARPPPLFLCSFAAADDADVPSPAPALAGAAPGEDNCRRITDILARGRNPMLVGVGAASAAADFAKASPYRIVPIGPASANNQAAPTTPTSGLIFSIGDLKDLVPDEADLQDAARRVVAEVTRLLETHRPAARQTQTVWVMGWSATYETYLAFLSKFPLVDKDWELQLLPITAVRDAGPAAGLVPPPPAPATTVAALSMPATTSFAESFVPFGGLLCDTYEANSLTTNFCPQALRCQHCNDRYEQEVASIIRGSGVTADAHQEGLPSLLQNGGMMGSNNEFDAVKVRDDQMVLSTKILNLEKKWNEYCVRLHQGCNRINRDPCQLFPHHIGVRVDRERCANPNQSAQTIALQRDIIKPCALSSPYTNITAKSISAPDQINADLVLNLQVRQSRSNEPLQSGVVPFQHINSSNYNKPEESSAAPVTTDLVLATPRGSSFKDSSSALCKRVEDIEETIQLMPNKVDDLNLKPPHLSIQPYTCSKSSSSNWEQTSPSALHSTSLGGTSAFGQWQRPSPLATQSFDLSNYKLLMEHLFKVVGRQEEALSAICASIVRCRSMERRRGANKKNDIWFSFYGPDSIAKRRVGVALAELMHGSSGNLIYLDLSLNDWGNPSFRGKRATDCIFEELRKKRRSVIFLDNIDKADCLVQESLIHAMETGRYKDLHGGRVTDLNDSIVVLSTRMIQGCQDASLGVEEGNAFSEEKAVAARGHQLKIIVEPGTTNIGGGNVVVSSRHSLGSSEASSYSSKRKLHISDGQEKTEESASTSKRLHRTSSIPFDLNLPGDDEEAHDDGDDDKSSGSHENYLEGSVGNLLRWVDGSINFKPFDFGKLCEDILQEFSNTTSKILGTRGCRLEIDAGAMEQVVAAAWASDSHENEKRPVRTWVEQVFGRSLEQVKMRCENLSSCTLRLVSCEVKEDGFGALLPSRIILDW

SEQ ID NO: 4104 - protein, 479 aa, Zea mays
MRESPSTQGGPSTSSAVDDSYSADGVEDSQLFLSVPALNQAASYLAQTASFLTQCLPVPGFVGLSEEGQELLTLPPASASGRLSVQTSSVEPSGTNSSLGQSDCGGNPSQENAGQMVPSHVFQNGASLFQGLVERARKTVRGSADDIGWLQRDQSLPTTEDGTARFLEILDSVRKNEHKLSDSLVYLLVPGLFSNHGPLYFVKTKAYFSKMGLACHIAKIHSESSVSKNAREIKEYIEEIYWGSRKRVLLLGHSKGGVDAAAALSLYWPQLKDKVAGLALAQSPYGGSPVASDILREGQLGDYVRLRKIMEILVSKVLKGDLQALEDLTYERRKEFLRRHPLPQDVPIVSFHTEASITPSVLTALSHVAHLELPIAGDGNSTRIPVVMPLSAAMAACSQLLVARYGEKSDGLVTRKDAEVPGSVAVRPERKLDHAWMVYSSLKEESGDQADTSQVCEALLTLLVEVAQKRRHEMAMKDE

SEQ ID NO: 4105 - protein, 479 aa, Zea mays
MRESPSTQGGPSTSSAVDDSYSADGVEDSQLFLSVPALNQAASYLAQTASFLTQCLPVPGFVGLSEEGQELLTLPPASASGRLSVQTSSVEPSGTNSSLGQSDCGGNPSQENAGQMVPSHVFQNGASLFQGLVERARKTVRGSADDIGWLQRDQSLPTTEDGTARFLEILDSVRKNEHKLSDSLVYLLVPGLFSNHGPLYFVKTKAYFSKMGLACHIAKIHSESSVSKNAREIKEYIEEIYWGSRKRVLLLGHSKGGVDAAAALSLYWPQLKDKVAGLALAQSPYGGSPVASDILREGQLGDYVRLRKIMEILVSKVLKGDLQALEDLTYERRKEFLRRHPLPQDVPIVSFHTEASITPSVLTALSHVAHLELPIAGDGNSTRIPVVMPLSAAMAACSQLLVARYGEKSDGLVTRKDAEVPGSVAVRPERKLDYAWMVYSSLKEESGDQADTSQVCEALLTLLVEVAQKRRHEMAMKDE

SEQ ID NO: 4106 - protein, 480 aa, Pennisetum glaucum
MKDPLPSTQGEPSTSATVDDSCSDDRVGDSQLFLSVPALNQAASYLAQTASFLTQCLPVPSYVGLPEEGQELVTLPSASAVDRLSVQTSSVESAGTNSSLGQADCSGSPSQESTGQMVPSQVFQNGASLFQGLVERARKTVRGSADDIGWLQRDQSLPTTEDGTGRFLEILDSVRKNEHKLPDSVVYLLVPGLFSNHGPLYFVKTKAHFSKMGLACHIAKIHSESSVSKNAREIKEYIEEIYWGSRKRVLLLGHSKGGVDSAAALSLYWAQLKDKVAGLVLAQSPYGGSPVASDILREGQLGDYVRLRKIMEVLVSKVLKGDVQALEDLTYERRKEFLRQHPLPQEIPVVSFHTEASITPSVLTTLSHVAHLELPIAAAGNSTRIPVVMPLSAAMAACSQLLVVRYGEKSDGLVTRKDAEVPGSVVVRPERKLDHAWMVYSSLREEPGDQADTSQVCEALLTLLVEVAQKRRHEMAMKDE

SEQ ID NO: 4107 - protein, 480 aa, Pennisetum glaucum
MKDPLPSTQGEPSTSATVDDSCSDDRVGDSQLFLSVPALNQAASYLAQTASFLTQCLPVPSYVGLPEEGQELVTLPSASAVDRLSVQTSSVESAGTNSSLGQADCSGSPSQESTGQMVPSQVFQNGASLFQGLVERARKTVRGSADDIGWLQRDQSLPTTEDGTGRFLEILDSVRKNEHKLPDSVVYLLVPGLFSNHGPLYFVKTKAHFSKIGLACHIAKIHSESSVSKNAREIKEYIEEIYWGSRKRVLLLGHSKGGVDSAAALSLYWAQLKDKVAGLVLAQSPYGGSPVASDILREGQLGDYVRLRKIMEVLVSKVLKGDVQALEDLTYERRKEFLRQHPLPQEIPVVSFHTEASITPSVLTTLSHVAHLELPIAAAGNSTRIPVVMPLSAAMAACSQLLVVRYGEKSDGLVTRKDAEVPGSVVVRPERKLDHAWMVYSSLREEPGDQADTSQVCEALLTLLVEVAQKRRHEMAMKDE

SEQ ID NO: 4108 - protein, 358 aa, Setaria italica
MVPSHVFQNGASLFQGLVERARKTVRGSADDIGWLQRDQSLPTTEDGTARFLEILDSVRKNEHKLPDSVVYLLVPGLFSNHGPLYFVKTKAYFSKMGLACHIAKIHSESSVSKNAREIIYWGSRKRVLLLGHSKGGVDSAAALSLYWPQLKDKVAGLVLAQSPYGGSPVASDILREGQLGDYVRLRKIMEVLVSKVLKGDVQALEDLTYERRKEFLRQHPLPQEVPIVSFHTAASITPSVLTALSHVAHLELPIAADGNSTRIPVVMPLSAAMAACSQLLVARYGEKSDGLVTRKDAEVPGSVVVRPERKLDHAWMVYSSLKEEPGDQADTSQVCEALLTLLVEVAQKRRHEVAMKDE

SEQ ID NO: 4109 - protein, 654 aa, Oryza sativa
MRTLEEMLALHKFGGVGKETGMKLMNHYEKYAIFMMLSKITSFEEGAILCNFLPLIREHLPSAAEEIESDIISLAQSEDSDVYDIYTVKEVDDDTTMEGTSSAPYPLLQVDNGDDVCYDDDDPYDTDDSNAEDNPLYDYPAELSEDEDDDSNSENPFSDLDGSDPEYEKEEDKEPTMEDLPSNLGQPSTSASSVDASYSANRIEDSQLFLSVPALNQAASYLAQTASYLTQCLPVSGYTAISDEGQELATLPPASTAGGSSFQASSEQSADSSPGEIDNTGSSSQEITEQMAPLRVFQNGASLFQGLVERARKTVRGSADDIGWLQQDQSLPPTEDGTARFLEILDAVRKNEHKLPDSMVYLLVPGLFSNHGPLYFVKTKSYFSKMGLACHIAKIHSESSVSKNAREIKEYIEEIYWGSKKRVLLLGHSKGGVDAAAALSLYWPQLKDKVAGLALAQSPYGGSPVASDILREGQLGDYVRLRKLMEILVSKVLKGDLQALEDLTYERRKEFLRQNPLPPEVPIVSFHTEASITPSVLTALSHVAHLELPAAADGNPTRIPVVMPLSAAMAACSQLLVARYGEKSDGLVTRKDAEVPGSVVVRPERKLDHAWMVYSSLKEEPRDQADTSQVCEALLTLLVEVAQKRRHEMAMKDE

SEQ ID NO: 4110 - protein, 484 aa, Oryza sativa
MDKEPTMEDLPSTLGQPSTSASSVDARYSADRTEDSQLFLSVPALNQAASYLAQTASYLTQCLPVSGYTAISEEGQELATLPPASTVGGSSFQASSEQSADSSPGEIDNTGSSSQEITEQMAPLRVFQNGASLFQGLVERARKTVRGSANDIGWLQQDQSLPPTEDGTARFLEILDAVRKNEHKLPDSMVYLLVPGLFSNHGPLYFVKTKSYFSKMGLACHIAKIHSESSVSKNAREIKEYIEEIYWGSKKRVLLLGHSKGGVDAAAALSLYWPQLKDKVAGLALAQSPYGGSPVASDILREGQLGDYVRLRKLMEILVSKVLKGDLQALEDLTYERRKEFLRQNPLPPEVPIVSFHTEASITPSVLTALSHVAHLELPAAADGNPTRIPVVMPLSAAMAACSQLLVARYGEKSDGLVTRKDAEVPGSVVVRPERKLDHAWMVYSSLNEEPRDQADTSQVCEALLTLLVEVAQKRRHEMAMKDE

SEQ ID NO: 4111 - protein, 476 aa, Triticum aestivum
MEPSAQGEPSTSASVDDSQSVDRAEDSELFPSVPALNQAASNLAQIASYFTQCLPVPGYTGIPEEGQELAILPPVSTSGRPALQTSSAELDGSSLSPSVISSSQETSEISGQMAPFRVFQNGASLFQGLVDRARKTVRGSADDIGWLQRTQGLPAAEDGTTRFLEILDSVRKNEHKLPDAVVYLLVPGLFSNHGPLYFVKTKAYFSKMGLVCHIAKIHSESSVSKNAREIKEYIEEIYWGSRKRVLLLGHSKGGVDAAAALSLYWPQLKDKVAGLVLAQSPYGGSPVASDILREGQLGDYVMLRKLMEILVSKVLKGDLQALEDLTYERRKEFVAQHPLPPEVPIVSFHTEASITPSVLTALSHVAHVELPVAADGNPARIPVVMPLSAALAACSQLLVARYSEKSDGLVTRKDAEVPGSVAVRPERKLDHAWMVYSSMNEEPGDQANTSQVCEALLTLLVEVAQKRRHQTAMKDE

SEQ ID NO: 4112 - protein, 476 aa, Triticum aestivum
MEPSAQGEPSTSASVDDSQSVYRAEDSELFPSVPALNQAASNLAQIASYFTQCLPVPGYTGIPEEGQELAILPPVSTSGRPALQTSSAELDGSSLSPSVISSSQETSEISGQMAPFRVFQNGASLFQGLVDRARKTVRGSADDIGWLQRTQGLPAAEDGTTRFLEILDSVRKNEHKLPDAVVYLLVPGLFSNHGPLYFVKTKAYFSKMGLVCHIAKIHSESSVSKNAREIKEYIEEIYWGSRKRVLLLGHSKGGVDAAAALSLYWPQLKDKVAGLVLAQSPYGGSPVASDILREGQLGDYVMLRKLMEILVSKVLKGDLQALEDLTYERRKEFVAQHPLPPEVPIVSFHTEASITPSVLTALSHVAHVELPVAADGNPARIPVVMPLSAALAACSQLLVARYSEKSDGLVTRKDAEVPGSVAVRPERKLDHAWMVYSSMNEEPGDQANTSQVCEALLTLLVEVAQKRRHQTAMKDE

SEQ ID NO: 4113 - protein, 490 aa, Brachypodium distachyon
MPEPSSASTSASASADDSVDRVEDSQLFSPVPAINQAASNLANLASYFTQCLPVPGGYTGIPEEGQELAILAPVSTTGRPALQASSSSSSSSSSSSSSSSEFDASSSLSHSEIDLTVSSSQENSGQMSPFRVFQNGASMFQGLVERARKTVRGSADDIGWLQRVQSLPPTEDGTARFLEILDSVRNKEHKLPDSLVYLLIPGLFSNHGPLYFVKTKAYFSKMGLVCHIAKIHSESSVSKNAREIKDYIEEIYWGSRKRVLLLGHSKGGVDAAAALSLYWPQLKDKVAGLALAQSPYGGSPVASDILRDGQLGDYVMLRKLMEILVSKVLKGDLQALEDLTYERRKEFLSRHPLPPEVPIVSFHTEASITPSVLTALSHVAHVELPIAGDGNPARIPVVMPLSAAMAACSQLLVARYGEKSDGLVTRKDAEVPGSLAVRPERKLDHAWMVYSSMREEAGDEADTSQVCEALLSLLVEVAQKRRHEMAMKDE

SEQ ID NO: 4114 - protein, 525 aa, Zea mays
MAKGDDALARKRNRVRRKRLRSSENAVSARVAAIIASKHRRKSGKRRACEGMCFSLPTPDDPFNERHGRKHKLDDEPADDTAADAAEDSGNPKKKGANTKKQQPVAKYGAEAKSKAVRERETGAEVVRGDFDRPSKFLVVCLNAIRDAVAPEEGGGSIHGAGDWGVELWRCCSAQAPSDVLDASGACATVAQTAWLVSTACDIVARKERHGMVVSCPFLLYLVSSQDKAAQVRSICKPLKPLGIHSVSLHPGASIEHQISGLKTCEPEFLIATPERLLELVSLKAIDISGVSMLVIDGLKCFVDHNVSDKIFSIRDAISNNLQITIFTDPSDKNIATMAKNLLRGRITKLSINDSVSSRSAFIAQHVHFCPSEELKTTKVKEILEQILQDHPKKTSKVLLVAASDKKARLMSLSLKLENCTVIDDSCGNSFTICSSVGLMNVIVKDRENMSVTDVEAFETVLVVDLPPSVDEYIEILTGAALHVIGGEVHSIFCNTDASVAKPLAQLLADCGQVVPEFLKSLKSS

SEQ ID NO: 4115 - protein, 740 aa, Zea mays
MEQISLGNRYKECRTQRTTSCQTKILVGKDVLNEIEQRRSSPSVIAKLMGIEVLPPSKVVNSRHQEFKDVFEVSEEPPEAVAKEKSQGLPSLKRRALSLKKLMPSKTLYRDDTHDCYVDCVAGLGRLNSVEINNPLFEKHLHDMNYSANYQYVKDTSSVCRTYPVGLANSSLSNFSLLSRGKNKDFNSIVVLEPPCLEKGHDPENIFSIPYLSPVNKNCSRGMKHKKFEFPVMENGRVREHILGTEANNVLRIRKERPLTSDSIDPLQIGQEASVHQFGNTDVSCSGSSQRYSCGNDSFRKTNRSSSSRICRHAESAVGSKTLAEMFALSDSERLKLNSDSNAPVLCNMIDRDNGHSKDGCFIVLPKHAPVLSIRSSMDMPSCLEGSSQGKNNLNISNIYNNGKFQIDSSRDKPRSLKQIGSGTEAHLSSAHCFQNLTGDNFSTPDCLNDKVLLTTDEDVVRQSAESEPSRFNLQVSRKQRVTVLPFHCHEDESISVSDHTDGTKFCKGSKEVEQPSPVSILEPPINEDICFPRCFNYDLQGMANKQRGCHQYHNESEVNMSSDDEDHSFYQSLEAFQVEENWDFSYLLDILICSGIIVVDWQLICKSWYLPGYPVGPHVFDRLERKYNKIATWAKPERRLLFDLVNSILSEVLAPCVDVHPWVQPSRHCVAFWGPEGPVEKVWQTIVRLQEDCVTRHPDEMVLDTNWLEVGTDINMVGKQIARMLHGDLLEEVIVDFLG

SEQ ID NO: 4116 - protein, 341 aa, Zea mays
MGRAAGLARDGVTTAGRATTTRVMRAAVSAFFAGYHRFTSVAALLALPFSAAVLASEAMAPSSWALRAVAARLRSVFAAAGFPPSPFFALLEAKLSQTVFTFAATLPFALTFLLLAKACVAAMLRLRDDDASESPPPRRRRVAVAALPPCAAVARAYPAVVATHLLNAFLMLSANAAVFSLLLLAFGAADLLGLTSHVWTLALSAAGAIVYSLVVGVATVVCNLAIVVAATEPGCAGHAAVLRACVAIRGRVSTALALALPTNLGMAAAEALFGLRVVAQRRRDGRLAPGVAGEAFSIAYIHAICVVLEIIVTCMFYRSCKRSEADELRELEPEEKGDLQA

SEQ ID NO: 4117 - protein, 337 aa, Panicum virgatum
  misc_feature (130)..(130): Xaa can be any naturally occurring amino acid
MRRAGMARGARGHGAAGRAGRVMRAAVSEFFGGYHCFTSVAALLALPFSAAVLASEAVAPSSATLRGAAARLRSVVAAAGFPPSPFFALLEAKLAQTVFTFAATLPFALTFLLLAKACVAAMLRDDDAAXPPRRQRRLRLAALPPCGAVARAYPAVVATHLLNAFLMLTANAAVFSLLLLAFGAADLLGLTSHLWTLALSAAGAIVYSLAIGVATVVCNLAVIVAATEPGCAGHAAVLRACVAIRGRVSTALALALPTNLGMAAAEALFGLRVVAQRRRAGRLAPGVAGEAFSIAYIHAICVVLEIIVSCMFYRSCKRSEADELRELEPEEKGDLQA

SEQ ID NO: 4118 - protein, 340 aa, Zea mays
MRRAGGLSRAGHGAAPAAGVMRAAASAFFAGYHCFTSVAALLALPFSAAVLVAEAAAAAPAPAPVALRALAARLRAVFAAAGFPPSPFFALLEAKLSQTVFTFAAALPFALTFLLLAKACVAAMLRDDAASPRRHRRRRWPGVAALPACGAVARAYPAVLATHVLGAFLMLSANAAAFSLLLLAFGAADLLGLTSRAWTLALSAAGAVAYSLAVGVAAVVCNLAVVVAATEPGCAGHAAVLRACVAIRGRVSTALALALPTNLGMAAAEALFGLRVVAQRRRDGRLAPAVAAEAFSIAYIHAVCVVLEIIVACVFYRSCKRSEADELRELEPEEKGDLQA

SEQ ID NO: 4119 - protein, 402 aa, Zea mays
MAAGSSAVWAAQHPACSGGKFHHLSPSHSHCRPRRALQTPPALPARRSGASPPRASLAAAAPAVAVRTASEEAVYEVVLRQAALVEAATPQRRRTRQPRWAEEEEEERVLGWGLLGDAYDRCGEVCAEYAKTFYLGTQLMTPERRKAVWAIYVWCRRTDELVDGPNASYITPTALDRWEKRLEDLFEGRPYDMYDAALSDTVSKFPVDIQPFKDMVQGMRLDLWKSRYMTFDELYLYCYYVAGTVGLMTVPVMGIAPDSKASTESVYNAALALGIANQLTNILRDVGEDARRGRIYLPLDELAQAGLTEEDIFRGKVTGKWRRFMKGQIQRARLFFDEAEKGVTHLDSASRWPVLASLWLYRQILDAIEANDYNNFTKRAYVGKAKKLLSLPLAYARAAVAP

SEQ ID NO: 4120 - protein, 408 aa, Panicum virgatum
MAVWAAHHASCRPHQPSSSSSSQRPRRGARLLPLPLPLPTRRGGASLARPRASLAAAAPVARTASEEAVYEVVLRQAALVEGAVASKGAAAAAGRRRQQQQQRPRWAEEKEDEGLRGWGLLGDAYDRCGEVCAEYAKTFYLGTQLMTPERRKAVWAIYVWCRRTDELVDGPNASYITPTALDRWEKRLEDLFEGRPYDMYDAALADTVSKFPVDIQPFKDMIEGMRLDLWKSRYRTFDELYLYCYYVAGTVGLMTVPVMGIAPDSKASTESVYNAALALGIANQLTNILRDVGEDARRGRIYLPLDELAQAGLNEDDIFRGKVTDKWRRFMKGQIQRARLFFDEAEKGVAHLDSASRWPVLASLWLYRQILDAIEANDYNNFTKRAYVGKAKKLLSLPAAYARAAVGS

SEQ ID NO: 4121 - protein, 390 aa, Avena sativa
MAGSSAVYTPCRPSAHGRHRALRPVGLLPAPGRVGLLPARTRARASLVATAPARTATEEAVYEVVLRQAALVEELQGKKRTRDAGTRRWREEEQEAELGWGLLGDAYDRCGEVCAEYAKTFYLGTQLMTPERRKAVWAIYVWCRRTDELVDGPNSSYITPKALDRWEKRLEDLFEGRPYDMYDAALSDTVTKFPIDIQPFKDMIEGMRLDLWKSRYRTFDELYLYCYYVAGTVGLMTVPVMGIAPDSKASAESVYNAALALGIANQLTNILRDVGEDSRRGRIYLPLDELAQAGLTEEDIFRGKVTDKWRRFMKGQIQRARLFFDEAEEGVMSLDSASRWPVLASLWLYRQILDAIEANDYNNFTKRAYVGKAKKFLSLPAAYARAAISS

SEQ ID NO: 4122 - protein, 394 aa, Brachypodium distachyon
MAGSSAVYTPCRPHHAHGHQQRRWRRSALAHGLLPTATTGRRGVLARASLAAAAAAGRTAAEEAVYEVVLRQAALQGSGTREAAAGKGRRRWREEEVDDAELGWGLLGDAYERCGEVCAEYAKTFYLGTQLMTPERRKAVWAIYVWCRRTDELVDGPNSSYITPKALDRWEKRLEDLFEGRPYDMYDAALSDTASKFPIDIQPFRDMIEGMRLDLWKSRYKSFDELYLYCYYVAGTVGLMTVPVMGIAPDSKASAETVYNAALALGIANQLTNILRDVGEDARRGRIYLPLDELAQAGLTEEDIFRGKVTDKWRRFMKGQIQRARLFFDEAEEGVMHLDSASRWPVLASLWLYRQILDAIEANDYNNFTKRAYVGKAKKLLSLPVAYARAAVSS

SEQ ID NO: 4123 - protein, 398 aa, Oryza sativa
MASSSSAAALWTAAPHPHGSCIRIHAIFHQRHQRRGRRPVVVASSVRPLQAASLAVATAPVAVASRRTAAEEAVYEVVLRQAALVEEATHRRGAGAPRWAEEDAVDWGLLLGDAYHRCGEVCAEYAKTFYLGTQLMTPERRKAVWAIYVWCRRTDELVDGPNSSYITPKALDRWEKRLEDLFEGRPYDMYDAALSDTVSKFPVDIQPFKDMIEGMRLDLWKSRYRSFDELYLYCYYVAGTVGLMTVPVMGIAPDSKASTESVYNAALALGIANQLTNILRDVGEDSRRGRIYLPLDELAEAGLTEEDIFRGKVTDKWRKFMKGQILRARLFFDEAEKGVAHLDSASRWPVLASLWLYRQILDAIEANDYNNFTKRAYVNKAKKLLSLPVAYARAAVAS

SEQ ID NO: 4124 - protein, 394 aa, Hordeum vulgare
MAGSSAVYASCRPHARAGFFHPHPADQAQRGGLLLPAAASAWRRGGAGAPRASLVAARTATEEAVYEVVLRQAALVGDLQGRRREARRWRDEQMEQEGDAELGWGLLGDAYDRCGEVCAEYAKTFYLGTQLMTPERRKAVWAIYVWCRRTDELVDGPNASYITPKALDRWEKRLEDLFEGRPYDMYDAALSDTASKFPIDIQPFRDMIEGMRLDLWKSRYRTFDELYLYCYYVAGTVGLMTVPVMGIAPDSKASAESVYNAALALGIANQLTNILRDVGEDSRRGRIYLPLDELAQAGLTEEDIFRGKVTDKWRRFMKGQIQRARLFFDEAEKGVMHLDSASRWPVLASLWLYRQILDAIEANDYNNFTKRAYVGKAKKFLSLPAAYARAALSP

SEQ ID NO: 4125 - protein, 397 aa, Triticum aestivum
MAGSSAVYTSCRPHARAFHHHPADQAQRGGGLPGLLPAAAWRRGGAAVPRASLVAARTATEEAVYEVVLRQAALVEDLQGRREADAGRRRRWRDEQVEQEGDAELGWGLLDDAYDRCGEVCAEYAKTFYLGTQLMTPERRKAVWAIYVWCRRTDELVDGPNSSYITPKALDRWEKRLEDLFEGRPYDMYDAALSDTASKFPIDIQPFRDMIEGMRLDLWKSRYMTFDELYLYCYYVAGTVGLMTVPVMGIAPDSKASAESVYNAALALGIANQLTNILRDVGEDSRRGRIYLPLDELAQAGLTEEDIFRGKVTDKWRRFMKGQIQRARLFFDEAEKGVMHLDSASRWPVLASLWLYRQILDAIEANDYNNFTKRAYVGKAKKFLSLPAAYARAALSP

SEQ ID NO: 4126 - protein, 405 aa, Triticum aestivum
ASERRAQPMAGSSAVYTSCRPHARAFHHHPADQAQRGGGQPGLLPAAAWRRGGAAVPRASLVAARTATEEAVYEVVLRQAALVEDLQGRREADAGRRRRWRDEQVEQEGDAELGWGLLDDAYDRCGEVCAEYAKTFYLGTQLMTPERRKAVWAIYVWCRRTDELVDGPNSSYITPKALDRWEKRLEDLFEGRPYDMYDAALSDTASKFPIDIQPFRDMIEGMRLDLWKSRYRTFDELYLYCYYVAGTVGLMTVPVMGIAPDSKASAESVYNAALALGIANQLTNILRDVGEDSRRGRIYLPLDELAQAGLTEEDIFRGKVTDKWRRFMKGQIQRARLFFDEAEKGVMHLDSASRWPVLASLWLYRQILDAIEANDYNNFTKRAYVGKAKKFLSLPAAYARAALSP

SEQ ID NO: 4127 - protein, 399 aa, Leymus cinereus x Leymus triticoides
  misc_feature (32)..(32): Xaa can be any naturally occurring amino acid
MAGSSAVYTSCRPHARAFLHPVDQTQRGGQLXLLPAATTAAAWRRGGAAPRASLVAARTATEEAVYEVVLRQAALVEDLQGRRAREAEAGRRRWRDEQQEQEGDAELGWGLLGDAYDRCGEVCAEYAKTFYLGTQLMTPERRKAVWAIYVWCRRTDELVDGPNSSYITPKALDRWEKRLEDLFEGRPYDMYDAALSDTASKFPIDIQPFRDMIEGMRLDLWKSRYRTFDELYLYCYYVAGTVGLMTVPVMGIAPDSKASAERVYNAALALGIANQLTNILRDVGEDSRRGRIYLPLDELAQAGLTEEDIFRGKVTDKWRRFMKGQIQRARLFFDEAEKGVMHLDSASRWPVLASLWLYRQILDAIEANDYNNFTKRAYVGKAKKFLSLPAAYARAALSS

SEQ ID NO: 4128 - protein, 416 aa, Saccharum officinarum
MDLRRRRLAVAAAVVAVCAATLTPAAEGFDILQILGKHDEFSQFCKLLNETHLAGDINRDRTITVLAVANGDMGHLTGGHYSLGTLRHILELHVVADYYDDKKLKQLSHAATAASTLFQRSGFAPGMAGYVNITQHRGGKVSFIVDDAADTVKPVTYVKQIESHRYDYSVLQVSGVLSSPEAEAPVAPPAPVNLTDILSKKYCKSFAGLLAADPKVFDTLNGTKDTALTIFCPVDAAVAAFMPKFKNLTAKAKTAILLYHAVPDYYSMQFLKSNKGKVTTLATTSVAKKDYTYEAESKEDTVTLDTTVITSTIQATVRDDDPLAVYAVSKFLQPKELFKAKTADLAPAPAPEAGPKKKKKKPSSGSAASAPSDESADGPSADDSTDDAADKAAAAPSSLFARWVTIAMALVLVLAA

SEQ ID NO: 4129 - protein, 413 aa, Setaria italica
MGLRRLAVAAAVLAVCAAAVEGFDILQILGKHDEFSQFCKLLNETHLAGDINRDRTITVLAVANGDMGHLTSAHYSLGTIRHILELHVVADYYDEKKLKQLSHGATAASTLFQRSGFAPGMAGYVNITQHRGGKVTFIVDDAADSVKPVTFVKQIESHRYDYSVLQVSSVLSSPEAEAPVAPPAPVNLTELLSKKYCKSFAGLLAADAKAFDTINGTKDTALTLFCPVDAAVAAFMPKFKNLTAKAKTAILLYHAVPDYYSMQFLKSNKGKVTTLASTSVAKKDYTYEAQTEADTVTLDTTVTTSTIQATVRDDDPLAIYAVSKFLQPKELFKPKKAEDLAPSPAPEVPKKKTKKKPGSTSAAAAPSDDDSADGPAADDSADDAADKAGAAPSMLTRWGTAAAMVAAALALGA

SEQ ID NO: 4130 - protein, 404 aa, Pennisetum glaucum
MGLRRLAVAAAVLAVCAAAVEGFDILQILGKHDEFSQFCKLLNETHLAGDINRDRTITVLAVANGDMGHLTGGHYSLGTIRHILELHVVADYYDEKKLKQLSHGATAASTLFQRSGFAPGMAGYVNITQHRGGKVTFIVDDAADSVKPVTFVKQIESHRYDYSVLQVSSVLSSPEAEAPVAPPTPVNLTELLSKKYCKSFAGLLAADAKVFDTINGTKDTALTLFCPVDAAVAAFMPKFKNLTAKAKTAILLYHAVPDYYSMQFLKSNKGKVTTLASTSAAKKDYTYEAESEADTVTIDTTVTTSTIQATVRDDDPLAIYAISKFLQPKELFKPKKGEDLAPAPAPEGPKKKKTKKKPGSTSAAAAPSDDDSADGPAADDSADDAADKTGAAAPSMLARWSTVA

SEQ ID NO: 4131 - protein, 413 aa, Panicum virgatum
MDLMRPLAVVVALLAVWAAAAEGFDILQILGKQDEFSQFCKLLNETHLAGDINRDRTITVLAVANGDMGHLTSGHYSLGTIRHILELHVVADYYDEKKLKQLSHGATAASTLFQRSGFAPGMAGYVNITQHRGGKVTFIVDDAADSVKPVTFVKQIESHRYDYSVLQVSSVLSSPEAEAPVAPPAPVNLTDLLSKKYCKSFAGLLAADAKAFDTINGTKDTALTLFCPVDAAVAAFLPKFKNLTAKAKTAILLYHAVPDYYSMQFLKSNKGEVTTLATTSVAKKDYTYEAQTEADTVTLDTTVTTSTIQATVRDDDPLAIYAVSKFLQPKELFKSKTKDLAPAPAPEGAKKKTKKKPGSTSTAAAPSGDEAADGPAADDSADDAADKAGAAPSPLVRWVTAVATVAAVLALVA

SEQ ID NO: 4132 - protein, 297 aa, Zea mays
MLLRSASSPLLNCGRAPAAAASVEHLAVVSPLLSPAVAAPRHGPVLCRAMSEGDLAAPLVPKKDDGHGRAPRLSLSASLSSSASIFVEEEDGEGEEEEDLVAVAGAGVDVPLPLRRLLTNTGLDVSAAAALAFVEQGVGGSGGGGKACGSSGGKGGIGDGDGGSNRAATDAHYRQMIEADPGNSLLLVNYARFLKEVAGDAARAQEYCERAILASPGDAEALSLYAGLVWETSRDAGRAEDYYSRAVQAAPDDCYVLGSYAGFLWDAEEDEEENSEPLPPPSLFQGAAQRPSITAAS

SEQ ID NO: 4133 - protein, 375 aa, Zea mays
MADVQGDNEAVLEDDAFPDDGPLDTEEGGGGEPISGGDEEEEEDVDGLASFLESEILSGSSDEDPIDEQRQQKEEGDAAKNKRKQGSGSDGDGCSGSEGEQTKRARREEKRRQAKGKAVAPQIDTGLFSNVPPELFLQIFKFLSSEDLISCALVCRFMNAAASDETLWRRLYCMRWGLASNAKFRECAWKNLYIQRDREDMVEFVRNTPTEFKEYYIQMQAAKRSQAPRPSEVNDDKVMLDKTVADQVSSWKNSRGLTDEAVKGHSCSGNTCSYTQIGDAYICEKTGRVHVCDDACREFVLDQSSGLLLCTISGHCFERWLCPDDEWDADDTDLQQAGVVDEAEPFMGSGRYARAIMLGYNCTDEKELEDALRFC

SEQ ID NO: 4134 - protein, 349 aa, Saccharum officinarum
MADVQGDKEAGLEDDDFPDDGPLDPEEPGEGGEPRSGGDEEEEDDVDGLASFLESEILSGSSDQDPIDQEQRQQEEDGDAAKNKRKQGSGPDGDGCSGSCSEGEQTKRARREEMRRQAKGKAVAPQIDTGMFSNIPPELFLQIFKFLSSEDLISCALVCRFMNAAASDETLWRRLYCMRWGLASNAKFRECAWKNLYIQRDREDMVEFVRNTPTEFKEYYIQMQAAKRSQVPRPSEVNDDKVMLDKTVADQVSSWKNSRGLTDEAVKGHSCSGNTCSYTQIGDAYICEKTGRVHVCDDACREFVLDQSSGLLLCTISGHCFERWLCPDDEWDADDTFQDMQQAGVADEA

SEQ ID NO: 4135 - protein, 349 aa, Saccharum officinarum
  misc_feature (313)..(313): Xaa can be any naturally occurring amino acid
  misc_feature (338)..(338): Xaa can be any naturally occurring amino acid
  misc_feature (346)..(347): Xaa can be any naturally occurring amino acid
MADVQGDKEAGLEDDDFPDDGPLDPEEPGEGGEPRSGGDEEEEDDVDGLASFLESEILSGSSDQDPIDQEQRQQEEDGDAAKNKRKQGSGPDGDGCSGSCSEGEQTKRARREEMRRQAKGKAVAPQIDTGMFSNIPPELFLQIFKFLSSEDLISCALVCRFMNAAASDETLWRRLYCMRWGLASNAKFRECAWKNLYIQRDREDMVEFVRNTPTEFKEYYIQMQAAKRSQVPRPSEVNDDKVMLDKTVADQVSSWKNSRGLTDEAVKGHSCSGNTCSYTQIGDAYICEKTGRVHVCDDACREFVLDQSSGLLXCTISGHCFERWLCPDDEWDADDTFXDMQQAGVXXEA

SEQ ID NO: 4136 - protein, 313 aa, Panicum virgatum
MLSIKEEEEEGDIAKNKRKQDSGSDGDGGNGSGSEEGEQNKRMRREERRRQAKGKAVAPQIDTGMFSSIPPELFLQIFKFLSSEDLISCALVCRFMNAAASDETLWRRLYCMRWGLASNAKFRECAWKNLYIQRDREDMVEFVRNTPTEFREYYIQMQASKRSQAPLPSEVNDDKVILDKTIADQVSTWKSSRGLTDESVKGHSCSGNTCSYTQIGDAYICEKTGRVHVCDDACREFVLDQSSGLLLCTISGHCFERWLCPDDEWDADDTDQQQGGVVDEPEPFMGSGRFARAIMLGYNCTDEKELEQALRFC

SEQ ID NO: 4137 - protein, 381 aa, Setaria italica
MADVQGDEAGLEDDPPPEEGLVDPDEGVEADVGGGGDEDEEDVDGLASFLESEILSGSSAEDPIDKQQQEEGDAVKNKRKQESGSDGDGGNGSGSGSGSSSDGEQNKRARREEKRRQAKGKFVAVAPQIDTGMFSSIPPELFLQIFKFLSSEDLISCALVCRFMNAAASDETLWRRLYCMRWGLASNAKFRERAWKNLYIQRDREDMVEFVRNTPTEFREYYIQMQAAKRSQAPLPSEVNDDKVILDKTVADQVSTWKSSRGLTDESVKGHSCSGNTCSYTQIGDAYICEKTGRVHVCDDACREFVLDQSSGLLLCTISGHCFERWLCPDDEWDADDTDQQQGGVADEPEPFMGSGRFARAIMLGYNCSDEKELEHALRFC

SEQ ID NO: 4138 - protein, 376 aa, Pennisetum glaucum
MANVQGDEAGLEDDLSPEEGPVDPEDGVEADVDGGGDEDEEEDVDGLASFLESEILSGSSAEDTIDKQQEEEEGDAAKNKRKQESGSDGDGGNGSGSDGEQNKRARREERRQAKGKAVAVAPQIDTGMFSSVPPELFLQIFKFLSSEDLISCALVCRFMNAAASDETLWRRLYCMRWGLASNAKFRECAWKNLYIQRDREDMVDFVRDTPTEFREYYIQMQASKRSQAPLPSEVNDDKVILDKTVADQVSTWKSSRGLTDESVKGHSCSGNTCSYTQIGDAYICEKTGRVHVCDDACREFVYDQSSGMLLCTISGHCFERWLCPDDEWDVDDTDQQQGGVADEPEPFMGSGRFARAIMLGYNCSDEKELEHALRFC

SEQ ID NO: 4139 - protein, 243 aa, Hordeum vulgare
PANDATATSCVTGTTSFPVLCLHCPIMDMDYPPRYPGQPSGVCSDDGIPVVDLAVLVNGDAWERAQAIRHLGRACQDWGFFMVTNHGVPETLQSAMMDACRELFSLPPEQKQEHLDAGPMDPVRVGTGFNSAVDGARYWRDYVKMFAHPELHCPAKPESLRGVAAEYAACTRGLLLELTAAISESLGLEGGLIAQRLDLASGLQILVGNHYPPCGGGPGDDGAVGLPAHSDHGLLTLVFPKRG

SEQ ID NO: 4140 - protein, 626 aa, Panicum virgatum
MPLFNRKPFSLLEPPKDLDSKEKVFQIRFTKEIFRDYQEYLKRLNLYRQRVWTCKMSGKSNLTFEEALVSEHNAMEKAQNMPTELMAYVLRMIQYSTLGLHELVNKIYASLLEEVFEGIELHSKKDGSVVPCKILKILYSDGTKMCEVGWLCRDKTLINTSVVKAVDLFYRRAPVSRNTLKLFIRDSTTQTIPWVIHENLAKKYGIPTDPPNDMMHYEGLHKKGRKREENGTIENGRKKMKKDEGHVPIKYPIDDLLVRPDGDDPALSKRPPLATDFRVPRCSVGDLLMVWDFCLSFGRVLNLSPFLLTDMENAICHKESNVLVVEIHASMFHLLIKDKGDYFTVLQNKKRKLKVSLVTWAEYLCDFLEMTKNEELLSNIATIRRGYYGHIDTDIKLKILHELVEEAIKTSAIREILSERADQKQALNATRRESIRKGREEQNLNTEIAMKNEESQTDAVKDGNETIDELARGKEEKEKSNVSRSKTEGKRHLVRHVEMEFDKLSIRSSPLGKDRHYNRYWFFRREGRLFVESADSREWGYYSSKEELDALMGSLNVKGIRERALKRQLEKFYNKISNALEKRTKDIVNKMLLEEGVLRRSTRVRAQPKDNPSMAFLKYVNKWKDN

SEQ ID NO: 4141 - protein, 451 aa, Triticum aestivum
  misc_feature (24)..(24): Xaa can be any naturally occurring amino acid
  misc_feature (389)..(389): Xaa can be any naturally occurring amino acid
MKSVAAIIGGAVGGFIVLLAACFXVCIICKRKNKKKKKKKTSKDPGGKSEDGHWTPLTEYSGSRSAMSGNTATTGSTLPSNLCRHFTFADLQTATKNFDQAFLLGKGGFGNVYLGEIDSGTKVAIKRCNPMSEQGVHEFQTEIEMLSKLRHRHLVSLIGYCEDKSEMILVYDYMAHGTLREHLYNTKNPPLSWKKRLEICIGAARGLYYLHTGVKHTIIHRDVKTTNILLDDKWVAKVSDFGLSKTGPNMDATHVSTVVKGSFGYLDPEYFRRQQLSEKSDVYSFGVVLFEVLCARPALSPSLPKEQISLADWALRCQKQGVLGQVIDPVLQGKIAPQCFLKFTDTAEKCVADRSVDRPSMGDVLWNLEFALQLQESEEDTGSLTEGTXSSSGASPLVMTRLQSDEPSTDASTTTTSTTTMSMTGRSIASMDSDGLTPSAVFSQIMHPDGR

SEQ ID NO: 4142 - protein, 522 aa, Triticum aestivum
MLSWLLVSVRWTCGLHSTLIFQADPEYFDAILNGLEVFKLQNYGSPNNLSGLNPPLPQKPADASPSAASGKMKSVAAIIGGAVGGFIVLLAACFDVCIICKRKNKKKKKKKTSKDPGGKSEDGHWTPLTEYSGSRSAMSGNTATTGSTLPSNLCRHFTFADLQTATKNFDQAFLLGKGGFGNVYLGEIDSGTKVAIKRCNPMSEQGVHEFQTEIEMLSKLRHRHLVSLIGYCEDKSEMILVYDYMAHGTLREHLYNTKNPPLSWKQRLEICIGAARGLYYLHTGVKHTIIHRDVKTTNILLDDKWVAKVSDFGLSKTGPNMDATHVSTVVKGSFGYLDPEYFKRQQLTDRSDVYSFGVVLFEVLCARPALSPSLPKEQISLADWALRCQKQGVLGQVIDPALQGKIAPQCFLKFTDTAEKCVADRSVDRPSMGDVLWNLEFALQLQESEEDTGSLTEGTLSSSGASPLVMTRLQSDEPSTDASTTTTSTTTMSMTGRSIASMDSDGLTPSAVFSQIMHPDGR

SEQ ID NO: 4143 - protein, 346 aa, Avena sativa
LGKGGFGNVYLGEIDSGTKVAIKRCNPMSEQGVHEFQTEIEMLSKLRHRHLVSLIGYCEDRSEMILVYDYMAHGTLREHLYNTKNPPLSWKQRLEICIGAARGLYYLHTGVKETIIHRDVKTTNILLDHKWVAKVSDFGLSKTGPNVDNTHVSTVVKGSFGYLDPEYFRRQQLSEKSDVYSFGVVLFEVLCARPALSPSLPKEQVSLADWALRCQKKGILGQIIDPCLQGKIAPQCFIKFAETAEKCVADHSIDRPSMGDVLWNLEFALQLQESDVDSSSSFTEGTLSSGASPLVMTRLQSDEPSTGTTTTTTTTVSITGQSIASVESDGLTPSTIFSQLMHPDGR

SEQ ID NO: 4144 - protein, 878 aa, Brachypodium distachyon
MGFPILLVIILTLLSLILLVVVADNNSTASGHVALNCGASGQNNDDNGRTWDGDTSSKFAPLVKGVTAPASYQHPSLPSTVPFMTARIFTSNYTYSFPVSAGRMFVRLYFYPIAYGNYAVSDAFFSVTTRNLSLLNDFNASQTAQAINVAYLVREFSLNVSSGSLDLTFAPSKHWNGSYAFVNGIEIVPTPDIFTTADTRFVNGGTPAPFQINTDRGFQTMHRLNVGGQAIPPKDDLSFYRSWANDSPYIFGGSGVAFSRDNNLTIKYTSTVPNYTAPIGVYGTARSMGTNAQVNLNYNLTWILPVDAGFFYLLRFHFCEIQYPITKVNQRSFFIYINNQTAQRQMDVIAWSGGIGRTAYTDYVIITTGSGQVDMWVALYPDLSSKPEYYDAILNGLEVFKLQDYGKNNLAGLNPPLPQKPDVNPNGPSREGNSRGTVLAAICGAIGGFAVLLICFGVCIACRRNKKISKDSDKSDDGCWTPLADYSRSRSGNSGNTATTGSHASLPSNLCRHFSFAEVQAATNNFDQAFLLGKGGFGNVYLGEIDSGTKLAIKRCNPMSEQGVHEFQTEIEMLSKLRHRHLVSLIGYCEDKNEMILVYDYMAHGTLREHLYKTKNPPLSWKQRLEICIGAARGLHYLHTGVKQTIIHRDVKTTNILLDDKWVAKVSDFGLSKTGPNVDNTHVSTVVKGSFGYLDPEYFRRQQLSEKSDVYSFGVVLFEVLCARPALSPSLPKEQVNLADWALHCQKKGILGQIIDPLLQGKISPQCFVKFAETAEKCVADHSIDRPSMSDVLWNLEFVLQLQESAEDNSSLTGGMSSSDVSSPLVPTRLQSDEPSTETTTTTTASTMSITQRSIASAESAGLTPSTIFSQLMNPDGR

SEQ ID NO: 4145 - protein, 881 aa, Oryza sativa
MMHPSLLATIQWLTLSALLSIAMAADNNSTASAPIFLNCGASGVQPDSYNRSWDGDASSKFAPSVKGNVARASYQDPSLPSPVPYMTARFFTSNYTYSFPVSPGRMFVRLHFYPTNYNGNLDSANAYFGVTTNNLILLDNFNASQTALATSSAYFFREFSVNVTSSSLKLTFAPSTRNGSYAFVNGIEIVPTPDIFTTPTPTSANGGDNVQYGIDPVMGLQTMYRLNVGGQPISPQGDSGFYRSWDNDSPYIYGAAYGVTFSKDGNVTIKYPNTEPNYTAPVAVYATARSMGPTAQINLNYNLTWILPVDAGFTYLLRFHFCEIQYPITKVNQRSFFIYINNQTAQNQMDVIVWSGGIGRTTYTNYVVTTVGSGQTDLWVALHPDLSSKPEYFDAILNGLEVFKLQDLGRNNLAGLNPPLPPKPGVNPNGGSSRGKSKSVAPAAIGGAVGGLAVLLIACVGLCIICRRKKKVAKDTGKSDEGRWTPLTDFTKSQSATSGKTTNTGSHSMLPANLCRHFSFAEIQAATNNFDKSFLLGKGGFGNVYLGEIDSGTRVAIKRGNPLSEQGVHEFQNEIEMLSKLRHRHLVSLIGYCEDRNEMILVYDYMAHGTLREHLYNTKNPPLSWKQRLEICIGAARGLYYLHTGAKQTIIHRDVKTTNILLDDKWVAKVSDFGLSKAGPNVDNTHVSTVVKGSFGYLDPEYFRRQQLTEKSDVYSFGVVLFEVLCARNALSPSLPKEQVSLADWALRCQKKGVLGEIIDPLLKGKIAPQCFLKFAETAEKCVADRSVDRPSMGDVLWNLEFALQLQESTEDSSSLTEGTSASTSPLVVARLHSDEPSTDVTTTTTTTTSLSITDRSIASVESDGLTPSNIFSQLMTPDGR

SEQ ID NO: 4146 - protein, 877 aa, Sorghum bicolor
MAHPTLSATLRCLTLLCILALAVAADNNTIGSGQIRLDCGATSPTGPDADGRSWDSDTNSKFAPALKGIAATASYQDSSLPSATPYMTARIFTSNYTYSFPVSPGCMFVRLYFYPTNYVSNHAAADAYFGVTAGNLTLLYDFNASQTAAAVTPVSVAFFVREYYINVTEGSLNLTFSPSTHHNGSYAFINGIEIVPTPDLFTTPKPTLVNGGNMDLAGTGFQTMYRLNVGGQAIPPQGDVDFYRSWGDDSFYIYASDYGVTFGKDNNLTITYTPSVPNYTAPFNVYATARSMGPNAQINLNHNLTWILPVDAGFYYLLRFHFCEIQYPITKVNQRSFFIYINNQTAQQQMDVIAFSGGIGNTVYRDYVTITAGSGQTDLWVALHPDLSTRPEYFDAILNGLEVFKLQNYGNNSLNGLNPPLPSVETNNGKSSGRNKSSVPAIVGGAVGGFAALLIAFIGVCIICRRKEVAKESGKPDDGQWTPLTDYSKSRSNTSGKTTTTGSRTSTLPSNLCRHFSFGEIQAATNNFDQTSLLGKGGFGNVYLGEIDSGTMVAIKRGNPTSEQGVHEFQTEIEMLSKLRHRHLVSLIGYCDDMNEMILVYDYMANGTLREHLYNTKKPALSWKKRLEICIGAARGLHYLHTGAKHTIIHRDVKTTNILLDDKLVAKVSDFGLSKTSPNVDNTHVSTVVKGSFGYLDPEYFRRQQLTEKSDVYSFGVVLFEVLCARPALSPSLPKEQVSLADWALHSQKKGILGQIIDPYLQGKISPQCFMKFAETAEKCVADHSIDRPSMADVLWNLEFALQLQESAEDSSSVTDGTSSNTSPLTILRLHSDEPTTDTTTTTSTSMSMTGRSLASVDSDGLTPSSVFSQLMHPGGR

SEQ ID NO: 4147 - protein, 457 aa, Saccharum officinarum
FEPSNGKPSVRNKDSVPVPAIIGGAVGGFAALLIAFIGVCIICRRKKVAKESGKPDDGQWTPLTDYSKSRSNTSGKTTTTGSRTSTLPSNLCRHFSLGEIQPATNNFDQTSLLGKGGFGNVYLGEIDSGTMVAIKRGNPTSEQGVHEFQTEIEMLSKLRHRHLVSLIGYCDDMNEMILVYDYMANGTLREHLYNTKKPALSWKKRLEICIGAARGLHYLHTGAKHTIIHRDVKTTNILLDDKLVAKVSDFGLSKTGPNVDNTHVSTVVKGSFGYLDPEYFRRQQLTEKSDVYSFGVVMFEVLCARPALSPSLPKEQVSLADWALHCQKKGILGQIIDPHLQVKISPQCFMKFVETAEKCVADHSIDRPSMADVLWNLEFALQLQESAEDSSSVTDGTSSNTSPLIIPRLHSDEPLTDTTTTTSSSTMSMAGRSLASVDSDGLTPSVVFSQLMHPGGR

SEQ ID NO: 4148 - protein, 412 aa, Saccharum officinarum
  misc_feature (298)..(298): Xaa can be any naturally occurring amino acid
FEPSNGKPSVRNKDSVPVPAIIGGAVGGFAALLIAFIGVCIICRRKKVAKESGKPDDGQWTPLTDYSKSRSNTSGKTTTTGSRTSTLPSNLCRHFSLGEIQPATNNFDQTSLLGKGGFGNVYLGEIDSGTMVAIKRGNPTSEQGVHEFQTEIEMLSKLRHRHLVSLIGYCDDMNEMILVYDYMANGTLREHLYNTKKPALSWKKRLEICIGAARGLHYLHTGAKHTIIHRDVKTTNILLDDKLVANVSDFGLSKTGPNVDNTHVSTVVKGSFGYLDPEYFRRQQLTEKSDVYSFGVVXFEVLCARPALSPSLPKEQVSLADWALHCQKKGILGQIIDPHLQVKISPQCFMKFVETAEKCVADHSIDRPSMADVLWNLEFALQLQESAEDSSSVTDGTSFKHIATYHPQASLG

SEQ ID NO: 4149 - protein, 545 aa, Pennisetum glaucum
SIRGHLIYINNQTAQQQMDVIVWSGGFGRTAYTDYVIITPGSGQMDLWVALHPDLSSRPEYFDAILNGLEIFKIQNFGNNSLNGLNRPILSDKHDGKPAKRKSKVAAPAAIVGAVGGFVVLVASIGVCIICRRNKRVAKESVKSDDGHWTPLTDYSKSQSNTSGKITNTGSRASMLPSNLCRHFSFSEIQAATNNFDQTSLLGKGGFGNVYLGEIDSGTKVAIKRGNPMSEQGVHEFQTEIEMLSKLRHRHLVSLIGYCEDMNEMILVYDYMANGTLREHLYNSKKAPLSWKSRLEICIGAARGLHYLHTGAKHTIIHRDVKTTNILLDDKLIAKVSDFGLSKTGPNVDNTHVSTVVKGSFGYLDPEYFRRQQLTEKSDVYSFGVVLFEVLCARPALSPSLPKEQVSLADWALHCQKKGSLGQIIDPNLQGKISPQCFMKFAETAEKCVADHSIDRPYMADVLWNLEFALQLQESAEDNSGLTDGTSSNTSPLILPSHHSGEPWTDTTTTTSTTMSMTGRSLASMESDALTPSSVFSQLMNPGGR

SEQ ID NO: 4150 - protein, 562 aa, Pennisetum glaucum
YLLRFHFCEIQYPITKVNQRSFFIYINNQTAQQQMDVIVWSGGIGRTAYTDYVIITPGSGQMDLWVALHPDLSSRPEYFDAILNGLEIFKIQNFGNNSLNGLNRPILSDKHDGKPAKRKSKVAAPAAIVGAVGGFVVLVASIGVCIICRRNKRVAKESVKSDDGHWTPLTDYSKSQSNTSGKITNTGSRTSMLPSNLCRHFSFSEIQAATNNFDQTSLLGKGGFGNVYLGEIDSGTKVAIKRGNPMSEQGVHEFQTEIEMLSKLRHRHLVSLIGYCEDMNEMILVYDYMANGTLREHLYNSKKAPLSWKSRLEICIGAARGLHYLHTGAKHTIIHRDVKTTNILLDDKLIAKVSDFGLSKTGPNVDNTHVSTVVKGSFGYLDPEYFRRQQLTEKSDVYSFGVVLFEVLCARPALSPSLPKEQVSLADWALHCQKKGSLGQIIDPNLQGKISPQCFMKFAETAEKCVADHSIDRPYMADVLWNLEFALQLQESAEDNSGLTDGTSSNTSPLILPSHHSGEPWTDTTTTTSTTMSMTGRSLASMESDALTPSSVFSQLMNPGGR

SEQ ID NO: 4151 - protein, 383 aa, Panicum virgatum
MSDSVTEEANTDTTVKGSEDVEEKEQDVGSNKDSSVEGLKSVLNFFKSRIPEFKVQVINVDVSEETELAANSSEELAQDDVKSTSENSLEETTAEELEQEEDVSEEDMDEESKSTEVKLFISGVVHNKEDAGAKSYVRVPAEINNMEKDSFELYIPGKGSDQDLAETKAAKQKVADMAAKLASELMPSDVAKALWGTTKSSSKINKEVQELLRLTLSKARVKLTENTIFNRMITDTNSTDPFSGLYVGAFSPYGPEIVQLRRKFGHWNSTDDVEFFEYVEAVKLTGDLSVPAGQITFRAKIGKGKRLENRGAYPEEFGVIASYKGQGRIAQPGFKNPRWVDGELLVLNGKSTIPHLGGAELGFLYSVPEQSFLVLFDRLNLPE

SEQ ID NO: 4152 - protein, 510 aa, Sorghum bicolor
MAELKSSIEDQRYQDASKLTRLAGTSLVGWWVGYAKDTDDSIGRIVRISPGVGRYVAKSYSPRQLVTASSGTPLFEIFLVREDDETYTMKVVHLRPTKGTSGASSISSTITESPVKVENESSSESSAISDSITEEANTDTPVKGNEDAEEKEQDIGSSKDSSVEGLKSVLNFFKSRIPEFKVQVINVDVSEETELAANSSEELVQDDVKSTPESSLEEPTTEELEQEEDVPEEDMDEESKSTEVKLFISGVVHNKEDAGAKSYVRVPAEINNMGKDSFELYIPGKGSDRDLIETKAAKQKVADMAAKLASELMPSDVAKALWGTTKSSSKINKEVQELLRLTLSKARVKLTENTIFNRIIMDTNSTDPFNGLYVGAFSPYGPEIVQLRRKFGHWNSTDDVEFFEYVEAVKLTGDLSVPAGQITFRAKIGKGKRLENRGAYPEEFGVVASYKGQGRIAQPGFKNPRWVDGELLVLSGKSTIPHLGGAELGFLYSVPEQSFLVLFDRLNLPE

SEQ ID NO: 4153 - protein, 627 aa, Zea mays
MSTAATACATRAAARPPLNTAPARRAPPSAVRPPSATPARRAAGCCFCAAASSASSPSTWDWTRWSRHFDEVDQAESYASLLQFQLEEAVENEDFAEAAKLKRDIIEATGNDAVAHVMAELKNAIEEQRYQDASRLTRLAGTSLVGWWVGYAKDTDDSIGRIVRISPGVGRYVAKSYNPRQLVTASSGTPLFEIFLVKEDDETYTMKVVHMRPTKGTSGAPSISSTITESPAKVENENSSESSAISDSVTEEANTDTTVRGNEDAEEKAQDVGSSKDSSVEGLKSVLNFFKSRIPEFKVQVINVDVAEETELAANSSEELVQDDVKSTPESSLEEPATEELEQEEDVPEENTDEESKSTEVKLFISGVVHNKEDAGAKSYVRVPAEINNMEKDSFELYIPGEGSDRDLAETKAAKQKVADMAAKLASELMPSDVAKALWGTAKSSSKINKEVQELLRLTLSKARVKLTENTIFKRIIMDTNSTDPFNGLYVGAFSPYGPEIVQLRRKFGHWNSTDDVEFFEYVEAVKLTGDLSVPAGQITFRAKIGKGKRLENRGAYPEEFGVIASYKGQGRIAQPGFKNPRWVDGELLVLNGKSTIPHLGGAELGFLYSVPEQSFLVLFDRLNLPE

SEQ ID NO: 4154 - protein, 622 aa, Zea mays
MSPACATPAAARPLNTVPTRRSPPSAARPPSAIPARRSAGCCFCASSSSSASSPSTWDWTRWSRHFDEVDQAESYASLLQFQLEEAVENEDFAEAAKLKRDIIAATGNDAVAHVMAELKSAIEEQRYQDASRLTRLAGTSLVGWWVGYAKGIDDSIGRIVRISPGVGRYVAKSYSPRQLVTASSGTPLFEIFLVREDDKTYTMKVVHLRPTKGTLGASSISSAITESPATVETPESSAISDSITEEANIDTPVKGNGDAEEKEQDVGSSKDTSVDGFKSLLNFFKSRIPEFKVQVINVDVSEETELAANSSEESVQDDVKSTPEGSLEEPTTEELEQEEDVPEEDMDEESKSTKVKLFISGVVHNKEDAGTKSYVRVPAEINNMEKDSFDLYIPGNGSGHDLPETKAAKQKVADMAAKLASELMPSDVAKALWGTTKSSSKINKEVQELLRLTLSKARVKLTDDTFFNRIIMDTNSMDPFNGLYVGAFSPYGPEIVQLRRKFGHWNSSDDVEFFEYVEAVKLTGDLSVPAGQITFRAKIGKGKRLENRGAYPEEFGVIASYKGQGRIAQPGFKNPRWVDGELLVLNGKSTIPHLGGAELGFLYSVPEQSFLVLFDRLNLPEC

SEQ ID NO: 4155 - protein, 700 aa, Triticum aestivum
MFIEIMVMYPIQHRAYRPGIDNLLVLLIGGIPIAMPTVLSVTMAMGSHRLSQQGAITKRMTAIEEMAGMDVLGSDKTGTLTLNKLTVDKNLVEVFERGITQDQVILMAARASRTENQDAIDTAIVGMLADPKEARAGIQEVHFLPFNPTDKRTALTYIDADGKMHRVSKGAPEQILHLAHNTSEIERRVHAVIDKFAERGLRSLAVAYQEVPDGRKESPGGPWHFAGLMPLFDPPRHDSAETIRRALNLGVNVKMITGDQLAIGKSTGRRLGMGTNMYPSSALLGQKNSDESISALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVILGGYLAIMTVIFFWAAYKTNFFPRLFHVESLEKTAQDDFQKLAAAIYLQVSTISQALIFVTRSRSWSFAERPGFLLVFAFLVAQLIATLIAVYADWRFTQIKGIGWGWAGVVWLYNIITYLPLDIIKFLIRYTLSGKAWDLVIDQRIAFTRKKDFGKEERELKWAHAQRTLHGLQPPDAKMFSEKGGYNELNHMAEEAKRRAEIARLRELHTVKLYWHVGCMGIGNANRPYCREVKFS

SEQ ID NO: 4156 - protein, 698 aa, Zea mays
MFVEIIVMYPIQHRAYRPGIDNLLVLLIGGIPIAMPTVLSVTMAIGSHRLSQQGAITKRMTAIEEMAGMDVLCSDKTGTLTLNKLTVDRNLVEVFERGTTQDQVILMAARASRTENQDAIDTAIVGMLADPKEARAGIQEVHFLPFNPTDKRTALTYIDGDGKMYRVSKGAPEQILHLAHNKSDIERRVHAMIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTNFFPKIFHVESLEKTAQDDFQKLASAVYLQVSTISQALIFVTRSRSWSFVERPGFLLVFAFLVAQLIATLIAVYADWAFTSIKGIGWGWAGIVWLYNIIFYFPLDIIKFLIRYALSGKAWDLVIEQRIAFTRKKDFGREERELKWAHAQRTLHGLQAPDAKMFPEKAGYNELNQMAEEAKRRAEIARLRELHTLKGHVESVVKLKGLDIETIQQSYTV

SEQ ID NO: 4157 - protein, 750 aa, Pennisetum glaucum
TVKQGEIEAVVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFEKGVTQDQVILMAARASRIENQDAIDTAIVGMLADPKEARAGIQELHFLPFNPTDKRTALTYIDSDGKMYRVSKGAPEQILNLAHNKSEIERRVHAVIDKFAERGLRSLGVAYQEVPDGRKESLGGPWHFVALMPLFDPPRHDSAETIQRALNLGVNVKMITGDQLAIGKETGRRLGMGTNMYPSSALLGQDKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTTQDDYQKLASAVYLQVSTISQALIFVTRSRGWSFVERPGFLLVFAFLVAQLIATLIAVYANWAFTSIKGIGWGWAGVVWLYNLVFYFPLDILKFLIRYALSGKAWDLVIEQRIAFTRKKDFGKEERALKWAHAQRTLHGLQPPDAKLFPDRVNELNQMAEEAKRRAEISRLRELHTLKGHVESVVKLKGLDIDTIQQSYTV

SEQ ID NO: 4158 - protein, 696 aa, Sorghum bicolor
MFVEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFEREVTQDQVILMAARASRIENQDAIDTAIVGMLADPKEARAGIQEVHFLPFNPTDKRTALTYIDSDGKMYRVSKGAPEQILNLAYNKSEIERRVHAVIDKFAERGLRSLAVAYQEVPDGKKESPGGPWHFVALMPLFDPPRHDSAETIQRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTAQDDYQKLASAVYLQVSTISQALIFVTRSRSWSFVERPGFLLVFAFLVAQLIATLIVVYANWGFTSIKGIGWGWAGVVWLYNLVFYFPLDILKFLIRYAMSGKAWDLVVEQRIAFTRKKNFGKEERALKWAHAQRTLHGLQPPDAKLFPERVHELNQMAEEAKRRAEIARLRELHTLKGHVESVVKLKGLDIDTIQQSYTV

SEQ ID NO: 4159 - protein, 592 aa, Pennisetum glaucum
MAARASRTENQDAIDTAIVGMLADPKEARAGIQEVHFLPFNPTDKRTALTYIDSDGKMLRVSKGAPEQILHLAHNKSEIERRVHAVIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVFLGGYQAMMTVIFFWAAYKTNFFPRIFHVESLEKTAQDDFQKLASAVYLQVSTVSQALIFVTRSRSWSFVERPGFLLVFAFLVAQLIATLIAVYANWAFTSIKGIGWGWAGVVWLYNIIFYFPLDIIKFLIRYALSGKAWDLVIEQRIAFTRKKDFGKEERELKWAHAQRTLHGLQAPDAKMFPEKAGYNELNQMAEEAKRRAEIARLRELHTLKGHVESVVKLKGLDIETIQQSYTV

SEQ ID NO: 4160 - protein, 716 aa, Ricinus communis
MQVLTAIGNFCICSIGVGMIIEIIVMYPIQDREYRPGIDNLLVLLIGGIPIAMPTVLSVTMAIGSHRLSQQGAITKRMTAIEEMAGMDVLCSDKTGTLTLNKLTVDKNIIEVFAKGVDADTVILMAARASRTENQDAIDTAIVGMLADPKEARAGIQEVHFLPFNPTDKRTALTYINSDGKMHRVSKGAPEQILNLAHNKSDIERRVHAVIDKFAERGLRSLAVAYQDVPDGRKESPGGPWQFIGLLPLFDPPRHDSAETIRRALNLGVNVKMITGDQLAIGKETGRRLGMGTNMYPSSALLGQDKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIILGSYLAMMTVIFFWAAYKTNFFPRVFGVSTLEKTAHDDFRKLASAIYLQVSTISQALIFVTRSRSWSFVERPGILLVVAFVIAQLVATLIAVYASWSFAAIEGIGWGWAGVIWLYNLIFYFPLDFIKFFIRYALSGRAWDLVIEQRIAFTRQKDFGKEQRELQWAHAQRTLHGLQPPDTKMFTERTHFTELNNMAEEAKRRAEIARLRELHTLKGHVESVVRLKGLDIDTIQQAYTV

SEQ ID NO: 4161 - protein, 645 aa, Lotus japonicus
PDYEFVRMTAIEEMAGMDVLCSDKTGTLTLNKLTVDKNLVEVFAKGVDPDTVVLMAARASRLENQDAIDTAIVGMLADPKEARAGIQELHFLPFNPTDKRTALTYTDQDGKMHRVSKGAPEQILNLAHNKADIERRVHAVIDKFAERGLRSLAVSYQEVPDGRKESAGGPWQFIGLLPLFDPPRHDSAETIRRALNLGVNVKMITGDQLAIGKETGRRLGMGTNMYPSSALLGQNKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFTTGVVLGSYLAMMTVIFFWAAYKTDFFPRVFGVSSLEKTAHDDFRKLASAIYLQVSTISQALIFVTRSRGWSYVERPGFLLVAAFIVAQLIATLIAVYASWSFAAIEGIGWGWAGVIWLYNIIFYIPLDFIKFLTRYALSGRAWDLVIEQRIAFTRQKDFGKEQRELQWAHAQRTLHGLQPPDSKFTERTHVNELNQMAEEAKRRAEIARLRELHTLKGHVESVVRLKGLDIDTIQQAYTV

SEQ ID NO: 4162 - protein, 664 aa, Gossypium hirsutum
MPTVLSVTMAIGSHRLSQQGAITKRMTAIEEMAGMDVLCSDKTGTLTLNKLTVDKNLIEVFAKGVDADTVVLMAARASRTENQDAIDSAIVGMLADPKEARAGIREVHFLPFNPTDKRTALTYIDSDGKMHRVSKGAPEQILHLAHNKADIERRVHAVIDKFAERGLRSLAVAYQEVPDGRKESPGGPWQFIGLMPLFDPPRHDSAETIRRALNLGVNVKMITGDQLAIGKETGRRLGMGTNMYPSSALLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAVMTVIFFWAAYKTNFFPRVFGVATLEKTAHDDIKKLASAVYLQVSIISQALIFVTRSRSWSFVERPGLLLLAAFVIAQLIATLIAVYANWSFAAIEGIGWGWAGVIWLYNIIFYIPLDFIKFFIRYALSGRAWDLVIEQRIAFTRQKDFGKEQRELQWAHAQRTLHGLQAPDTKMFTERTHFTELNQMAEEAKRRAEIARLRELHTLKGHVESVVRLKNLDIDTIQQAYTV

SEQ ID NO: 4163 - protein, 698 aa, Prunus persica
MVIEIIVMYPIQDRDYRPGIDNLLVLLIGGIPIAMPTVLSVTMAIGSHRLSQQGAITKRMTAIEEMAGMDVLCSDKTGTLTLNKLTVDKNLIEVFAKGMDPDTVVLMAARASRVENQDAIDTAIVGMLADPKEARAGVQELHFLPFNPTDKRTALTYLDRDGKMHRVSKGAPEQILNLAHNKSDIERRVHAVIDKFAERGLRSLAVAYQEVPEGRKESAGGPWQFVGLMPLFDPPRHDSAETIRRALDLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAIMTVIFFWAAYKTDFFPRVFGVSTLEKTANDDFRKLASAIYLQVSIISQALIFVTRSRSWSFVERPGLLLVVAFVIAQLIATLIAVYANWSFAAIEGIGWGWAGVIWLYNLVFYFPLDIIKFMIRYALSGKAWDLLIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 4164 - protein, 426 aa, Cajanus cajan
MGTNMYPSSALLGQDKDESISALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFTTGIVLGSYLAMMTVIFFWAAYKTNFFPRVFGVSTLEKTAHDDFRKLASAIYLQVSTISQALIFVTRSRGWSYVERPGILLVTAFVIAQLIATLIAVYANWSFAAIEGIGWGWAGVIWLYNIIFYIPLDIIKFLIRYALSGRAWELVIEQRIAFTRQKDFGKEQRELQWAHAQRTLHGLQPPDTKMFTERTHFNELNQMAEEAKRRAEIARLRELHTLKGHVESVLKLKGIDVDTIQQAYTV

SEQ ID NO: 4165 - protein, 706 aa, Artemisia annua
CICSIAVGMVIEIIVMFPIQDRQYRPGIDNLLVLLIGGIPIAMPTVLSVTMAIGSHRLAQQGAITKRMTAIEEMAGMDVLCSDKTGTLTLNKLTVDKNLIEVFAKGVDADTVVLMAARASRTENQDAIDAAIVGMLADPKEARADIQELHFLPFNPTDKRTALTYLDSQGKMHRVSKGAPEQILNLAHNKSDIERRVHAVIDKFADRGLRSLAVSYQEVPDGRKESAGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQALKHICGMTGDGVNDAPALKKADIGIAVADATDAARSASDIVLTEPGLSVIISAVLTSRAIFQRMKNYTIYAVSITIRIVLGFMLLALIWRFDFPPFMVLIIAILNDGTIMTISKDRVKPSPLPDSWKLAEIFTTGVVLGSYLAMMTVIFFWAAYKTDFFPRTFGVPTLEKTAHDDFRKLASAIYLQVSTISQALIFVTRSRSWSFVERPGWLLIIAFAIAQLIATLIAVYANWSFAAVEGIGWGWAGVIWLYNIVFYFPLDIIKFFIRYALSGRAWDLVIERRIAFTRQKDFGKEQRELQWAHAQRTLHGLEVPDTKMFNDRNNVTELNQMAEEAKRRAEIARLRELHTLKGHVESVVRLKGLDIETIQQAYTV

SEQ ID NO: 4166 - protein, 276 aa, Quercus alba
MVLIIAILNDGTIMTISKDRVKPSPLPDSWKLAEIFTTGIILGGYLAMMTVIFFWAAYKTDFFPRTFGVRSLKQEDDFRRLASAVYLQVSTVSQALIFVTRSRTWSFVERPGLLLVAAFIVAQLFATLIAVYANWKFAAVQGIGWGWAGVIWLYNIIFYIPLDFIKFFTRYALSGRAWDLVIEQRIAFTRKKDFGKEERELKWAHAQRTLHGLHPPESKMFTERASYSELNQMAEEAKRRAEIARLREMSTLKGHVESVVRLKGLDIDTIQQSYTV

SEQ ID NO: 4167 - protein, 763 aa, Helianthus annuus
KGPGDGVYSGSTCKQGEIEAVVIATGVHTFFGKAAHLVDSTNQVGHFQKVLTAIGNFCICSIAVGMVIEIIVMFPIQDRQYRPGIDNLLVLLIGGIPIAMPTVLSVTMAIGSHRLAQQGAITKRMTAIEEMAGMDVLCSDKTGTLTLNKLTVDKNLIEVFSKGVDADTVVLMAARASRTENQDAIDAAIVGMLADPKEARADVQELHFLPFNPTDKRTALTYLDNQGKMHRVSKGAPEQILNLAHNKSDIERRVHAVIDKFADRGLRSLAVAYQEVPEGRKESAGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTDFFPRTFGVPTLEKTAHDDFRKLASAIYLQVSTISQALIFVTRSRSWSFVERPGWLLVIAFAIAQLVATLIAVYANWSFAAVEGIGWGWAGVIWLYNIVFYFPLDIIKFFIRYALSGRAWDLVIERRIAFTRQKDFGKEQRELQWAHAQRTLHGLEVPDTKMFGDRTNVTELNQMAEEAKRRAEIARLRELHTLKGHVESVVRLKGLDIETIQQAYTV

SEQ ID NO: 4168 - protein, 476 aa, Triphysaria pusilla
MPTVLSVTMAIGSHRLAQQGAITKRMTAIEEMAGMDVLCSDKTGTLTLNKLTVDKNLIEVFTKGIDADTVVLMAARASRTENQDAIDAAIVGMLADPKEARAGIREIHFLPFNPTDKRTALTYIDGEGKWHRVSKGAPEQIIHLAHNKSDIERRAHAVIDKFAERGLRSLAVAYQEVPEGTKESPGGPWQFIGLMPLFDPPRHDSAETIRRALNLGVNVKMITGDQLAIGKETGRRLGMGTNMYPSSALLGKNKDESIAALPIDELIEKADGFAGVFPEHKYEIVKRLQALKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFATGVVLGGYLAMMTVIFFWAAYKTDFFPSVFGVSTLEKRPMMTLESSLRQYIFK

SEQ ID NO: 4169 - protein, 698 aa, Arabidopsis lyrata
MIIEIVVMYPIQHRAYRPGIDNLLVLLIGGIPIAMPTVLSVTMAIGSHRLSQQGAITKRMTAIEEMAGMDVLCSDKTGTLTLNKLTVDKNLIEVFTKGVDADTVVLMAAQASRLENQDAIDAAIVGMLADPKEARAGVREVHFLPFNPTDKRTALTYIDSDGKMHRVSKGAPEQILNLAHNKAEIERRVHAVIDKFAERGLRSLAVAYQEVPEGTKESAGGPWQFMGLMPLFDPPRHDSAETIRRALNLGVNVKMITGDQLAIGKETGRRLGMGTNMYPSSALLGQHKDESIGALPIDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGVVFGSYMAMMTVIFFWAAYKTDFFPRTFGVSTLEKTAHDDFRKLASAIYLQVSIISQALIFVTRSRSWSYVERPGMWLVIAFILAQLVATLIAVYANWSFAAIEGIGWGWAGVIWLYNIVFYIPLDIIKFLIRYALSGRAWDLVIEQRVAFTRQKDFGKEQRELQWAHAQRTLHGLQAPDAKMFPERTHFNELSQMAEEAKRRAEIARLRELHTLKGHVESVVRLKGLDIETIQQAYTV

SEQ ID NO: 4170 - protein, 259 aa, Capsicum annuum
RSLLIGSPRLAQQGAITKRMTAIEEMAGMDVLCSDKTGTLTLNKLTVDKNLVEVFAKGVDADTVVLMAARASRTENQDAIDTAIVGMLSDPKEARAGIREIHFLPFNPTDKRTALTYLDGEGKMHRVSKGAPEQILNLAHNKSDIERRVHAVIDKFAERGLRSLGVAYQEVPEGRKESPGGPWQFIGLLPLFDPPRHDSAETIRRALNLGVNVKMITGDQLAIGKKQGVAWEWEPTCILHLLCWGRLRMNQLLLYQLMN

SEQ ID NO: 4171 - protein, 761 aa, Gnetum gnemon
PGEGVYSGSTCKQGELECVVIATGVHTFFGKAAHLVDTTNQIGHFQKVLTAIGKLCICSIAVGMIIEIIVMYPIQDRKYRPGIDNLLVLLIGGIPIAMPTVLSVTMAIGSHRLSQQGAITKRMTAIEEMAGMDVLCSDKTGTLTLNKLTVDKNLIEVFSKRFDKDAIVLMAARASRTENQDSIDAAIVGMLADPKEARAGIQEIHFLPFNPTDKRTALTYTDAEGKMYRASKGAPEQILNLAHNKPEIERRVHSVIDKFAERGLRSLAVAYQEVPECRKESAGGPWHFLGLMPLFDPPRHDSAETIRRALNLGVNVKMITGDQLAIGKETGRRLGMGTNMYPSSSLLGQDKDESIAALPIDDLIEKADGFAGVFPEHKYEIVKRLQARKHICGMTGDGVNDAPALKKADIGIAVADATDAARGASDIVLTEPGLSVIISAVLTSRAIFQRMKNYTIYAVSITIRIVLGFMLLALLWKFDFPPFMVLIIAILNDGTIMTISKDRVKPSPLPDSWKLAEIFATGIIIGSYLALMTVIFFWAAYKTDFFPRTFGVESLQHKDQDDFRKLSAAVYLQVSTISQALIFVTRSRSWSFVERPGLLLVFAFVVAQLIATLIAVYANWGFAAIEGMGWGWAGVVWLYNIIFYFPLDIIKFFIRYALSGKAWDLVIESRTAFTRQKDFGKEARELKWAHAQRTLHGLHPPDTKMFSERTYVSDLNQMAEEAKRRAEIARLRELHTLKGHVESVVRLKGLDIDTIQQAYTV

SEQ ID NO: 4172 - protein, 655 aa, Panicum virgatum
AIGAHRLAQQGAITKRMTAIEEMAGMDVLCSDKTGTLTLNKLTVDKSLIEIFQKGVDQDTVILMAARASRTENQDAIDATIVGMLADPKEARAGVQEIHFLPFNPTDKRTALTYLDREGRMHRVSKGAPEQILHLAHNKSDIERRVRAVIDKFAERGLRALGVAYQEVPDGRKESPGGPWQFIGLLPLFDPPRHDSAETIRRALDLGVNVKMITGDQLAIGKETARRLGMGTNMYPSSALLGQDKDESIATLPVDELIEKADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTNFFPRVFGVESLEKTAQDDFQKLASAVYLQVSTISQALIFVTRSRSWSFVERPGFLLVFAFLVAQLIATVIAVYANWAFAAIKGIGWGWAGVIWLYNIVFYFPLDIIKFLTRYALSGRAWDLVLEQRVAFTRKKDFGRADRELKWAHAQRTLHGLQAPEATIFENKTTFNELNQLAEEARRRAEMARLREVNTLKGRMESVAKQKGLDIETIQQSYTV

SEQ ID NO: 4173 - protein, 828 aa, Avena sativa
MARLAPKAKVLRNGKWNEEESAILVPGDIISVKLGDIIPADARLLEGDPLKIDQSSLTGESLPVTKGPGDGVYSGSTCKQGELEAVVIATGVHTFFGKAAHLVDSTNQVGHFQKVLTAIGNFCICSIAVGMVIEIVVMYPIQHRAYRPGIDNLLVLLIGGIPIAMPTVLSVTMAIGSHRLAQQGAITKRMTAIEEMAGMDVLCSDKTGTLTLNKLTVDKNLIEVVQRGIDQDTVILMAARASRTENQDAIDATMVGMLADPKEARAGIQELHFLPFNPTDKRTALTYLDGEGKMHRVSKGAPEQILDLAHNKSEIERRVRLVIDKFAERGLRSLGVAYQEVPDGSKESPGGPWQFIGLLPLFDPPRHDSAETIRRALHLGVNVKMITGDQLAIGKETARRLGMGTNMYPSSALLGQHKDDSIVALPVDELIEKADGFAGVFPEHKYEIVKRLQARKHICGMTGDGVNDAPALKKADIGIAVDDSTDAARSASDIVLTEPGLSVIISAVLTSRAIFQRMKNYTIYAVSITIRIVLGFMLLALIWQFDFPPFMVLIIAILNDGTIMTISKDRVKPSPQPDSWKLSEIFATGVVLGSYLAMMTVIFFWAAYKTDFFPRVFHVESLEKTAQDDFQKLAAAVYLQVSTISQALIFVTRSRSWSFMERPGFLLVFAFLVAQLIATLIAVYADWGFAAIKGIGWGWAGVIWLYNIVFYLPLDVIKFLIRYAMSGRAWDLVLDQRIAFTRKKDFGREERELKWATAQRTLHGLQPAELTTFHGMNSYSELNQLADEARRRAEIARLRELNTLKGRMESVVRQKGLDLETIQQSYTV

SEQ ID NO: 4174 - protein, 670 aa, Taxus baccata
IKLGDIVPADCRLLEGDPLKIDQSALTGESLPVTKNPGDGVYSGSTCKQGELEAVVIATGVHTFFGKAAHLVDSTNNVGHFQKVLTAIGNFCICSIGVGMIIEIIVQYPIQHRPYRPGIDNLLVLLIGGIPIAMPTVLSVTMAIGSHRLSQQGAITKRMTAIEEMAGMDVLCSDKTGTLTLNKLTVDKNLIEVFAKGIDKDMVVLMAARASRTENQDAIDAAIVGILADPKEARAGIQEVHFLPFNPTDKRTALTYIDGQGRMHRVSKGAPEQILNLAHNKSEIERRVHTIIDKFAERGLRSLAVAYQEVSDGRKESPGGPWQFVGLMPLFDPPRHDSADTIRRALNLGVSVKMITGDQLAIGKETGRRLGMGTNMYPSSSLLGQSKDASIEALPVDDLIEKADGFAGVFPEHKYEIVRRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLSEIFATGIIIGSYLAMMTVIFFWAAFKTDFFPRTFGVSNLHIPSEENTRKLSAVVYLQVSTISQALIFVTRSRSWSFVERPGLLLVGAFMVAQLIATLIAVYANWEFAAIKGMGWVGPG

SEQ ID NO: 4175 - protein, 519 aa, Pennisetum glaucum
HNKSEIERRVHAVIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVFLGGYQAMMTVIFFWAAYKTNFFPRIFHVESLEKTAQDDFQKLASAVYLQVSTVSQALIFVTRSRSWSFVERPGFLLVFAFLVAQLIATLIAVYANWAFTSIKGIGWGWAGVVWLYNIIFYFPLDIIKFLIRYALSGKAWDLVIEQRIAFTRKKDFGKEERELKWAHAQRTLHGLQAPDAKMFPEKAGYNELNQMAEEAKRRAEIARLRELHTLKGHVESVVKLKGLDIETIQQSYTV

SEQ ID NO: 4176 - protein, 545 aa, Triticum aestivum
PRVRLDSDGKMYRVSKGAPEQILNLAYNKSEIAQKVHTVIDKFAERGLRSLGVAYQDVPDGRKESPGSPWHFVALLPLFDPPRHDSAETIQRALNLGVNVKMITGDQLAIGKETGRRLGMGTNMYPSSALLGQNKDESIADLPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGVVLGGYLAMMTVIFFWAAYKTNFFPRVFHVKSLEKTTQDDFKMLASAVYLQVSTISQALIFVTRSRSWSFIERPGFLLVFAFLVAQLIATLIAVYADWGFTSIKGIGWGWAGIVWLYNIVFYFPLDIIKFFIRYALSGKAWDLVIDQRIAFTRKKHFGKEERELKWAHAQRTLHGLQPPNAKLFPEKAGYNELCQMAEEAKRRAEIARLRELHTLKGHVESVVKLKGLDIDTIQQSYTV

SEQ ID NO: 4177 - protein, 596 aa, Lactuca sativa
ALWPLDGDKTGTLTLNKLTVDKNLIEIFAKGVDADMVVLMAARASRVENQDAIDAAIVGMLADPKEARAGIKEIHFLPFNPTDKRTALTYLDDENKMHRVSKGAPEQILNLAHNKSNIEKRVHTVIDKFAERGLRSLAVAYQEVPEGKKESPGGPWEFIGLMPLFDPPRHDSADTIRRALNLGVSVKMITGDQLAIGKETGRRLGMGTNMYPSSALLGQNRDESIVALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGIILGSYLAMMTVIFFWAAYETNFFPRVFGVSSLQKGARDDFRKLASAIYLQVSTISQALIFVTRSRSWSFYERPGALLMGAFLIAQLIATLIAVYANWSFAAIEGIGWGWAGVIWLYNIVFYIPLDFIKFFTRYALSGRAWDLVIDQRLLSQEKETSGKKIVSLNWLKPKELYMDSTHPKPNMLNETTIMSLIKWLKMQFVELR

SEQ ID NO: 4178 - protein, 633 aa, Panicum virgatum
MAGMDVLCSDKTGTLTLNKLTVDKNLVEVFERGITQDQVILMAARASRTENQDAIDTAIVGMLADPKEARAGIQEVHFLPFNPTDKRTALTYIDSDGKMFRVSKGAPEQILHLAHNKSEIERRVHAVIDKFAERGLRSLAVAYQEVPEGRKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTDFFPRIFHVESLEKTAQDDFQKLASAVYLQVSTISQALIFVTRSRSWSFVERPGFLLVFAFLVAQLIATLIAVYADWAFTSIKGIGWGWAGIVWLYNIIFYFPLDIIKFLIRYALSGKAWDLVIEQRIAFTRKKDFGKEERELKWAHAQRTLHGLQAPDAKMFPEKAGYNELNQMAEEAKRRAEIARLRELHTLKGHVESVVKLKGLDIETIQQSYTV

SEQ ID NO: 4179 - protein, 558 aa, Vitis vinifera
EVHFLPFNPTDKRTALTYIDGQGKMHRVSKGAPEQILNLAHNKSEIERRVHAVIDKFADRGLRSLAVAYQEVPDGRKESLGGLWQFVGLMPLFDPPRHDSADTIRRALNLGVNVKMITGDQLAIAKETGRRLGMGTNMYPSSALLGQNKDESIAALPVDELIEKADGFAGVFPEHKYEIVKRLQARKHVCGMTGDGVNDAPALKKADIGIAVADATDAARSASDIVLTEPGLSVIISAVLTSRAIFQRMKNYTIYAVSITIRIVLGFMLLALIWRFDFPPFMVLIIAILNDGTIMTISKDRVRPSPLPDSWKLAEIFATGVVLGSYLAMMTVIFFWAAYETDFFPRVFNVSSLQIKDRDDIRKLASAVYLQVSIISQALIFVTRARSWSFVERPGLLLVVAFVIAQLIATLIAVYANWSFAAIEGIGWGWAGVIWLYNLVCYIPLDFIKFIIRYALSGKAWDLVIEQRIAFTRKKDFGKEARELKWALAQRTLHGLHPPETKMFTDHNITELNQMAEEAKRRAEIARLRELHTLKGHVESVVRLKGLDINTIQQAYTV

SEQ ID NO: 4180 - protein, 545 aa, Triticum aestivum
  misc_feature (124)..(125): Xaa can be any naturally occurring amino acid
  misc_feature (370)..(370): Xaa can be any naturally occurring amino acid
  misc_feature (377)..(377): Xaa can be any naturally occurring amino acid
PRVRLDSDGKMYRVSKGAPEQILNLAYNKSEIAQKVHTVIDKFAERGLRSLGVAYQDVPDGRKESPGSPWHFVALLPLFDPPRHDSAETIQRALNLGVNVKMITGDQLAIGKETGRRLGMGTNXXPSSALLGQNKDESIADLPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGVVLGGYLAMMTVIFFWAAYKTNFFPRVFHVKSLEKTAQDDFKMLASAVYLQVSTISQALIFVTXSRSWSLXERPGFLLVFAFLVAQLIATLIAVYADWGFTSIKGIGWGWAGIVWLYNIVFYFPLDIIKFFIRYALSGKAWDLVIDQRIAFTRKKHFGKEERELKWAHAQRTLHGLQPPNAKLFPEKAGYNELCQMAEEAKRRAEIARLRELHTLKGHVESVVKLKGLDIDTIQQSYTV

SEQ ID NO: 4181 - protein, 527 aa, Lactuca sativa
  misc_feature (524)..(524): Xaa can be any naturally occurring amino acid
ALWPLDGDKTGTLTLNKLTVDKNLIEIFAKGVDADMVVLMAARASRVENQDAIDAAIVGMLADPKEARAGIKEIHFLPFNPTDKRTALTYLDDENKMHRVSKGAPEQILNLAHNKSNIEKRVHTVIDKFAERGLRSLAVAYQEVPEGKKESPGGPWEFIGLMPLFDPPRHDSADTIRRALNLGVSVKMITGDQLAIGKETGRRLGMGTNMYPSSALLGQNRDESIVALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGIILGSYLAMMTVIFFWAAYETNFFPRVFGVSSLQKGARDDFRKLASAIYLQVSTISQALIFVTRSRSWSFYERPGALLMGAFLIAQLIATLIAVYANWSFAAIEGIGWGWAGVIWLYTSSSTSLSISLNSSXDTL

SEQ ID NO: 4182 - protein, 831 aa, Helianthus annuus
  misc_feature (641)..(641): Xaa can be any naturally occurring amino acid
MAHLAPKAKVLRDGKWNEEEAAILVPGDIISIKLGDIIPADARLLEGDPLKIGQSALTGESLPVTKLPGDGVYSGSTCKQGEIEAVVIATGVHTFFGKAAHLVDSTNQVGHFQKVLTAIGNFCICSIAIGMVVEIIVMYPIQNREYRPGIDNLLVLLIGGIPIAMPTVLSVTMAIGSHRLSQQGAITKRMTAIEEMAGMDVLCSDKTGTLTLNKLSVDKNLIEIFAKGVDADMVVLMAARASRVENQDAIDAAIVGMLADPKEARGGIQEVHFLPFNPTDKRTALTYIDGENKMHRVSKGAPEQILNLAHNKSEIERRVHLVIDKFAERGLRSLAVAYQEVPAGKKESPGGPWEFIGLMPLFDPPRHDSAETIRRALNLGVSVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTQPGLSVIISAVLTSRAIFQRMKNYTIYAVSITIRIVLGFMLLALIWKFDFPPFMVLIIAILNDGTIMTISKDRVKPSPQPDSWKLAEIFATGIILGSYLAMMTVIFFWAAYETDFFPRVFGVSSLQKTGQVTLDDVKKKLASAXYLQVSTISQALIFVTRSRSWSVYERPGALLFGAFLIAQLIATLIAVYADWNFSAIEGIGWGWAGVIWLYNIVFYIPLDFIKLFIRYAISGRAWDLVIDQRVAFTRKRNFGKEDRELKWAQAQRTLHGLDPPEIHSVDRNNHNELNQMAEDAKRRAEMTRLRELLTLKGHVESVVKLKNIDIDTIQQSYTV

SEQ ID NO: 4183 - protein, 743 aa, Helianthus annuus
MRQCAYLFGKAAHLVDSTNQVGHFQKVLTAIGNFCICSIAIGMVVEIIVMYPIQNRKYRPGIDNLLVLLIGGIPIAMPTVLSVTMAIGSHRLSQQGAITKRMTAIEEMAGMDVLCSDKTWTLTLNKLSVDKNLIEIFAKGVDADMVVLMAARASRVENQDAIDAAIVGMLADPKEARGGIQEVHFLPFNPTDKRTALTYIDGENKMHRVSKGAPEQILNLAHNKSEIERRVHLVIDKFAERGLRSLAVAYQEVPAGKKESPGGPWELIGLMPLFDPPRHDSAETIRRALNLGVSVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTQPGLSVIISAVLTSRAIFQRMKNYTIYAVSITIRIVLGFMLLALIWKFDFPPFMVLIIAILNDGTIMTISKDRVKPSPQPDSWKLAEIFATGIILGSYLAMMTVIFFWAAYETDFFPRVFGVSSLQKTGQVTLDDVKKKLASAVYLQVSTISQALIFVTRSRSWSVYERPGALLFGAFLIAQLIATLIAVYADWNFSAIEGIGWGWAGVIWLYNIVFYIPLDFIKLFIRYAISGRAWDLVIDQRVAFTRKRNFGKEDRELKWAQAQRTLHGLDPPEIHSVDRNNHNELNQMAEDAKRRAEMTRLRELLTLKGHVESVVKLKNIDIDTIQQSYTV

SEQ ID NO: 4184 - protein, 548 aa, Saccharum officinarum
KRTALTYLDGEGRMHRVSKGAPEQILHLAHNKSNIEKRVRAVIDKFAERGLRALGVAYQEVPDGRKESPGGPWQFIGLLPLFDPPRHDSAETIRRALHLGVNVKMITGDQLAIGKETARRLGMGTNMYPSSALLGQNKDESIASLPIDELIEKADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGIVLGGYLAMMTVIFFWAAYKTDFFPRLFHVESLEKTAQDDFQKLASAVYLQVSTISQALIFVTRSRSWSFVERPGFLLVFAFLVAQLIATLIAVYANWAFAAIKGIGWGWAGVIWLYNLVFYFPLDIIKFLIRYALSGRAWNLVLEQRIAFTSKKNFGTEERELKWAHAQRTLHGLQPPEASIFENKTTFNELNQLAEEARRRAEMARLREVSTLKGKMESVVKQKGLDIETIQQSYTV

SEQ ID NO: 4185 - protein, 599 aa, Theobroma cacao
  misc_feature (173)..(173): Xaa can be any naturally occurring amino acid
  misc_feature (512)..(512): Xaa can be any naturally occurring amino acid
  misc_feature (540)..(540): Xaa can be any naturally occurring amino acid
  misc_feature (545)..(545): Xaa can be any naturally occurring amino acid
GADTVVLMAARASRTENQDAIDSAIVGMLADPKEARAGIREVHFLPFNPTDKRTALTYIDNDGKMHRVSKGAPEQILNLAHNKSDIERRVHVVIDKFAERGLRSLAVAYQEVPEGRKESSGGPWQFIGLMPLFDPPRHDSAETIRRALNLGVNVKMITGDQLAIGKETGRRLXMGTNMYPSSALLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGSYLAVMTVIFFWAAYKTDFFPRIFGVPTLEKTAHDDLRKLASAVYLQVSIISQALIFVTRSRSWSYVERPGLLLVVAFVVAQLIATLIAVYANWSFAAIEGIGWGWAGVIWLYNIIFYIPLDFIKFFIRYALSGRAWDLVIEQRIAFXRQKDFGKEQRELQWAHAQRTLHGLQAPXTKMFXERTHFTELNQMAEEAKRRAEIARLRELHTLKGHVESVVRLKNLDIDTIQQAYTV

SEQ ID NO: 4186 - protein, 435 aa, Zea mays
MITGDQLAIGKETARRLGMGTNMYPSSALLRQNKDESIASLPIDELIEKADGFAGVFPEHKYEIVKGLQARKHICGMTGDGVNDAPALKKADIGIAVADSTDATRSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTDFFPRLFHVESLEKTAQDDFQKFASAVYLQVSTVSQALIFVTRSRSWSFVERPGFLLVFAFLVAKLIATLIAVYANWAFTAIKGIGWGWAGVIWLYNIVFYFPLDIIKFLIRYALSGRAWNLVLEQRIAFTSKKNFGTEERERKWAHAQRTLHGLQPPEASIFENKTTFNELNQLAEEARRRAEMARLREVSTLKGRMESVVKQKGLDI

SEQ ID NO: 4187 - protein, 626 aa, Pennisetum glaucum
MYFSDKTGTLTLNKLSVDKNLIEVFEKGVTQDQVILMAARASRIENQDAIDTAIVGMLADPKEARAGIQEVHFLPFNPTDKRTALTYIDSDGKMYRVSKGAPEQILNLAHNKSEIERRVHAVIDKFAERGLRSLGVAYQEVPDGRKESLGGPWHFVALMPLFDPPRHDSAETIQRALNLGVNVKMITGDQLAIGKETGRRLGMGTNMYPSSALLGQDKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTTQDDYQKLASAVYLQVSTISQALIFVTRSRGWSFVERPGFLLVFAFLVAQLIATLIAVYANWAFTSIKGIGWGWAGVVWLYNLVFYFPLDILKFLIRYALSGKAWDLVIEQRIAFTRKKDFGKEERALKWAHAQRTLHGLQPPDAKLFPDRVNELNQMAEEAKRRAEIARLRELHTLKGHVESVVKLKGLDIDTIQQSYTV

SEQ ID NO: 4188 - protein, 537 aa, Triphysaria pusilla
MHRASKGAPEQILDLAHNRSEIEHRVHAVIDKFAERGLRSLAVAYQEVPDGRKESSGGPWNFLGLMPLFDPPRHDSAETIRRALNLGVNVKMITGDQLAIGKETGRRLGMGTNMYPSSALLGKDKDESIIALPIDELIEQADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFATGVVLGSYLAMMTVIFFWAAYETDFFPRTFGVKSLQRIVNQPPNFRMLASAIYLQVSIVSQALIFVTRSRSWSFLERPGLLLFGAFLIAQLIATLIAVYANWSFAFIEGIGWGWAGVIWLYNLVFYFPLDPIKFFIRYALSGKAWDLVIEQRIAFTRKKDFGKEDRELKWVQAQRTLHGLHPPEAQYGERSSNHNDLNQLAEEARRRAEMARLRELHTLKGHVESVIKMKNLDIDTIQQSYTV

SEQ ID NO: 4189 - protein, 533 aa, Citrus sinensis
  misc_feature (67)..(67): Xaa can be any naturally occurring amino acid
  misc_feature (81)..(81): Xaa can be any naturally occurring amino acid
MHRVSKGAPEQILNLAHNKSDIERRVHAVIDKFAERGLRSLAVAYQEVPEGRKDSPGGPWQFMGLMXLFDPPRHDSAETIXRALNLGVNVKMITGDQLAIGKETGRRLGMGTNMYPSSALLGQDKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWAAYKTDFFPRVFGVATLEKTAHDDFRKLASAIYLQVSTISQALIFVTRSRSWSFVERPGILLLVAFLIAQLIATLIAVYANWSFAAIEGIGWGWAGVVWLYNIIFYIPLDFIKFFIRYALSGKAWDLVIEQRIAFTRQKDFGKEQRELQWAHAQRTLHGLQPPDTKMFTERTHELNQMAEEAKRRAEIARLRELHTLKGHVESVVRLKGLDIDTIQQAYTV

SEQ ID NO: 4190 - protein, 514 aa, Cajanus cajan
MTYIDNEGKMHRVSKGAPEQILNLAHNKSEIERRVHSVIDKFAERGLRSLAVAYQEVPDGKKENKGGPWQFIGLLPLFDPPRHDSAETIRRALNLGVNVKMITGDQLAIGKETGRRLGMGTNMYPSSSLLGQNKDEAIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPYPDSWKLAEIFTTGIILGGYLAMMTVIFFWAAYKTDFFPKTFGVSSLQKKDRDDIRKLASAIYLQVSTISQALIFVTRARSWSYIERPGLLLVAAFVIAQLIATLIAVYANWSFAAIEGIGWGWAGVVWLYNLIFFIPLDFIKFIIRYALSGRAWDLVIEQRIAFTRKKDFGKEERELKWAHAQRTLHGLHPPESKMFGERTNYTELNQMAEEAKKTCRDCKT

SEQ ID NO: 4191 - protein, 632 aa, Selaginella moellendorffii
AIEEMAGMDVLCSDKTGTLTLNKLTVDKNLVEVFAKGYDKDYVLLLAARASRMENQDAIDAAVVGTLADPKEARAGIEEVHFLPFNPTDKRTALTYIDSDGKMHRASKGAPEQILDLSYNKVEIAQRVHAVIDKFAERGLRSLAVACQDVPEGNKESPGGPWQFVGLMPLFDPPRHDSAETIRRALNLGVNVKMITGDQLAIGKETGRRLGMGTNMYPSSSLLGQSKGEAFEGLPIDELIEKADGFAGVFPEHKYEIVKRLQMKKHICGMTGDGVNDAPALKKADIGIAVADATDAARGASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGVVIGSYLALMTVIFYWLADKTTFFPDHFHVPHIGSDANKMHSAIYLQVSIVSQALIFVTRSRSWSFMERPGFLLVVAFLIAQLIATFIAVYANWGFAFVEGIGWGWAGVIWLYNIVFYFPLDVIKFAVRYILSGRAWELLFEQRTAFTRQKDFGREAREVKWAQAQRTLHGLQPPDFKIPEKGTHKETSDMAEQALRRAEIARLRELHTLKGHVESVVRLKGLDINTIQQAYTV

SEQ ID NO: 4192 - protein, 869 aa, Glycine max
QESKVLKFLGFMWNPLSWVMEAAAIMAIALANGGGKPPDWQDFVGIITLLIINSTISFIEENNAGNAAAALMARLAPKAKFLRDGKWIEEDASILVPGDIISVKLGDIIPADARLLEGDPLKIDQSALTGESLPVTKGPGDSVYSGSTCKQGEINAVVIATGVHTFFGKAAHLVDSTNQVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDAAIVGMLGDPKEVGSYMMIYHFFMLAKHAILNLARNKSEIERRVHSVIDKFAERGLRSLAVAYQEVPDGKKESQGGPWQFIGLLPLFDPPRHDSAETIRRALNLGVNVKMITGDQLAIGKETGRRLGMGTNMYPSSALLGQNKDEAIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWHFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTISQALIFITRARSWSYVERPGLLLVAAFVIAQLIATLIAVYANWSFAAIEGIGWGWAGVVWLYNLIFYIPLDFIKFIIRYALSGRAWDLVIEQRIAFTRKKDFGKEERELKWAHAQRTLHGLHPPETKMFNERTSYTELNQMAEEARRRAEIARLRELHTLKGRVESVVRLKGLNIDTIQQAYTV

SEQ ID NO: 4193 - protein, 641 aa, Selaginella moellendorffii
QGAITKRMTAIEEMAGMDVLCSDKTGTLTLNKLTVDKNLVEVFAKGYDKDYVLLLAARASRMENQDAIDAAVVGTLADPKEARAGIEEVHFLPFNPTDKRTALTYIDSDGKMHRASKGAPEQILDLSYNKVEIAQRVHAVIDKFAERGLRSLAVACQDVPEGNKESPGGPWQFVGLMPLFDPPRHDSAETIRRALNLGVNVKMITGDQLAIGKETGRRLGMGTNMYPSSSLLGQSKGEAFEGLPIDELIEKADGFAGVFPEHKYEIVKRLQMKKHICGMTGDGVNDAPALKKADIGIAVADATDAARGASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFATGVVIGSYLALMTVIFYWLADQTTFFPDHFHVPHIGSDANKMHSAIYLQVSIVSQALIFVTRSRSWSFMERPGFLLVVAFLIAQLIATFIAVYANWGFAFVEGIGWGWAGVIWLYNIVFYFPLDVIKFAVRYILSGRAWELLFEQRTAFTRQKDFGREAREVKWAQAQRTLHGLQPPDFKIPEKGTHKETSDMAEQALRRAEIARLRELHTLKGHVESVVRLKGLDINTIQQAYTV

SEQ ID NO: 4194 - protein, 677 aa, Manihot esculenta
MVFTLVLLASKERLKQWLLPLVFIPSLERLLTLWILQTKLATSKRQGDRNKVLTAIGNFCICSIAVGMVIEIIVMYPIQDREYRPGIDNLLVLLIGGIPIAMPTVLSVTMAIGSHRLSQQGAITKRMTAIEEMAGMDVLCSKMHRVSKGAPEQILNLARNKSDIERRVHAVIDKFAERGLRSLAVAYQEVPEGRKESPGGPWQFIGLMPLFDPPRHDSAETIRRALNLGVNVKMITGDQLAIGKETGRRLGMGTNMYPSSALLGQDKDESISALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLAEIFTTGIVLGSYLAMMTVIFFWAAYKTDFFPRVFGVSTLEKTAHDDFRKLASAIYLQVSTISQALIFVTRSRSWSYVERPGLLLVVAFLVAQLIATLIAVYANWSFAAIEGIGWGWAGVIWLYNIIFYIPLDFIKFFIRYALSGRAWDLVIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 4195 - protein, 513 aa, Arachis hypogaea
ERRVHAVIDKFAERGLRSLAVAYQEVPDGRKESAGGPWQFIGLMPLFDPPRHDSAETIRRALNLGVNVKMITGDQLAIGKETGRRLGMGTNMYPSSALLGQDKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGSYLAMMTVIFFWAAYKTNFFPRVFGVSTLEKSAHDDFRKLASAIYLQVSTISQALIFVTRSRGWSYVERPGLLLVVAFIVAQLIATLIAVYANWSFAAIEGIGWGWAGVIWLYNIIFYIPLDIIKFLIRYALSGRAWDLVIEQRIAFTRQKDFGKEQRELQWAHAQRTLHGLQAPDTKMFTERTHFNELNQMAEEAKRRAEIARLRELHTLKGHVESVVRLKGLDIDTIQQAYTV

SEQ ID NO: 4196 - protein, 663 aa, Marchantia polymorpha
SIAMPTVLSVTMAIGSHRLAQQGAITKRMTAIEEMAGMDVLCSDKTGTLTLNKLTVDKNLIETFTPGVDKDMVVLLAARASRTENQDAIDAAIVNMLADPKEARAGVQEIHFLPFNPTDKRTALTYVDNEGHWHRASKGAPEQILELAHNKDIISSRVHAVIDKFAERGLRSLAVARQKIPEGTKESAGGPWEFCGLLPLFDPPRHDSAETIRRALNLGVNVKMITGDQLAIAKETGRRLGMGINMYPSSSLLGQHKDEAIAALPIDELIEKADGFAGVFPEHKYEIVKRLQEKKHICGMTGDGVNDAPALKKADIGIAVADATDAARSASDIVLTEPGLSVIISAVLTSRAIFQRMKNYTIYAVSITIRIVLGFLLLALIWKFDFSPFMVLIIAILNDGTIMTISKDRVKPSPLPDSWKLKEIFATGVVLGTYLAVMTVVFFWLAHKTTFFQEKFGVRDISGDRNELTAAVYLQVSIVSQALIFVTRSRSWSFLERPGFLLVAAFWIAQLIATFIAVYANWSFAFIKGIGWGWAGVIWLYSLIFYIPLDIIKFLVRYILSGRAWHYMINQRTAFTTQKDFGKEAREMKWAHAQRTLHGLQSPDVKMAGDRGSYKELNDIAEQAKRRAEIARLRELNTLKGHVESVVRMKGLDIDTIQQAYTV

SEQ ID NO: 4197 - protein, 474 aa, Centaurea maculosa
  misc_feature (458)..(458): Xaa can be any naturally occurring amino acid
MPLFDPPRHDSAETIRRALNLGVSVKMITGDQLAIGKETGRRLGMGTNMYPSSALLGQNRDESIVALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLSEIFATGIILGSYLAMMTVIFFWAAYDTNFFPRVFGVSSLQKTPNVAEDEQDFRKLASAIYLQVSTISQALIFVTRSRSWSFYERPGALLFGAFLIAQLIATLIAVYANWSFCAIEGIGWGWAGVIWLYNIVFYIPLDIIKFFIRYALSGRAWDLVIDQRVAFTRKRNFGKEDRELKWAQAQRTLHGLDPPETQFVERNNHNELNQMAEDAIRRAEMTRLRELLTLKGHVESVXKLKNIDIDTIQQSYTV

SEQ ID NO: 4198 - protein, 511 aa, Cucumis melo
KVHAVIDKFAERGLRSLAVAYQEVPDGRKESAGGPWQFVGLLPLFDPPRHDSAETIRRALNLGVNVKMITGDQLAIGKETGRRLGMGTNMYPSSALLGQDKDESIAALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIILGGYLAMMTVIFFWAAYKTNFFPRVFGVATLEKTAHDDIRKLASAVYLQVSTISQALIFVTRSRSWSYVERPGLLLVAAFLVAQLIATLIAVYANWGFAAIEGIGWGWAGVIWLYNIIFYIPLDLIKFFIRYALSGRAWDLVIEQRIAFTRQKDFGKEQRELQWAHAQRTLHGLQAPDAKMFHDRTHFTELNQMAEEAKRRAEIARLRELHTLKGHVESVVRLKGLDIDTIQQAYTV

SEQ ID NO: 4199 - protein, 629 aa, Pennisetum glaucum
GCPCSDKTGTLTLNKLTVDKSLIEVFQRGVDQDTVILMAARASRTENQDAIDATIVGMLADPKEARAGVQEIHFLPFNPTDKRTALTYLDGEGKMHRVSKGAPEQILHLAHNKSDIERRVRAVIDKFAERGLRALGVAYQEVPDGRKESPGGPWQFIGLLPLFDPPRHDSAETIRRALDLGVNVKMITGDQLAIGKETARRLGMGTNMYPSSALLGQDKDESIISLPVDELIEQADGFAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPMPDSWKLAEIFATGVVLGGYLAMMTVIFFWAAYKTNFFPRVFGVESLEKTAQDDFQKLASAVYLQVSTISQALIFVTRSRSWSFMERPGFLLVFAFLVAQLIATLIAVYANWAFAAIKGIGWGWAGVIWLYNVVFYFPLDIIKFLTRYALSGRAWDLVLEQRIAFTRKKDFGREERELKWAHAQRTLHGLQAPEPSIFENKTTFNELNQLAEEARRRAEMARLREVNTLKGKMESVVRQKGLDMETIQQSYTV

SEQ ID NO: 4200 - protein, 112 aa, Triticum aestivum
YLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4201 - protein, 121 aa, Triticum aestivum
MQVWPSEGVYFFETLSYLPPLSREALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPG

SEQ ID NO: 4202 - protein, 113 aa, Hordeum vulgare
SYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCEESGKA

SEQ ID NO: 4203 - protein, 144 aa, Hordeum vulgare
SSASLGSVSNGGRIRCMHVWPIEGIKKFETLSYLPPLTTEALLKQVDYLIRSKWVPCLEFSKVGFVFREHNSSPGYYDGRYWTMWKLPMFGCTDATQVLNEVEEVKKEYPGAYVRIIGFDNLRQVQCVIFIGFRPPCCEESGKA

SEQ ID NO: 4204 - protein, 95 aa, Pinus taeda
RATLAVTHLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4205 - protein, 136 aa, Triticum aestivum
MYQKCQSYLQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4206 - protein, 114 aa, Triticum aestivum
LSYLPPLSTEGLLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4207 - protein, 61 aa, Triticum aestivum
MWKLPMFGCTDATQVLNEVEEVKKEYPDAYVRVIGFDNLRQVQCVSFIAFRPPGCEESGKA

SEQ ID NO: 4208 - protein, 128 aa, Triticum aestivum
MQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4209 - protein, 124 aa, Lolium multiflorum
PIEGIKKFETLSYLPPLSAEALLKQIDFLIRSKWVPCLEFSKVGFIFREFGSTPGYYDGRYWTMWKLPMFGCTDAAQVLKEVDEVKKEYPDAYVRIIGFDNIRQVQCVSFIAFKPPGCEESGKA

SEQ ID NO: 4210 - protein, 109 aa, Avena sativa
PLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4211 - protein, 97 aa, Avena sativa
LLDSLQWVPCLEFSKVGFIFREYGSTPGYYDGRYWTMWKLPMFGCTDASQVIKEVEEVKKEYPDAYVRIIGFDNIRQVQCVSFIAFKPPGCEESGKA

SEQ ID NO: 4212 - protein, 156 aa, Avena sativa
KSTAGLPVTPSQLRKPRQRQQRWKESRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4213 - protein, 140 aa, Avena sativa
SVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4214 - protein, 165 aa, Avena sativa
HHRRALPRASSPPLASPSSRRSSGSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4215 - protein, 112 aa, Avena sativa
YLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4216 - protein, 123 aa, Avena sativa
EASRSSETPFLPCHHSQTEALLKQIDFLTRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4217 - protein, 128 aa, Avena sativa
MQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4218 - protein, 130 aa, Avena sativa
MQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKAKA

SEQ ID NO: 4219 - protein, 144 aa, Avena sativa
QCRPWQRQQRWKNQMHAGCGQLRASRSSETPSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4220 - protein, 125 aa, Avena sativa
TLSYLPPLSEEALLKQIDFLIRSKWVPCLEFSKVGFIFREHGSTPDTTTAGTGQCGSCPCSAAPTPHRSSRRWRRSRRSTLTPMSASSASTTSVKCSASASSPSSHRVARSLARHKPRAGNNCLF

SEQ ID NO: 4221 - protein, 68 aa, Avena sativa
MASSATTVAPFQGLKSTAGLPVTPSQLRKPRQASATVERIRCMQVWPIEGIKKFETLLTCHHSQRRPS

SEQ ID NO: 4222 - protein, 127 aa, Avena sativa
ETLSYLPPLSEEALLKQIDFLIRSKWVPCLEFSKVGFIFREHGSTPGYYDGRYWTMWKLPMFGCTDASQVIKEVEEVKKEYPDAYVRYHRLRQHPSSAVRQLHRLQATGLRGIWQGISCQLVQVAAI

SEQ ID NO: 4223 - protein, 120 aa, Avena sativa
HQEVRDPVLLAPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4224 - protein, 164 aa, Avena sativa
LPVRALPGPQVHRWPPRQPPQQAGLGSVSNGGRTRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4225 - protein, 61 aa, Avena sativa
SRPPRGSKSTAGLPVQPPQQRRPWQRQQRWKNPMHAGAGLLRASRSSRPCLTCRHSQRRPS

SEQ ID NO: 4226 - protein, 61 aa, Avena sativa
MWKLPMFGCTDASQVIKEVEEVKKEYPDAYVRIIGFDNIRQVQCVSFIAFKPPGCEESGKA

SEQ ID NO: 4227 - protein, 117 aa, Avena sativa
SRPFLTCHHSQRTALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4228 - protein, 87 aa, Triticum aestivum
VEGLRCMQVWPIEGIKKFETLSYLPPFSREAFFKQVDYLIRSKWVPCLEFSKVGFIFREHNASPGYTMAGTGQCGSCLCSGALTPRR

SEQ ID NO: 4229 - protein, 74 aa, Hordeum vulgare
MAPTMMASLATSVSPFQGLKSTAGLTMSRRSNGAILCSVTYCGRIRCMQVWPIEGINNFQTLSYLPPHQHGGPP

SEQ ID NO: 4230 - protein, 177 aa, Hordeum vulgare
MAPTDHVQQAATAVAAYPGLKPTRGLPISHLFGNAAGLCSRRNGGRIQCRRGWPIEGIKKFETLSYLPPLSTEALLKHVDYLIRSKWVPCLEFSKVGFIFREHNASPGYYDGRYWTMWKLPMFGCTDATQVLNQVGEVKKEYPDAYVRIIGFDNMRQVQCVSFIAFKPPGCEESGKA

SEQ ID NO: 4231 - protein, 128 aa, Avena sativa
MQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4232 - protein, 143 aa, Avena sativa
NAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESGKA

SEQ ID NO: 4233 - protein, 128 aa, Avena sativa
MQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESGKA

SEQ ID NO: 4234 - protein, 111 aa, Avena sativa
LPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESGKA

SEQ ID NO: 4235 - protein, 81 aa, Avena sativa
MQVWPIEGIKKFETLSYLPPLSEEALLKQIDFLIRSKWVPCLEFSKVGFIFREHGSTPDTTTAGTGQCGSCPCSAAPTPHR

SEQ ID NO: 4236 - protein, 61 aa, Hordeum vulgare
MWKLPMFGCTDATQVLNEVEEVKKEYPDAYVRIIGFDNMRQEQCVSFIGFKPPGCEESGKA

SEQ ID NO: 4237 - protein, 79 aa, Avena sativa
VFREHGSTPGYYDGRYWTMWKLPMFGCTDASQVIKEVEEVKKEYPDAYVRIIGFDNIRQVQCVSFIAFKPPGCEESGKA

SEQ ID NO: 4238 - protein, 137 aa, Hordeum vulgare
LGSVSNGGRIRCVQVWPIEGIKKFETLSYLPPLSTEALLKQVDYLIRSKWVPCLEFSKVGFIFREHNASPGYYDGRYWTMWKLPMFRCTDATQVLNEVEEVKKEYPDAYVRIIGFDNMRQVQCVSFIAFKPPGCEES

SEQ ID NO: 4239 - protein, 69 aa, Avena sativa
LLKQIDFLIRSKWVPCLEFSKVGFIFREHGSTPRVLRRQVLDNVEAAHVRLHRRLTGHQGGGGGEEGVP

SEQ ID NO: 4240 - protein, 61 aa, Triticum aestivum
  misc_feature (46)..(46): Xaa can be any naturally occurring amino acid
MWKLPMFGCTDATQVINEVEEVKKEYPDAYVRIIGLDNMRQVQCVXFIAFKPPGCEESGKA

SEQ ID NO: 4241 - protein, 134 aa, Triticum aestivum
  misc_feature (63)..(63): Xaa can be any naturally occurring amino acid
  misc_feature (81)..(81): Xaa can be any naturally occurring amino acid
  misc_feature (126)..(126): Xaa can be any naturally occurring amino acid
EALLKQVDYLIRSKWVPCLEFSKVGFIFREHNASPGYYDGRYWTMWKLPMFGCTDATQVYERXEEVKKEYPDAYVRIIGFXNMRQVQCVSFIRLQSHRAAKESRQGLNSHSTTGIYKVPLHFVNSXIAWVFLPH

SEQ ID NO: 4242 - protein, 129 aa, Triticum aestivum
MWKLPMFGCPDPTQVFNEVEEVKKEYPDAYVRIIGFDNMRQVQCVRFIAFKPPGCEESGKALTAPSRQAIYKVPLQFYPPPPCFGFSFSIYLFYLFLRKCVCPCSCTNMARESMLVCECYRWLCICPDA

SEQ ID NO: 4243 - protein, 147 aa, Triticum aestivum
MQVWPTEGIKKLGTLSDLPPLSTEALLKQIDYLIRSKWLPCLEFSKVGFIFREHNASPGYYDGRYWTMWNLHMFGCTDATQVINEVEEVKKEYPDAYVRIIGLDNMRQVQCVSFIAFKPPGCEEYGTAYTAHSRQAIYKVPLQFGQL

SEQ ID NO: 4244 - protein, 85 aa, Triticum aestivum
  misc_feature (15)..(15): Xaa can be any naturally occurring amino acid
  misc_feature (20)..(20): Xaa can be any naturally occurring amino acid
EFSKVGSSSVSTTHXLVYDXRYWTMWKLPMFGCTDATQVINEVEEVKKEYPDAYVRIIGFDNMRQVQCVSFIAFKPPGCEESGKA

SEQ ID NO: 4245 - protein, 56 aa, Triticum aestivum
MFGCPDPTQVINEVEEVKKEYPDAYVRIIGFDNMRQVQCVSFIAFKPPGCEESGKA

SEQ ID NO: 4246 - protein, 61 aa, Hordeum vulgare
MWKLPMFRCTDATHVLNEVEEVKKEYPDAYVRIIGFDNMRQVQCVSFIAFKPPGCEEYWHA

SEQ ID NO: 4247 - protein, 146 aa, Hordeum vulgare
MCLPGLRIVPNAERAGLPVSRRSNGASLGSVSIGGRIRCMQVSPIEGIKKFETLSYLPPLSTEALLKQVDYLIRSKRVPCLEFNKVGFILREHNASPGYYDGRNWTMCKLPMFGCTDATQVLNEVEEVKKEYPDAYVRIIGFGNMR

SEQ ID NO: 4248 - protein, 67 aa, Lolium multiflorum
DGRYWTMWKLPMFGCTDAAQVLKEVDEVKKEYPDAYVRIIGFDNIRQVQCVSFIAFKPPGCEESGKA

SEQ ID NO: 4249 - protein, 206 aa, Triticum aestivum
VAPTTKAYNFVLNSCPTVVSMARELGPSLPLSAAKLVRKLNSTSPWPAEAEVVQELLAASSVLNKAMVWSETEVKLNLHGFSITSAYVLMLQWVDAVKGDRTLPLEVSVVCGVGKHSDVRGEPKVRELAQEVLSRMGSPLRLSARNKGRLVAKRDRVKQWLATEWTSMVPEESTDQSPNSSDQQQFLPNLLRKLGQFFSSFVPVSR

SEQ ID NO: 4250 - protein, 206 aa, Triticum aestivum
VAPTTKAYNFVLNSCPTVVSMARELGPSLPLSAAKLVRKLNSTSPWPAEAEVVQELLAASSVLNKAMVWSETEVKLNLHGFSITSAYVLMLQWVDAVKGDRTLPLEVSVVCGVGKHSNVRGEPKVRELAQEVLSRMGSPLRLSVRNKGRLVAKRDRVKQWLATEWTSMVPEESTDQSPNSSDQQQFLPNLLRKLGQFFSSFVPVSR

SEQ ID NO: 4251 - protein, 524 aa, Brachypodium distachyon
MPAATSLPARAPAPSAARRRRSSRAAVVSASSSLRRAASGGGSSWRSERRLMSELDRTVTSGAAERVIRGYVGTKSERAALAALSRLLIDSDPLAIPVSPLQFHLEPCSSPGGNLFKSRLQFYEAVTQARWFKWSSIHAAGVAALLEATGGAEESRSLVAGSAARLQCPSEVALFYCDLMAAFSSRGLNRRAMDFYAQLRAMPPPALSGSGAGGGGGGRIYMAMIKSLCLMGLAAEAEEALREMVSLGHKPDAFQFGLVAKCYGKAGQLAEMERVIASMSDAGIRLGTGAANIVLSCYSACRDHGKMLMWLKRMRKLRIAPTTKAYNFVLNSCTTVVKMARELGPSLPLSSAQLVKKLRSGSPWPAEADVVQELLAASSVLDKAMNWSENEVKLNLHGFSVTSAYVLMLQWVDAIKGGRALPLEVSVVCGVGKHSDVRGEPKVRELAQEVLSRTGSPLRLSARNKGRLVAKRDRVKQWLTTEWTSPLLEESTDQSSSTSDQQPFLPKLLRKLGQMFSSFVSVSR

SEQ ID NO: 4252 - protein, 486 aa, Gossypium hirsutum
DNNTSAGQIELVNDWKNVFNRATVVVFPNYALPMIYSTFDTGNYYVIPGSPADAWKGENAMYLYKDNQRASMGYGPNEVLIAIVGSQFMYRGLWLEHALILQALLPLFADFSSDNDSISHPKIIVLSSDSASNYSMAVEKIALNLRYPSGVVKHVAVHGDVDGVLSMTDLVIYGSFLEEPSFPEILIKAMSHGKPIVAPDLSSIRKYVDNRVNGYLFPKENISVLTQIILQMISKGKLSPLALNIASIGRGTVKNMMVQETIEGYAMLLENVLKFPSEVAPPKAVIELPSKLKEEWQWNLFVNLQNSTLEDKSSKFLNNLEEQWNHSQRKKFGSPVAMNDSFSYEIWEEEKDAYFHTKRRREEQELKDRTDQSRGTWEDVYRNAKRADHARNDLHERDERELERTGQPLCIYEPYFGEGTWPFLHRSSLYRGIGLSTKGRRPRMDDVDGPSRLELLRNSYYRDILGEYGAFLQLLTGLTTYTGMPG

SEQ ID NO: 4253 - protein, 1033 aa, Manihot esculenta
MGSLETALPLKRESLLRSSSAGRTERYPFSQRPRSRFSRFLLFRKLDYLQWICTVAVFLFVVISFQMFLPGSVIEKSQDSWKELDMVSGDLLSLKETGTLDFGEDIKFEPSKLIEKFEKEARDVNNLSFNFSVTQRRFGYKKPQLALVFADLLVDPQQLLMVTVATALQEIGYITQVFSIEDGPAHEIWKSIGVPVTIFQSKHRMEIAVDWLMYDGILVSSLETKVVLSCFMQEPFKSLPLIWTIHEKALAVRSRKYTENGQIELANDWKRVFNRATVVVFPNHVLPMMYSSFDAGNYYVIPGSPAQAWEADALVALYKDNVRVKMGYGPDDIIITIVGSQFLYRGLWLEHALILQALLPLFSKFPFDDNSISRLKIIVLSGNSTSNYTMAVEAIAVNLHYPRGAVKHIAIDEDEGSVLSASDIVVYGSFHEEQSFPEILIKAMCIGKPIVAPDLHMIRKYVDDRVNGFLFPREKIRVLTHIILQLILNGKLSPVARNIASVGKGTARNLMVAETVEGYASLLEKIIRLPSEVALPEAFVEIPSKLKEEWRWHLFGAFSKSAYEERTLRISRSLDKIEEQWNRTQRESSRSITSIDESFLYDIWKEEKDNEILNARKRREEEELKDRSDQPHGTWEEAYRGAKRADRSRNDLHERDEGELERTGQPLCIYEPYFGEGTWSFLHHSSLYRGVGLSSKGRRPRADDVDAPSRLPLLNNPYYRDALGEYGAFFAIANRIDRVHKNAWIGFQSWRATARKASLSRTAELALLDAIQTQRHGDALYFWVRMDMDPRNQLQQDFWSFCNAINAGNCKSAFSEAFRRMYGVEQDLDYLPPMPDDGDTWSVMLSWALPTRSFLEFVMFSRMFVDALDAQMYDEHHQSGHCYLSLSKDKQCYSRVLELLINVWAYHSARQMVYVNPETGLMQEQHKIKSRRGKMWVKWFSYTTLKSMDEDLAEEADSDQPKRRWLWPNTGEVVWQGVFEKERSLRNQQKEKRRQQSKDKLNRMRRKHRQKVIGKYVKPPPEDIENSNSTMLM

SEQ ID NO: 4254 - protein, 1041 aa, Populus trichocarpa
MGSLETGGISFKRDKNTLIRSYSAGRTERHPFLYRPRSSFSRFLRFKKLDYIQWICTVAVFLFFVVLFQMFLPGSVVEKSELGSSPWRGMELVDKDLWYLKEIGGLDFGEDIKFQPSKILQHFRKENREMNMSFSNRTLSRFPYRKPQLALVFADLLVDPHQLLMVTVATALQEIGYTIHVYSLGDGPAQSIWKSMRSPVNIIQISHKMEIAVDWLNYDGILVNSLETKSVFSCFMQEPFKSVPLIWTINERTLATHSRQYTSSWQIELLYDWRKAFNRATVVVFPNHVLPMMYSAFDTGNYYVIPGSPADIWETETTMALYNDEIHVKMGYEPDDIVIAIVGSQFLYRGLWLEHALVLKALLPLFAEFSLDNNSKSHLKIIILSGDPTGNYSVAVEAIAANLSYPRGTVKHFAVDDDVGSPLGAADLVIYGSFLEEQSFPEILVKAMSIGKPIITPDLSMIRKYVDDRVNGYLFPKENLKVLTQIVLQAISKGTLSPLARNIASMGKNTAKNLMVLETVEGYATLLENVVELPSEVTPPKAVSEIPPKLKKEWCWHLFKAFMNSTHEDRTLKSSRYLKTVEEQWNYMQKESSGSIAATNDSFSYDIWEEERNIMMLNTRKRREEEELKDRTDQPHGTWEDVYKSAKRADRSRNDLHERDEGELLRTGQPLCIYEPYFGEGTWSFLHQSSLYRGIGLSTKGRRPRTDDIDAPSRLSLLSKPYYRDALGEYGAFFAIANRIDRIHKNSWIGFQSWRATARKASLSRIAEKALVDAIESRKHGDSLYFWVRMDMDPRNDLQSDFWSFCDAINAGNCKLAFSEALKRMYGIKHDLEFLPPMPEDGDTWSVMLSFALPTRSFLEFVMFSRMFVDALDAQMYDEHHQSGRCYLSLAKDKHCYSRVLELLINVWAYHSARQMVYVNPETGLMQEQHAVKSRRGNIWVKWFSYSILKSMDEDLAEEADSDQPKRRWLWPSTGEVVWQGLFEKERNLRNHQKEKRRQQSKDKQQRMRKKRRQPVLGKYVKPPPEDIENSNSTVSMSESL

SEQ ID NO: 4255 - protein, 1052 aa, Populus trichocarpa
MGSLETGGISFKRDKNTLIRSYSAGRTERHPFLYRPRSSFSRFLRFKKLDYIQWICTVAVFLFFVVLFQMFLPGSVVEKSELGSSPWRGMELVDKDLWYLKEIGGLDFGEDIKFQPSKILQHFRKENREMNMSFSNRTLSRFPYRKPQLALVFADLLVDPHQLLMVTVATALQEIGYTIHVCILVLELLCRVYSLGDGPAQSIWKSMRSPVNIIQISHKMEIAVDWLNYDGILVNSLETKSVFSCFMQEPFKSVPLIWTINERTLATHSRQYTSSWQIELLYDWRKAFNRATVVVFPNHVLPMMYSAFDTGNYYVIPGSPADIWETETTMALYNDEIHVKMGYEPDDIVIAIVGSQFLYRGLWLEHALVLKALLPLFAEFSLDNNSKSHLKIIILSGDPTGNYSVAVEAIAANLSYPRGTVKHFAVDDDVGSPLGAADLVIYGSFLEEQSFPEILVKAMSIGKPIITPDLSMIRKYVDDRVNGYLFPKENLKVLTQIVLQAISKGTLSPLARNIASMGKNTAKNLMVLETVEGYATLLENVVELPSEVTPPKAVSEIPPKLKKEWCWHLFKAFMNSTHEDRTLKSSRYLKTVEEQWNYMQKESSGSIAATNDSFSYDIWEEERNIMMLNTRKRREEEELKDRTDQPHGTWEDVYKSAKRADRSRNDLHERDEGELLRTGQPLCIYEPYFGEGTWSFLHQSSLYRGIGLSTKGRRPRTDDIDAPSRLSLLSKPYYRDALGEYGAFFAIANRIDRIHKNSWIGFQSWRATARKASLSRIAEKALVDAIESRKHGDSLYFWVRMDMDPRNDLQSDFWSFCDAINAGNCKLAFSEALKRMYGIKHDLEFLPPMPEDGDTWSVMLSFALPTRSFLEFVMFSRMFVDALDAQMYDEHHQSGRCYLSLAKDKHCYSRVLELLINVWAYHSARQMVYVNPETGLMQEQHAVKSRRGNIWVKWFSYSILKSMDEDLAEEADSDQPKRRWLWPSTGEVVWQGLFEKERNLRNHQKEKRRQQSKDKQQRMRKKRRQPVLGKYVKPPPEDIENSNSTVSMSESL

SEQ ID NO: 4256 - protein, 871 aa, Sorghum bicolor
MDLFAIDSDSESYTGTSDSEDQECEFAYSDHAQNILSSLDESIVKIDNFLTFERGFLHGDIVCPVSDPSGQLGRVVGVSMLVDLETSSGDIIKDVNSKKLSRVRSFVSGDRVVMGPWIGRVIRAFDLVTLLFSDGAKCEILLRDLDVLKPVPPILFEDAPYFYYPGQRVRIVDPSVSKSATWLCGSWRPSRDDCIVSHVDVGLVHVNWITSVTNVWGDKSSSPSNIQDPKKLTLLSCFPYANWQLGDWCALMADNNGYLWMDSGKSCILSEDHKCDSHGHMYFESYGSDCSQTYVVAKTKSTVDVLWQNGTVSLGLEPQALVPVSTLGDHDFWPGQYVLEKLTVEDAAKCQRTAIVRDVDALERTVNVKWIDPAHSDTVSYGSDPAVETVSVYELVEHPDFSFCTGEVVIRSAVNIDKSEADLTNGSLASKESLVTSSGFLSCIGNVLGYKDNGIEVQWANGVISKVQHFEIIGLDRLLDNSSLESMNEEHTIGDSLGEAEQEEMHHEIALESTEDCTGSLCKATAFLFPKTAFDFLTNVAASLFGTRGSPSPSSVSVDPRYEIVKMAEMQPCVEELPKEKQIVKFVAQIEKPILSSEDAISKRFDVVTDCLDHHFVKENGHESVTRGWLKKVQQEWSILQNDLPDGIHVRVYEERMDLLRACIVGAAGTPYHDNLFFFDIFFPPDYPHEPPSVHYHSGGLRLNPNLYESGKVCLSLLKTWTGTGNEVWNAENSTVLQLLLSLQALVLNEKPYFNEAGYDKFVGKADGEKNSITYNENAFLLSCKSMMYVLHKPPKHFEKLVKEHFTCRSLHILDACEAYLGGDLVGHAHDKAYISEDGSKNCSTGFKIMLGKLLPKLVTAFYEAGITSDP

SEQ ID NO: 4257 - protein, 874 aa, Panicum virgatum
MDLFAIDSDSESYSGTSDSEDQEECEFTYSDHAQSILSSLDESIGKIDNFLTFERGFLHGDIVCPVSDPSGQLGRVVGVAMFVDLETSSGDIIKDVNSKKLSRVRSFISGDCVVMGPWIGRVIRAFDLVTVLFSDGAKCEMLLRDSEALKPIPPILFEDAPYFYYPGQRVRIVEPSVYQSATWLCGSWRPGRDDGVVSHVDVGMVHVNWITSVTNVWGDKSSSPPNIQDPKKLTLLSCFPYANWQLGDWCALTVDDHGCLWMDSGKSCIVSEAWKCNSPGHMHLENCSSGYSQTYVVSKTKSTVDILWQNGSISLGLEPQTLVPVSTLGDYDFWPGQFVLEKLAVEDSARRQRTGIVRDVDALERTVNVLWISPAGSDTVSYGRSGSTVETVSAYELAEHPDFSFCTGEVVIMSAVNIEKSEADLTNGSLASRESLVTHSDFLSCIGNVLGYKDDGIEVQWANGVISNVQHFEIIGLDKLLDSSLESMHEENTAGDSVDVDEQEEMHHENANIALESTDCTGSLCKVTAFLFPKTAFDFLTNVASSLFGTHGSPSPSSVVIDTQYQIIKTVEMQTSADELPEEKQVVELVAKIEKPNLTSEDNISKRFDVVTDCSDHHFVKESGHESVTRSWVKKVQQEWMILQNDLPDGIHVRVFEERMDLLRACIVGAAGTPYHDNLFFFDIFFPPDYPHEPPSAHYHSGGLRLNPNLYESGKVCLSLLKTWTGTGNEVWNPENSTVLQLLLSLQALVLNEKPYFNEAGYDKFLGKADGEKNSITYNENAFLLSCKSMMYVLHKPPKHFEKLVKEHFACRARRILDACEAYLGGDLVGHAHDKAYISEDGSKNCSTGFKIMLGKLLPKLAAAFSEAGIISGQ

SEQ ID NO: 4258 - protein, 863 aa, Pennisetum glaucum
MDLFAIDSDSESYSGTSDSEDQEECEYTYSDHAQNILSSLDESIGKIDNFLTFERGFLHGDIVCPVSDPSGQLGRVAGVAMFVDLETSSGDIIKDVNSKKLSRVRSFVSGDCVVMGPWIGRVIRAFDLVTLLFSDGAKCEMLVRDSEALKPIPPILFEDAPYFYYPGQRVRIVQPSIFESATWLCGSWRPNRHDGVVSHVDVGLVHVNWITSVTNVWGDKSSSPRNIQDPKNLTLLSCLSYANWQLGDWCALTSDDHGCLWMDSGKSCILNEAWKCDSHGHMHSGYSQTYIVSKTKSTVDVLWQNGSISLGLEPQTLVPVSTLGDYDFWPGQFVLEKLAVDDSARCQRTGIVKDVDALERTVNVKWISPAGSDAVNYGRSGPTVETVSAYELVEHPDFSFCTGEVVIRSAVNIDKSEADLTNGSLASKEALDFLSCIGNVLGYKDDGIEVQWANGVISKVQHFEIIGLDKLLDSSLEPMHEEHVGDAVAMAEQEEMHHENANIALESTDCTGSLCKATAFLFPKTAFDFLTNVATSLFGAHGSPSPSSVVEDPQYQIIKTAEMQTSADELPEEKLTVELVAKVEKPNPSSEDSISKRFDVVTDCSDHHFVKEIGHENVTRGWVKKVQQEWTILQNDLPDGIHVRVFEERMDLLRACVVGAAGTPYHDNLFFFDIFFPPDYPHEPPSVHYHSGGLRLNPNLYESGKVCLSLLKTWTGTGNEVWNAENSTVLQLLLSLQALVLNEKPYFNEAGYDKFLGKADGEKNSITYNENAFLLSCKSMMYVLCKPPKHFEKMVKEHFTCRAPCILDACEAYLGGDLVGHAHDKTYISEDGSKSCSTGFKIMLGKLLPKLATAFSEAGITGG

SEQ ID NO: 4259 - protein, 950 aa, Setaria italica
HIPKEWKGRRILLHFEAVDSAFFAWVNGVPIGYSQDSRLPAEFEVTDCCHPCDSDKENVLAVQVMRWSDGSYLEDQDHWWLSGIHRDVLLLSKPQIFITDYFFKATMDENFSLADIEVEVEIDSHKQDREHVSTLSIEATLYDNSGPSISLDGDLSFANVVNLKPKPKTSRGPCLGFHGYVLGGKIENPKLWSSEHPNLYTLVVLLKDANGKLIECESCQVGIRNVVRAHKQMLVNGCPVVLRGVNRHEHHPRLGKTNIEACMIKDLILMRQNNINAVRNSHYPQHSRWYELCDIFGLYVIDEANIETHGFDENSHFKHPTLEPIWANAMLDRVVGMVERDKNHACIIVWSLGNESSYGPNHASMSGWIRERDPTRLLHYEGGGSRTSSTDIVCPMYMRVWDIIKIAKDPSETRPLILCEYSHAMGNSNGNIDAYWMAIDNTFGLQGGFIWDWVDQGLLKEDSDGSKFWAYGGDFGDTPNDLNFCLNGIVWPDRTIHPAVHEVKYLYQPIKISSADNMLKIENGHFFDTTEALDFSWVLQGDGCILGSGSLNVPTLAPQTSHLINMESSPWFALWSTCAVKEVFLSVNVKQRYHTRWAKDGHLLASAQLCLPQKNGFVPHAVAFSSSPLVCERTGDSVIISKNDAWKIKVNSQLGTIDSWKVSNVELMSKGIFPCFWRAPTDNDKGGFYTKPYVSQWREASLDNVSFYSSQFSVKELPDNTVELSTVYYGLPGNLPKPDDAALSQAPESTLFQVNMLCRIYESGDVVLEYEVNPKADLPPLPRVGVVFNAEKSLSHVMWYGRGPFECYPDRKAAAHVGVYESSVEDLHVPYIVPGECGGRADVRWVALRNADGLGLQASVHGESPPMQMSASYYGTEELDRATHVHKLVKGDDIEVHLDHRHMGLGGDDSWTPCVHEQYLLPPTRYAFSMRLCPLLPSSSCHDIYKSQLP

SEQ ID NO: 4260 - protein, 618 aa, Saccharum officinarum
  misc_feature (83)..(85): Xaa can be any naturally occurring amino acid
  misc_feature (91)..(91): Xaa can be any naturally occurring amino acid
  misc_feature (125)..(125): Xaa can be any naturally occurring amino acid
MLDRVVSMVERDKNHACIIVWSLGNESSYGPNHASMSGWIRERDPTRLLHYEGGGSRTSSTDIVCPMYMRVWDIVKIAKDPSXXXPLILCXYSHAMGNSNGNIDAYWMAIDNTFGLQGGFIWDWXDEGLLKEDSDGSKFWAYGGDFGDTPNDSNFCLNGIVWPDRTIHPAVHEVKYLHQPIKISSAENMLKIENGHFFETTEALDFSWVLHGDGCILGSGPLNVPTLAPQTSQLINMESSPWFALWSACAAKEVFLSVNVKQRHETRWAKAGHLLASAQLCLPQKNVFVPNVIAFSSSPLVCERIGDNVTICKNNAWKIKVNSQLGTIDSWKVNDVELMSKGILPCFWRAPTDNDKGGFFTKPYASRWREAFLDNVSFHSSQFSVKELPDNTVEFSTVYYGVPGHLPKPDDEASESILFRVKMVCRIHESGDVVLDYEVNPRADLPPLPRVGVVFSAERSLSNVTWYGRGPFECYPDRKAAAHVGVYESSVEELHVPYIAPVECGGRADVRWVALRDAGGLGLFATAHGGSPPMQMSASYYGAAELDRATHVHRLVKGDDIEVHLDHRHMGLGGDDSWSPCVHEQYLLPPTRYAFSLRLCPVLPTSSCRDIYRSQLPS

SEQ ID NO: 4261 - protein, 1029 aa, Triticum aestivum
SLSGHWKFRLAQSPETVPDKFYDAQFNDSDWEALPVPSNWQMHGFDRPIYTNVTYPFPMNPPFVPSENPTGCYRKVFHIPKEWKGRRILLHFEAVDSAFLAWVNGVPIGYSQDSRLPAEFEITDCCHHCDSDKENVLAVQVMRWSDGSYLEDQDHWWLSGIHRDVLLLSKPQIFITDYFFKATLDENFRVADIEVEVEIDSHKQDREHIPTLSIEATLFDNSESSDDLNSDMSAANIVNLKTKPKPKGGPCHGFHGYVLGGKVENPKLWSSEKPNLYTLVVLLKDANGKLIDCESCQVGIRNVVLAHKQMLVNGSPVVIRGVNRHEHHPRVGKTNLEACMIKDLVLMRQNNINAVRNSHYPQHPRWYELCDIFGLYVIDEANIETHGFDENSHFKHPTLEPIWANSMLDRVVGMVERDKNHACIIIWSLGNEASYGPNHSAMSGWVRGRDPTRLIHYEGGGSRTSSTDIICPMYMRVWDILKIANDPSENRPLILCEYSHAMGNSNGNIDAYWKAIDNTMGLQGGFIWDWVDQGLLKEDADGSKSWAYGGDFGDIPNDLNFCINGIVWPDRTLHPAVNEVKYLYQPIKISLVDNILKIENGKFSETTEALDFSWILHGDGSVWGSGSLSVPNLAPQSSHLINMESSPWFTLWSTCAAKETFLSVHVTLRDQTRWAKAGHVLASAQLSLPQTKGFVPHVIALSKSPLTSEQVGDGVIISKNHEWQIKINSQLGTIDSWKINNVELMSKGIFPCFWRAPTDNDNGGFYTKSYATTWREAFLDNVSFYSSQFSVKELPDHTVEVSTTYYGLPGHLPKPDDAALSEASESVLFRVHMRCRIYESGDVILDYEVNPKSDLPPLPRVGIVFNAEKSLNHVTWYGRGPFECYPDRKAAAHVGVYESSVEDLHVPYIVPGECGGRADVWWVALKNADGFGLFASTHGESPPMQVSASYYGAAELDRATHQHKLVKGDDIEVHLDHMHMGVGGDDSWTPCVHEEYLLSPAASYRFSLRLRPLSPSSSCHDIYSSRLPN

SEQ ID NO: 4262 - protein, 1024 aa, Brachypodium distachyon
MNGGTLAILIPSLLYGTMTLFVARWRAPRFVPSNWQMHGFDRPIYTNVTYPFPMNPPFVPSENPTGCYRKVFHIPKEWKGRRILLHFEAVDSAFLAWVNGVPIGYSQDSRLPAEFEITDCCHHCDSGKENVLAVQVMRWSDGSYLEDQDHWWLSGIHRDVLLLSKPEIFITDYFFKATLDENFLVADIEVEVEIDSHKQDREHISTLSIEAKLFDNSVPSGGLNSDMSAANVVNLKAKPKPKPSHCHGFHGYVLGGKVENPKLWSSEKPNLYTLVVLLKDAKGKLIECESCQVGIRGVVLAHKQMLVNGCPVVIRGVNRHEHHPRVGKTNIEACMIKDLVLMRQNNINAVRNCHYPQHPRWYELCDIFGLYVIDEANIETHGFDESSSFKHPTLESIWTNCMLDRVVSMVERDKNHACIIVWSLGNESSYGPNHSAMSGWVRGRDPTRLIHYEGGGSRTSSTDIVCPMYMRVWDILKIANDPSENRPLILCEYSHAMGNSNGNIDAYWMAIDSTMGLQGGFIWDWVDQGLLKEDVNGSKFWAYGGDFGDTPNDSNFCLNGIVWPDRTIHPAVYEVKHLYQPIKISLMDNTLKINNAQFSETTEALDFSWILHGDGCVLGSGSLDLPDIAPQSSHLINMQSSPWFTLWSACAAKETFLSINVKLGGQTRWSKDGHILASAQLCLPQTNSFVPHVIALSRSPLVSEHVGDSVIISKNKDWQIKVNTRSGTIDSWKINNIELLSKGILPCFWRAPTDNDNGGFYTKSYATRWREAFLDNIVFRSSQFSVKELPDHAVEISTTYYGLPGHLVKPDDAALSEAPESTLFQVPMRCRMYESGDVILEYEVNPKSDLPPLPRIGIVFNTEKSLSHVTWYGRGPFECYPDRKAAAHVGVYESSVEDLHVPYIVPGECGGRADVRWTALRNAEGFGLFASVHGESPPMQMSASYYGAAELDRATHKHKLVKGDDIEVHLDHRHMGLGGDDSWTPCVHEQYLLPPDRRYAFSVRLRPLLPSTSCDDIYRSQLPH

SEQ ID NO: 4263 - protein, 99 aa, Saccharum officinarum
  misc_feature (83)..(83): Xaa can be any naturally occurring amino acid
  misc_feature (88)..(88): Xaa can be any naturally occurring amino acid
FSPAPSSSRSPGGGRSISRLPARVAGAVVRSLLTVVFAAVGMVLGAVTGALIGLATESGLVRGPASGPSPAPSCPWRSSTLRXHLALXRVRDLERPICA

SEQ ID NO: 4264 - protein, 188 aa, Zea mays
FVAVGMVLGAVTGALIGLATESGLVRGAGVGAISGAVVSMEVVDSSVAIWRSDESGIWSVLYVLDVLWSLVTGRLVREKVDPAVQSAVDSQMNAADSQDTAPTLADMFETAAAGMPAAAIAALPVTAVTESTVTDASGEPIGCPICLQDFEAGETARRLPECGHTFHLPCIDVWLLRHASCPLCRRAV

SEQ ID NO: 4265 - protein, 230 aa, Saccharum officinarum
MEAAAIFGTASASFSPAPSSSRSPGGGRSISRLPARVAGAVVRSLLTVVFAAVGMVLGAVTGALIGLATESGLVRGAGIGAISGAVVSMEVVDSSVAIWRSDESGIWSVLYVLDVLGVCSPAAWCARRGPRRASAVDSQMNAADSGDKTAPTLADMFETGAAAAAKGMPAAAIAALPVTAFTEHTVADASGEPIRCSVCLQDFEAGETARTLAECGHTFHLPGHDVWLVR

SEQ ID NO: 4266 - protein, 251 aa, Panicum virgatum
  misc_feature (43)..(43): Xaa can be any naturally occurring amino acid
  misc_feature (74)..(74): Xaa can be any naturally occurring amino acid
AFSPSTPAAPSGGAGGGGRSISRLLPARVAGAVARGVVTVVFXAVGVVLGAVTGALIGLATESGLVRGAGVGAXSGAVVSMEVVDSSVAIWRSHDSGIWSVLYVLDVIWSLLTGRLVREKVDPAVQSAVDSQMNAVDSPFGEMAPTLADMFETGAAGAAKGMPAAAIEALPSVTFTERAATGDDRDRLLRLPPGIRGRRDGAELAGVRAHVPPAVHRRLAAPPRVVPAVPPRGRGRCRACRAPARGVQWLA

SEQ ID NO: 4267 - protein, 243 aa, Cenchrus ciliaris
  misc_feature (132)..(132): Xaa can be any naturally occurring amino acid
MEAVSSASTSFSPSTPLAAASSGSGRGSSVSRLPARVARAVLRGVLTFVFAAVGMVLGAVTGALIGLATESGLVRGAGIGAISGAVVSMEVVDSSVAIWRSHDSGIWSVLYVLDVIWSLLTGRLVREKVDPXVQSAVDSQMNAVDSPFTETTPTTLADVFETGAKGMPAAAIEALPVTTFTTEDAAATGDHDGDRAGCSVCLQDFEAGETARRLPECGHTFHLPCIDVWLLRNASCPLCRRAV

SEQ ID NO: 4268 - protein, 439 aa, Sorghum bicolor
MASLAVLVSLVCAALASNAAAVRVELTRIHADPSVTASQFVRDALRRDMHRHNARQLAASSSNGTTVSAPTQISPTAGEYLMTLAIGTPPVSYQAIADTGSDLIWTQCAPCSSQCFQQPTPLYNPSSSTTFAVLPCNSSLSMCAAALAGTTPPPGCTCMYNMTYGSGWTSVYQGSETFTFGSSTPANQTGVPGIAFGCSNASGGFNTSSASGLVGLGRGSLSLVSQLGVPKFSYCLTPYQDTNSTSTLLLGPSASLNDTGGVSSTPFVASPSDAPMSTYYYLNLTGISLGTTALSIPTTALSLKADGTGGFIIDSGTTITLLGNTAYQQVRAAVVSLVTLPTTDGGSAATGLDLCFELPSSTSAPPTMPSMTLHFDGADMVLPADSYMMLDSNLWCLAMQNQTDGGVSILGNYQQQNMHILYDVGQETLTFAPAKCSTL

SEQ ID NO: 4269 - protein, 399 aa, Hordeum vulgare
MNGSTGSPGNHVNGKQVQSVDPPGLSSFNSGPRHRPLTVLRRCRGVLCLVIMPVTACMMMVYLAPMTTFVVRLFSVHYSRKWTCFLFGMWLAMFPFLFEKINRTRFVFSGEKVPPKECVLLFANHRTEVDWMYLWDLALRKGRLQSIKYILKKSLMKLPIFNWAFHIIEFIPVERNWEVDEPLIRRRLSELKNPKDPLWLAVFPEGTDYTEKKCIKSQEYAAEHGLPILKNVLLPKIKGFNCCLQELRSNLDAVYDITIAYKHRLPTFMDNVYGVDPSEVHVHTKIIQVSDIPTAEDEVSDWLTERFRLKDELLSDFSTRGHFPNEGTEEELPTLKCVANFAAVMGMTGVFIYLTLFSSVWFRVFAACSASFLTFATLYSVHAPQIVCLPEAGVHAKKA

SEQ ID NO: 4270 - protein, 399 aa, Triticum aestivum
MNGSTGSLGDHVNGKQVQSVDPPGLSSFNNGPRHRPLNALRRCRGVLCLVIMPVTACMMMVYLAPVTTFVVRLFSVHYSRKWTCFLFGMWLAMFPFLFEKINRTRFVFSGEKVPPKECVLLFANHRTEVDWMYLWDLALRKGRLQSIKYILKKSLMKLPIFNWAFHIIEFIPVERNWEVDEPLIRRRLSELKYPKDPLWLAVFPEGTDYTEKKCIKSQEYAAEHGLPILKNVLLPKIKGFNCCLQELRSNLDAVYDITIAYKHRLPTFMDNVYGVDPSEVHVHTKIIQVCDIPTAEDEVSSWLTERFRLKDELLSDFLAQGHFPNEGTEEDLSTLKCVANFLAVIGMTAFFIYLTLFSSVWFRVFAACSASFLTFATVYSVHAPQIVCLPEAGAHAKKA

SEQ ID NO: 4271 - protein, 398 aa, Brachypodium distachyon
MNGSTGSRNHVNGKQAQSVDSPRPSMLNNGPKHRPLTTFRRCRGVLCLVIMLLTAFMMMVYLAPVTTFLLRFFSVHYSRKWTCFMFGMWLAMFPFLFEKINRTRFVFSGESVPPKECVLLFANHRTEVDWMYLWDLALRKGRLQSIKYILKKSLMKLPVFNWAFHIIEFIPVERNWEIDEPLIRSRLSGLRNPKDPLWLAVFPEGTDYTEKKCLKSQEYAAEHGLPILKNVLLPKIKGFNCCLQELRSSLDAVYDITIAYKHRLPTFLDNLYGVDPSEVHIHAEIIQVSDIPTSEDEVSDWLTERFRLKDELLSDFLKLGHFPNEGTEEDLSTFKCLANFVAVISMSSFFMYLTLFSSVWFKVFVVCSASFLTLATCYSIHMPQLICLPEVGSHAKKS

SEQ ID NO: 4272 - protein, 353 aa, Avena sativa
MNGSPASQGNHVNGKQVQSADPPILSVFNNGPRHRPLTALRRCRGILCLVIMPLTAFMMMVYLAPVTTFVVRLFSVHYSRKWTCFLFGMWLAMFPFLFEKINRTRFVTSGEKVPPKECVLLFANHRTEVDWMYLWDLALRKGRLQSIKYILKKSLMKLPIFNWAFHIIEFIPVERNWEIDEPQIRRKLTGLKNPKDPLWLAVFPEGTDYSEKKCMKSQEYAAEHGLPILKNVLLPKIKGFNCCLQELRSNLDAVYDITIAYKHRLPTFMDNVYGVDPSEVHIHTEIIQVSDIPVPEDEVSDWLMERFRLKDELLSEFLKLGHFPNEGTEEEMSTLKCVANFVAVIGMTGSSAT

SEQ ID NO: 4273 - protein, 355 aa, Saccharum officinarum
AVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELITGRKPVGEFGDGVDIVQWVRMVTGSSKEGVMKIADPRLSTVPLYELTHVFYVAMLCVAEQSVERPTMREVGQILADMPGSTSTSIDVPLVIEPKEDGSPGEQQQEGPHESPPQQDLLSI

SEQ ID NO: 4274 - protein, 355 aa, Panicum virgatum
  misc_feature (91)..(91): Xaa can be any naturally occurring amino acid
AVLKARSLKRSAEARAWRLTAFQRLDFAVDDVLDCLKEENVIGKGGSGIVYKGAMPGGAVVAVKRLPAIGRAGAAHDDYGFSAEIQTLGRXRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELITGRKPVGEFGDGVDIVQWVRMVTGSSKEGVMKIADTRLSTVPLYELTHVFYVAMLCVAEQSVERPRMREVVQILADMPGPTSSSVDGPLVIEPKEDSSTEKPPQEGPHDSPPQQDLLSI

SEQ ID NO: 4275 - protein, 267 aa, Sorghum bicolor
APALAPATASVRPRIHRRVSRCGHGCRGWPQRPWSPSARAIKAAAAARPSSTRRRRHSRLEAPHPHQAPRPRPRPAHLHHRARSRRDAVDRHHDVARNCVARASRPRHHLGTRTAPSPSSSRAAAMASPCRRRQAPLRPPRPCPYLCVKLHHHAGVSRGAVLAAQRPRPATSSPLPSPRRASTTAGRVDATARPSLCLATVGVAAATTPSAPAPLRVYDGVDREPPCCHGAYLVEPTRRRQSHRCRAPGTRASPFAEHPMRPVAAAT

SEQ ID NO: 4276 - protein, 274 aa, Zea mays
MTVTVAAAKSTLRTCPGARRAAVLGRWMPLAPAAPANLKLFSPAVRVPRATSPAAVEDGSNTDIVPIPKVIIDQDSDPDATIVEITLGDRLGDLLDTMSALKNLGLNVVKASVCLDSTGKHIKFAITRAFTGRKIDDPELLEAVRLTIINNMIQYHPESSSQLAMGATFGPEAPTEEVDVDIATHIDIYDDGPERSLLVVETADRPGLLVDLVKIISDISINVQSGEFDTEGLLAKAKFHVSYRGRTLTEALQQVLCNSLRYFLRRPTTEDASF

SEQ ID NO: 4277 - protein, 278 aa, Setaria italica
MAVAVAAGTLRTCSGVFPAASGNHPLAGWRPLAPAAPAKLRLLSPALRVPRAASPAAVENGSSSNSNTVPTPKVIIDQDSDPDATIVEVTLGDRLGDLLDTMNALKNLGLNVVKASVCLDSTGKHNKFAITKASTGRKIDDPELLEAVRLTIINNMIQYHPESSSQLAMGATFGPEAPAEQVDVDIATHIDIYADGPERSLLVVETADRPGLLVDLVRIISDINITVQSGEFDTEGLLAKAKFHVSYRGKHLTEALKQILSNSLRYFLRRPTTEDASF

SEQ ID NO: 4278 - protein, 278 aa, Avena sativa
MAVTVAAGTLRPCSGVSPAASGNRRLAGWRPLAPAAPAKLRLPSPALRVPRAASPAAVEDGSSSNTDTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGATFGIEPPTEVVDVDIATHIDIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4279 - protein, 278 aa, Brachypodium distachyon
MAVTVAAGTHRPCSGVSPAASGNRRLAGWRPLAPAAPAKLRLSSPALRVPRAASPAAVEDGSSSNTDTVPTPKVIIDQDSDPDATIVEVTLGDRLGDLLDTMSALRNLGLNVVKASVCLDSSGKHNKFAITKSSTGRKIDDPELLEAVRLTIINNMLEYHPETSSQLAMGATFGIEPPTEVVDVDIATHIDIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4280 - protein, 276 aa, Panicum virgatum
MAVTVAAAAGTLRPCTGVSARGAAVLGRWRPLALAAPAKLRLSFSAVRVPRATSPAAVEDGSNTDTDPIPKVIIDQDSDPDATIVEVTLGDRLGDLVDTMSALKNLGLNVVKASVCLDSTGKHNKFSITKSSTGRKIDDPELLEAVRLTIINNMIQYHPESSSQLAMGATFGPEVPAEQVDVDIATHVDIYDDGPERNLLVVEAADRPGLLVDLVKAISDTNVTVQSGEFDTEGLLAKAKFHVSYRGKAVSKALQQVLSNSLRYFLRRPTTEDASF

SEQ ID NO: 4281 - protein, 278 aa, Triticum aestivum
MAVAVAAGTLRTCSGVFPAASGNHPLAGWRPLAPAAPAKLRLLSPALRVPRAASPAAVENGSSSNSNTVPTPKVIIDQDSDPDATIVEVTLGDRLGDLLDTMSALRNLGLNVVKASVCLDSSGKHNKFSITKSSTGRKIDDPELLEAVRLTIINNMLEYHPEASSQLAMGATFGLEPPTEVVDVDIATHIEIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4282 - protein, 278 aa, Triticum aestivum
MAVAVAAGTLRTCSGVFPAASGNHPLAGWRPLAPAAPAKLRLLSPALRVPRAASPAAVENGSSSNSNTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGATFGLEPPTEVVDVDIATHIEIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4283 - protein, 278 aa, Pseudoroegneria spicata
MAVAVAAGTLRTCSGVFPAASGNHPLAGWRPLAPAAPAKLRLLSPTLRVPRAASPAAIENGSSSNTDTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGATFGLEPPTEVVDVDIATHIEIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4284 - protein, 278 aa, Leymus cinereus x Leymus triticoides
  misc_feature (171)..(171): Xaa can be any naturally occurring amino acid
MAVSVAAGTLRTCPGVFPAASGNHPLAGWRPLAPAAPAKLRLLSPALGVPRAASPAAVENGSSSNTDTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGXTFGLEPPTEVVDVDIATHIDIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4285 - protein, 278 aa, Hordeum vulgare
MAVAVAAGTLRTCSGVFPPASGNHQLARWRPLAPAAPAKLRLLSPALRITSAASPAAVENGSSSNTDTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGATFGLEPPTEVVDVDIATHIEIYDDGPERSLLVVESADRPGLLVDLVKIIADINITVQSGEFDTEGLLAKAKFHVSYRGKPLIKALQQVLANSLRYFLRRPTTEDASF

SEQ ID NO: 4286 - protein, 257 aa, Pennisetum glaucum
VRSAAVLGRWRPLAPAAPAKLRLSSPAVRVPRAASPAAVEDGSNTDTVPIPKVIIDQDSDPDATIVEVTLGDRLGDLLDTMDALKNLGLNVVKASVSLDSTGKHNKFSITKTSTGRKIDDPELLEAVRLTIINNMIQYHPESSSQLAMGATFGPEAPAEQVDVDIATHIDIYADGPERSLLVVEAADRPGLLVDLVRIISDINITVQSGEFDTEGLLAKAKFHVSYRGKSLTEALKQVLSNSLCYSLRRPSTEDASF

SEQ ID NO: 4287 - protein, 402 aa, Zea mays
MKEFSYEEVEAATGGFAAKNLVGKGSHGSVYRARLKEEGGRTAVVAVKRPSHAQGEAKLGNEIAVLSAAPRHPGVIGIVGVSSSPAGAAAPGPRLPPLLVMEFMPNGSLHDLLHRSPRPPPWPRRVEIALDVARAVRALHAAAPRVIHRDVKSANVLLGRDGRARLADFSLAVSVQDDDEGEGSASAGPAPAPAPAGTIGYLDPCYTEAGRLGPASDVFSFGVVLLELVSGRRVMDVDSCPSSIVSWAAPLIGAGRAREVLDGRVAAPPTACADRVLAVAARCVSDSAELRPAMDEVVSELRGALESAGWRRHRDGGVVERVCRRVASWGQRARRRSKRRVRATATKVECAEHSGGGVALAVAPDRDGSSRNNGMVSGAAAHSKAEEDALARFESELDLVFR

SEQ ID NO: 4288 - protein, 827 aa, Zea mays
MATRAGRLPTTPAPALLLLLAFPFLLQGVLPSRAGDTVAAGRPLSGGQSLVSKRGKFRLGFFRPGATDNSSQRWYLGIWYNQLSVHTTVWVANRGTPISDPESSQLSISKDGNMVVLDHSRSSTAVWSTNVTTGVSSTSTVGVIRDNGNLVLADASNTSAVLWQSFDHSGDTWLPGGKLGRNKRTGEVTRLVAWKGRDDPTPSLFALELDPRGSSQYLLNWNDSERYWTSGNWTGTAFAAVPEMTSTGASPVSDYTFGYVDGANESYFTYDVADESVVTRFQVDVTGQIQFLTWVAAAAQWVLFWSEPKRQCDVYAVCGPFGLCTENALPSCTCPRGFRERDLAEWMQDDHTAGCARNTALQPCGAGAAARDGQKRRRDDDRFYTMPDVRLPSDARSAAAASAHDCELACLRNCSCTAYSYSGGCSLWYGDLINLQDTTSAGSGTGGGSISIRLAASEFSSNGNTKKLVIGLVVAGSSFVAAVTAIVLATVLVLRNRRIKSLRTVQGSLVAFTYRDLQLVTNNFSEKLGGGAFGSVFKGVLPDATLVAVKKLEGVRQGEKQFRAEVSTIGTIQHVNLIRLLGFCSEGSRRLLVYEHMPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLLDGDVRSAVDSQLGGNADVAEVERACKVACWCVQDAESLRPSMGMVVQVLEGLVDVNAPPVPRSLMVLADPSKYAVEFFSGLPST

SEQ ID NO: 4289 - protein, 824 aa, Zea mays
MATRAGRLPTTPAPALLLLLAFPFLLQGVLPSRAGDTVAAGRPLSGGQSLVSKRGKFRLGFFRPDNSSQRWYLGIWYNQLSVHTTVWVANRGTPISDPESSQLSISKDGNMVVLDHSRSSTAVWSTNVTTGVSSTSTVGVIRDNGNLVLADASNTSAVLWQSFDHSGDTWLPGGKLGRNKRTGEVTRLVAWKGRDDPTPSLFALELDPRGSSQYLLNWNDSERYWTSGNWTGTAFAAVPEMTSTGASPVSDYTFGYVDGANESYFTYDVADESVVTRFQVDVTGQIQFLTWVAAAAQWVLFWSEPKRQCDVYAVCGPFGLCTENALPSCTCPRGFRERDLAEWMQDDHTAGCARNTALQPCGAGAAARDGQKRRRDDDRFYTMPDVRLPSDARSAAAASAHDCELACLRNCSCTAYSYSGGCSLWYGDLINLQDTTSAGSGTGGGSISIRLAASEFSSNGNTKKLVIGLVVAGSSFVAAVTAIVLATVLVLRNRRIKSLRTVQGSLVAFTYRDLQLVTNNFSEKLGGGAFGSVFKGVLPDATLVAVKKLEGVRQGEKQFRAEVSTIGTIQHVNLIRLLGFCSEGSRRLLVYEHMPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLLDGDVRSAVDSQLGGNADVAEVERACKVACWCVQDAESLRPSMGMVVQVLEGLVDVNAPPVPRSLMVLADPSKYAVEFFSGLPST

SEQ ID NO: 4290 - protein, 1023 aa, Oryza sativa
MDEMSCGGGGGGARWKRARVAGMGEGKAGGGGGAAFLGLERVGMVVRMLPVPEKVSARARVVRGSLVAHFRGWRVVRETWWWVLLLWILAGSLGSFYLFLFMNAQSLDKRRDSLASMCDERARMLQDQFNVSMNHLQALAILVSTFHHSKTPSAIDQMTFARYAERTAFERPLTSGVAYAVRVTHGEREQFERQQGWAIKKMYSSSNKKQSSPGPGPGDAAVAEIREPAEEYAPVIFAQDAYKHVISFDMLSGNEDRDNILRARKSGKGVLTAPFKLLNNRLGVILTYTVYKYELPAYARPHERIQAAIGYLGGIFDIQALVEKLLKQLASQESIMVNVYDTTNESPISMYGDDTGSGMCHVSVLNFGDPSRKHEMHCRFEKKPPWPWLAITSSFGTLVIALLTGHIFQATVHRIAKVEDDFHKMSELKKRAEDADVAKSQFLATVSHEIRTPMNGVLGMLQMLMDTDLDTTQQDYVRTAQASGKALVSLINEVLDQAKIESGKLELETVPFDLRTVCDDILSLFCGKAQEKGLELAVYVSDQVPQILIGDPGRIRQIITNLVGNSIKFTERGHIYLTVHVVEEVMSCLEVETGIQNTNTLSGYPVANRRCSWESIRLFNRELHSSEKSFAPIASDSISLVISVEDTGVGIPFEAQSRVFTPFMQVGPSIARIHGGTGIGLSISKCLVGLMKGEIGFASKPHVGSTFTFTAVLMRAHCKGNDIKSSEFKGINALVVDHRPVRAKVTKYHLQRLGVKTELTAELNQFISKLNSGSLTAKLVLIDKETWLKESHCTPLLVNKLRNNDKPDSPKLFLLGSSASSPKGGSDTSREHNLNVIMKPLRASMLQVSLRRALGGVDKVHCRNGVVGNSTLGSLLHKKQIIVVDDNIVNLKVAAGALKKYGAEVTCADSGKKAITLLKPPHNFDACFMDIQMPEMDGFEATRRIRVMERDLNERIERGEAPPECASIQRWRTPILAMTADVIQATHEECLKSEMDGYVSKPFEGEQLYSEVARFFQNHDQVE

SEQ ID NO: 4291 - protein, 1019 aa, Brachypodium distachyon
MTGARLARGGGGAAGTTTMEAEKGGGAGIGVGFLGMGLYRLRLLPLPPLPEKLSSAKTLRSHVYANYLGSRPVRERWWRWLLLLWVLGWTLASCWIFYYENSQAVEKRRESLASMCDERARMLQDQFNVSMNHLQALAILVSTFHHAQTPSAINQATFARYAERTAFERPLTSGVAYAVRVTHGERDQFERQQGWSIKKMYSSKKKSPGPGPGDAATAEIREPAEEYAPVIFAQDAYKHVLSFDMLSGDDDRENILRARESGKGVLTAPFKLLNNRLGVISTYTVYKSEFPAYARPQERIQAAIGYLGGIFDIEALVDKLLHQLAGKQSIMVNVYDTTNEKPISMYGSNDTGGGMYHNSTLNFGDPSRRHEMHCRFMQKPPLPWLAITSSLGTLVIALLTGYIFHATVHRIAKVEDDYQNMMELKKRAEAADIAKSQFLATVSHEIRTPMNGVLGMLQMLMDTDLDTTQQDFVRTAQASGKALVSLINEVLDQAKIESGKLELEAVPFDLRIVCDDILSLFCGKAQEKGLELAVYVSDQVPQTLIGDPGRMRQIITNLMSNSIKFTERGHIYLTVHVVEEVMGCLEVKTGTHYTNTLSGYPVANRRRSWESFRLFDMDLHSSEMPFTPVTPDTIRLIISVEDTGAGIPFEAQYRIFTPYMQVGPSIARIHGGTGIGLSISKCLVHLMKGEIGFVSKPHVGSTFSFTAVLTRAQSNGNLNKSSGFKGINALVVDHRPVRAKVAKYHLQRLGVQTELTTDVNQIIPKLNCGPLAAKLVLVDKETWLKESHSMPHLVSKLRNKDQADPPKFFLLENPTSSIKSSSHISSEHNLNVIKKPLRASMLQVSLRQALGGVDKVHCKNGVVGNSTLGSLLHKKQIIVVDDNAVNLKVAAGALKKYGAVVTCADSGKKAIAYLSPPHIFDACFMDIQMPEMDGFQATKEIRKMESKLNEKIESGDVPPECVNVRRWRTPILAMTADVIQATYEECLKCEMDGYVSKPFEGEQLYREVTRFFQNHDQVQ

SEQ ID NO: 4292 - protein, 770 aa, Pennisetum glaucum
EDRENVLRARESGKGVLTAPFKLLNNRLGVISTYTVYKTELPPNASPQERIQAAIGYLGGIFDIEALVDKLLHQLAGKQSIMVNVYDTTNESPISMYGSNDTASDMCHVSTLNFGDPSRKHEMHCRFMQKPPVAWLAITSSFGSLVIALLVGYIFHATVKRIVKVEDDYQRMIELKKRAEAADVAKSQFLATVSHEIRTPMNGVLGMLQMLMDTDLDTTQQDYVRTAQASGKALVSLINEVLDQAKIESGKLELEMVPFDLRTVCDDILSLFCGKAQEKGLELAVYVSSRVPETLIGDPGRMRQIITNLVGNSIKFTERGHIYLTVHLVEEVMHCLEVETGTQNASTLSGYPVVNRKRSWENFRLFNMELNSSEVPFAPVGSDSVSLVISVEDTGVGIPFEAQSRVFTPFMQVGPSISRIHGGTGIGLSISKCLVGLMKGEIGFASKPQVGSTFTFTAVLTKAYSSGIENKSSEFKEINALVVDHRLVRAKVTKYHLQRLGVQTELTADLDQYISKVNSGLRIAKLVLIDKETWLKESHSIPLLVSKLSNKDQPDSTKLFLLENPKNSLRTKSHISRECNLTVIMKPLRASMLQASLQRALGGIDKVHCRNGVVGNSTLGSLLHKKQIIVVDDNIVNLKVAAGALKKYGAEVTCADSGKKAIALLKPPHNFDACFMDIQMPEMDGFEATRRIRLMESDLNEQIERGQVPPECANIRRWRTPILAMTADVIQATHEHCLKCEMDGYVSKPFEGEQLYSEVARFFLNQDQVL

SEQ ID NO: 4293 - protein, 645 aa, Zea mays
MSKANLMKYYADAKLSALMSFLKFLSVYKGAISNKNLDLPDGGISVAATQSAIKCACKSFESTVDSLLPQAHTDEVLFPLLSGQVELLLTLARILFHQAKNKKSSHLCPDIVLLMKTSGASTCLFVDLMPSAHALKQPVKTLLVLLLSSYEFMYSKVDIKDLPNDINIFGELALLSVSLLPILCKLAENRECSDLAVASMDLILKGSVPSNLWMPILQKHFHLQTILHKCQNGDLLSTQVILNFLLTLGRTKDGAKVLQSANIFAFLKLLLSQLSLDDSCLRNSLSAQVKDVNLWGLGLGIVASLNHCLDDDISHNNVVSNTISFLSGHVPLVSSYLSTQSATTHQSKKRALSQKSQTSLSALSLTENILILLCILAKYHFPRDTGKKEVDSELREIIIHLLAFISKGSVKTGNASKWNSSFFCPAVIKEEVALNEKPPLICSKYGWFRFAASCTLSTAGVSVSPSAALSVVRRDKTSGDSDSIRQTRFTEILAVQIYRIAFLIMKFLCSQAKEAVKRAEELEFLDLAHFPELPMPDILHGLQDQVVCIVTEIFEANGSSTLNPETEKVCQLLLVTLETSLYMELCVSQSCGIRPVLGRLEDFCKGIKAMLQAIEKHSSFEPFVRSLTEITSLLYPGLLHNNLLM

SEQ ID NO: 4294 - protein, 868 aa, Saccharum officinarum
  misc_feature (121)..(121): Xaa can be any naturally occurring amino acid
  misc_feature (233)..(233): Xaa can be any naturally occurring amino acid
  misc_feature (315)..(315): Xaa can be any naturally occurring amino acid
  misc_feature (542)..(542): Xaa can be any naturally occurring amino acid
MSHELFLQGKLLAETSNTVQDDPKGQKEHKSGPCHSSVVLKWFDNAILDDLISNLSSNAYKKELLHHAKVAACLCIIHLITKLSTGDTGSLSFSFVKKIQIISTKLSQHHAFLALLSQYSXHGYSGEQELNNLVINDLYYHIRGELEGRQISSGPFQELLGFLLEFKLFEHNPLEQLQNTYLMPNDKFVFDVEHIHDELGVDLWTDSDRKRSKEVAKKMLDIMRKANLMKCYXDAKLSALRSFLTFLSVYTGAVSNKNLDLPDGGISVAATQSAIRYACKSFKSAVDSLLPQADTNEVLFPLLSGQVELLLTLAXILFYQAKKNKKSSHLCPDIVLLMKTSGASTSFLVDLMPSAHALKKPVKALLVLLLLSYEFMYSKVHIKDLPNDVNMFGELALLSVSLLPILCKLAENRECSDLAVASMDLILKGFIPSNVWVPILQKHFHLQAILHKCQNGDLLSTQVILNFLLTLGRTKDGAKVLQSANIFAFLKVLLSQLSLDDSCLRNSLSAQVKDVNLWGLGLGIVASLNHCLDDDISHNNVXNSTISFLSGQVPLMSSYLSAQSAATHQSKKRALSQKSQTSLSALSLTENILILLCILAKYHFPRDTGKKEVDSELREIIIHLLAFISKGSVKTGDASNWNSSFFCPAVIKEEVALNEKPPLICSKYGWFKFAASCTLSTAAVSVSPSAALSVVRRDKSSGDSDSIRQTRYTEILAVQIYRIAFLIMKFLCSQAKEAVKRAEELEFLDLAHFPELPMPDILHGLQDQVVCIVTEVFEANGSSTLIPETEKVCQLLLVTLETSLYMELCVSQSCGIRPVLGRLEDFCKGMKAMLQAIEKHSSFKPFVRSLTEITTLLYPGLLHSNLLM

SEQ ID NO: 4295 - protein, 1089 aa, Zea mays
LCLYLSNVFIVETEDPHLFLKGMQVAAARAFSALCFIAYKAQPQLMENASFTSDVSEIRRLESNISCILDEDDKNNDCLVVAVFNLLTSAARYQPAFLISLIEQSTKSTDHNASTNDRDNRVLVTSKSNARLVDQILDYIDRSIELMNRSPLVLLSILDLLKALWESGIRFLFILEKLRSSVTFWDNLSRCIRATLDISPIDNIDAIDEKFSLRYHCQGKIFEIMSHELFLQGKLLTETSNTVQDDPKGQKEHKSGPCRISVVLKWFDNAILADLVSNLSSNAYKKELHHAKVAACLCIIHLITKLSTGDTGSLSFSFMKKIQIISTKLLQHHAFLALLSQYSLHGYSGEQELNNLVLNDLYYLIRGELEGRQISSGPFQELLSFLLGFRIFEHNPLEQLQNTYLMANDKFLFDVEHIHDELGVDLWTDSDKRSKEVAKKMLDIMSKANLMKYYADAKLSALMSFLKFLSVYKGAISNKNLDLPDGGISVAATQSAIKCACKSFESTVDSLLPQAHTDEVLFPLLSGQVELLLTLARILFHQAKNKKSSHLCPDIVLLMKTSGASTCLFVDLMPSAHALKQPVKTLLVLLLSSYEFMYSKVDIKDLPNDINIFGELALLSVSLLPILCKLAENRECSDLAVASMDLILKGSVPSNLWMPILQKHFHLQTILHKCQNGDLLSTQVILNFLLTLGRTKDGAKVLQSANIFAFLKLLLSQLSLDDSCLRNSLSAQVKDVNLWGLGLGIVASLNHCLDDDISHNNVVSNTISFLSGHVPLVSSYLSTQSATTHQSKKRALSQKSQTSLSALSLTENILILLCILAKYHFPRDTGKKEVDSELREIIIHLLAFISKGSVKTGNASKWNSSFFCPAVIKEEVALNEKPPLICSKYGWFRFAASCTLSTAGVSVSPSAALSVVRRDKTSGDSDSIRQTRFTEILAVQIYRIAFLIMKFLCSQAKEAVKRAEELEFLDLAHFPELPMPDILHGLQDQVVCIVTEIFEANGSSTLNPETEKVCQLLLVTLETSLYMELCVSQSCGIRPVLGRLEDFCKGIKAMLQAIEKHSSFEPFVRSLTEITSLLYPGLLHNNLLM

SEQ ID NO: 4296 - protein, 640 aa, Pennisetum glaucum
MKCYADAKLSTLRSFLTFLSVYTGASSNKNLDLPNGGISVPATQSAVKCACKSFQSTVDSLLPQVDTNEVLFPLLSGQVELLLTLARILFDQAKKNKKSSHLYPDIVLVMKTSGASTSFLVDLLSSTHALKQSVKALLALLLSSYEFMYSKVGIKDLPDNVNMFGELAVLSVSLLPVLCKLAENGEFSDLAVASMDLILKGFVPSEVCVPILQKHFHLQAILHKCQHGGLLSTQVILNFLLTLGRTKDGATVLLSANIFTFLKVLLSQLSLDDSCLRYSLSAQVKDVDQWGLGLAIVASLNHCLDDDISRNNVASSTISFLSGQVPLMSSYLSAQSVTAHQNKKRALSQKSQTSLSALSLTENILILLCILAKYHFPRDTGKKEVDSELREIIIHLLAFVSKGSVKAGNSSNWNSSFFCPDAAKEELVLNEKPPHIRSKHGWFKFAASCTLSVAGASVSASTALPLVIRDKSSGDSDSIRQTRFTEMIAVQIYRIAFLIMKFLCSQAKEAVKRAEELEFLDLAHFPELPMPDILHGLQDQVVSIVTEVFEAKESNTLNPETERVCHLLLVTLEMSLYMELCVSQSCGIRPVLGRFEDFCKGIKAMLQAIEKHSSFKVLVRSLTQITTLLYPGLMQTNLLM

SEQ ID NO: 4297 - protein, 1041 aa, Sorghum bicolor
MPVIAFAHVLYHSFKMNYIEKYCLSELFRYMPVIDSGGCVVKERKSIIVPAKGSKWADLLGSNPWRNIGYIELLASGGHFAGNYTSKDQLLEFLKIHLHASDVPFIRPPNARFHTVSSPLTVDNAFLLLEWIRNIKSDGVSLPDRFLACVKEGNWLKTSVGYKPPNESFLSSANWGSLLQSGTSFIDIPMIDQQFYRNKLHMYKQELKAIGVRFEFQEASSYIGSRLMSMAASNVLARDCVYSLLRLIRFLREKVLSPSQLIDSASSDCIIKDSEWAVASCISDQPFLDVKFYGEGILSYKSELELLGVIVGFKNNYHLVIDNFKFRSSAITSESTVLILKCIRYVSSCQDFIKKLRDLKWVKTNVGFCAPNVSFLVDSEWECLVQIFKEVPIIDLGFYGSVISSYKEELKKAGLITRFEEASIAIANVFNRMVSESSLTKANVLALLLAYRQLRTHRPLPVELFNCMRTEKWIHTSLGFQSPSNTILFDNAWQYLSPIAILPFIDDGDTCNGLGTDIYGYKDELRELGVTVEVKFGARFVLAGLSIPHDPSIMSKATILSFLECIKNYFASATEPPKGFKDQISKKWLKTSLGYQCPAECILFDAKQCFLQMEDGPFIDEAFYGSDIASFKHPLAMIGVTVDVNCAQDLIARYMRNKKDTNTISRIYMYLKKCNWKPDKNNNRKWIWIPKETEGGDWVSSKSCVLHDKNNLFGLQLHVLDKYYDRKLLDFFSLAFSVRHGPCSEDYCKLWATWESSVHELAISDCFAFWKFIATNWTKKTEELLSGCVKVPVCTDGKIILINKENVFIPDDLLLADLFSEHPQQSLFIWYASSAVPSMSRARFNCIYGSIGVKTISKAVTKNDSFPSANSRFKTVVLSKVIKFGLLQIVLAFLSNPAFDIPAEDRHKMVSCLLNVTIEETDEPITMAYSVSLSSGEVVEVKARRMLRWERENSKLYMQRTGGASSYKDKIEFATYFAHEISHGLLFQMPDQISSLAELIKIGSLLNFQQAAVAFLLKSKNLQLFPEDEDFLFRSKKMKIS

SEQ ID NO: 4298 - protein, 77 aa, Sorghum bicolor
MFHTRFRMIKHLFLCIANALSEWSPYFTLRADCANRQGLSPLQKCTSKIRLLAYGTPADGLDEYLKIGKSTTSLYKV

SEQ ID NO: 4299 - protein, 284 aa, Triticum aestivum
MVYGGEEALRRQYSIGDEIGHGRFGTVRRCHSNATGEALALKTTPKAPLRDPLDLALAEQEPKLHLLASSPPCSPHLVALHAAFDDADAVHLVVDLCAGGDLLSLLSARGGRLPEREAAGLAAQIASALAACHRRGVAHRDVKPDNLLFDAATGALKLADFGSAEWFGDGRRMSGIVGTPYYVAPEVVAGREYGEKVDVWSAGVVLYMTLSGSVPFYGATAPEIFEAVLRGNVRFPPRAFAGVSPEAKDLMRRMLCKDVSRRFSAEQVLRHPWIASCGGDAVAG

SEQ ID NO: 4300 - protein, 283 aa, Brachypodium distachyon
MSTGGEEALRLQYVVGDEIGRGRFGTVRRCHSAATGEAFAVKSTAKAPLLDPLDLALAEQEPKVHLLVSSPPCSRHVVALHAAFEDAHAVHLVLDLCAGGDLLSLLSARGGRLPEREAAGLAAQLAAALAACHRRGVAHRDVKPDNLLFDAAGALKLADFGSAEWFGDGRAMTGLVGTPYYVAPEVVAGREYGEKVDVWSAGVVLYVMLSGTVPFYGATAPEIFESVLRGNLRFPPRAFASVSPEAKDLMRRMLCKDVSRRFSADQVLRHPWIASRGGDAVAD

SEQ ID NO: 4301 - protein, 289 aa, Oryza sativa
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAADLVAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLRHPWIVSRGGAAVMG

SEQ ID NO: 4302 - protein, 291 aa, Triticum aestivum
  misc_feature (89)..(94): Xaa can be any naturally occurring amino acid
YGEQPRNRLDLYIPKDNRRPCPVVAFVTGGAWIIGYKAWGALLGRRLAERGIIVACIDYRNFPQGTISDMVSDASQGISFVCNNIASYXXXXXXIYLMGQSAGAHISACALMEQAVKESSGQPISWSVTQIKAYFGLSGGYNIHNLVDHFHQRGLNRSIFLSIMEGEEALSRYSPEIVVKESSTRTIALLPRIFLMHGTDDYSIPSSASRTFVDVLQQVGAQATLLLYEGKTHTDIFIQDPLRGGRDPLVEDVFSVIYADDATRQNAASAPTPRRLVFEWQLQLARWISPF

SEQ ID NO: 4303 - protein, 132 aa, Triticum aestivum
MDCAHTVSACRGMIDIMGDRGRERRDSYIIHSTMKIACKLHFFCCRCQFFAAAGLELFTCLFLGSRGFDSAFLMPPLAAAGLVAVALSFAGPLVALTLVGSLACPSSPVGFTAFRDAILICCSVPALEGLET

SEQ ID NO: 4304 - protein, 59 aa, Triticum aestivum
LLLYEGKTHTDIFIQDPLRGGRDPLVEDVFSIIYADDATRRIQLLRQLQGAWFLSGNCS

SEQ ID NO: 4305 - protein, 92 aa, Triticum aestivum
SCRIRHEDSSKPSSAGTEQHIRMASLKAVKPTGLEGQAKEPTKVSAAKGPAKLSATATKPAAAKGGIKKAESKPREPKKRQVKSSKPAAAKN

SEQ ID NO: 4306 - protein, 214 aa, Brachypodium distachyon
  misc_feature (208)..(209): Xaa can be any naturally occurring amino acid
  misc_feature (211)..(212): Xaa can be any naturally occurring amino acid
MQPPSSGGDAREADALLARSDSAGRRRRASPVQSASPAPQGWGGPRRQSSFRDDVGHAASETYLVTRLTFTLLQYLGLGYRWMTQLLALAVYAILLMPGFLQVGYYYFFSSQVRRSIVYGEQPRNRLDLYIPKDNTRPCPVMAFVTGGAWIIGYKAWGALLGRRLAERGIIVACIDYRNFPQGTISDMVADASQGISFVCNNIASYGXXLXXST

SEQ ID NO: 4307 - protein, 608 aa, Triticum aestivum
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTLRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLNTAIKSGKVRAPTHIISTISDDRGEEPCYAGVPMSTIIERGYGVGDVISLLWFKRSLPRYCTQFIEICVMLCADHGPCVSGAHNSIVTARAGKDLVSSLVSGLLTIGPRFGGAIDDAARYFKDAYDRDLTPYEFVEGMKKKGIRVPGIGHRIKSRDNRDKRVQLLQKYAHAHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4308 - protein, 608 aa, Triticum aestivum
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTVRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4309 - protein, 608 aa, Triticum aestivum
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTVRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPLVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4310 - protein, 608 aa, Triticum aestivum
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTVRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSVGLIGHTFDQKRLKQPLYRHPWEDVLYTK

SEQ ID NO: 4311 - protein, 608 aa, Hordeum vulgare
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMVVVLGELGGSDEYSLVEALKQGKVQKPVVAWVSGTCARLFKSEVQFGHAGAKSGGELESAQAKNQALRDAGAVVPTSFEALESVIKETFEKLVEDGNIPPVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4312 - protein, 608 aa, Avena sativa
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQATIRVVAIIAEGVPESDAKQLISYARANNKVIIGPATVGGVQAGAFKIGDTAGTIDNIIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQGKNQALRDAGAVVPTSFEALESVIKETFEKLVEEGKVPIVPEITPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4313 - protein, 608 aa, Brachypodium distachyon
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGVQAGAFKIGDTAGTIDNIIQCKLYRPGSVGFVSKSGGMSNELYSTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFDKLVEAGNIPPVAEITPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTNFPSVKYMEYAVQVETYTLSKANNLVMNVDGAIGSLFLDLLSGSGMFSKQEIDEIIEIGYLNGLFVLARSIGLIGHTFDQKRLKQPLYRHPWEDVLYTK

SEQ ID NO: 4314 - protein, 608 aa, Festuca arundinacea
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQATIRVVAIIAEGVPESDAKQLISYARANNKVIIGPATVGGVQAGAFKIGDTAGTIDNIIQCKLYRPGSVGFVSKSGGMSNEMYNTIARVTDGIYEGIAIGGDVFPGSTLSDHILRFNNIPQVKMMVVLGELGGSDEYSLVEALKQGKVQKPVVAWVSGTCATLFKSEVQFGHAGAKSGGELESAQGKNQALRDAGAVVPTSFEALESVIKETFEKLVEEGKVPLVPEITPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 4315 - protein, 608 aa, Pennisetum glaucum
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNEALREAGAIVPTSYEALESAIKETFEKLVEDGKISPVAEITPPPIPEDLKTAIKSGKVRAPTHIISTISDDRGEEPCYAGVPMSTIIEQGYGVGDVISLLWFKRSLPRYCTQFIEICVMLCADHGPCVSGAHNSIVTARAGKDLVSSLVSGLLTIGPRFGGAIDDAARYFKDAFDRGLTPYEFVEGMKKKGIRVPGIGHRIKSRDNRDKRVQLLQKYAHTHFPSVKYMEYAVQVETYTLSKANNLVLNVDGAIGSLFLDLLSGSGMFSKQEIDEIVEIGYLNGLFVLARSIGLIGHTFDQKRLKQPLYRHPWEDVLYTK

SEQ ID NO: 4316 - protein, 608 aa, Panicum virgatum
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNELYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALREAGAIVPTSYEALESAIKETFDKLAEEGKISPVTEITPPPIPEDLKTAIKSGKVRAPTHIISTISDDRGEEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVLNVDGAIGSLFLDLLSGSGMFTKQEIDEIVEIGYLNGLFVLARSIGLIGHTFDQKRLKQPLYRHPWEDVLYTK

SEQ ID NO: 4317 - protein, 608 aa, Oryza sativa
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDTKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALKDAGAVVPTSYEALETAIKETFEKLVEDGKISPVTEITPPPIPEDLKTAIKSGKVRAPTHIISTISDDRGEEPCYAGVPMSTIIEQGYGVGDVISLLWFKRSLPRYCTQFIEMCIMLCADHGPCVSGAHNSIVTARAGKDLVSSLVSGLLTIGPRFGGAIDDAARYFKDAYDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFSKQEIDEIVEIGYLNGLFVLARSIGLIGHTFDQKRLKQPLYRHPWEDVLYTK

SEQ ID NO: 4318 - protein, 608 aa, Setaria italica
MATGQLFSKTTQALFYNYKQLPIQRMLDFDFLCGRETPSVAGIINPGSDGFQKLFFGQEEIAIPVHPTVEAACNAHPTADVFINFASFRSAAASSMSALKQPTIRVVAIIAEGVPESDAKQLISFARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNEALREAGAIVPTSYEALESAIKETFEKLVEDGKISPVAEITPPPIPEDLKTAIKSGKVRAPTHIISTISDDRGEEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDACDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 4319 - protein, 608 aa, Sorghum bicolor
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALREAGAIVPTSYEALESAIKEAFDKLVEEGKISPVTEITPPPIPEDLKTAIKSGKVRAPTHIISTISDDRGEEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDACDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFTKQEIDEIVEIGYLNGLFVLARSIGLIGHTFDQKRLKQPLYRHPWEDVLYTK

SEQ ID NO: 4320 - protein, 608 aa, Saccharum officinarum
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALREAGAIVPTSYEALESAIKEAFDKLVEEGKISPVTEITPPSIPEDLKTAIKSGKVRAPTHIISTISDDRGEEPCYAGVPMSTIVEQGYGVGDVISLLWFKRSLPRYCTQFIEICIMLCADHGPCVSGAHNSIVTARAGKDLVSSLVSGLLTIGPRFGGAIDDAARYFKDACDRNLTPYEFVEGMKKKGIRVPGIGHRIKSRDNRDKRVQLLQKYAHTHFPSVKYMDYACQVETYTLSKANNLVLNVDGAIGSLFLDLLSGSGMFTKQEIDEIVEIGYLNGLFVLARSIGLIGHTFDQKRLKQPLYRHPWEDVLYTK

SEQ ID NO: 4321 - protein, 608 aa, Cajanus cajan
MATGQLFSRTTQALFYNYKQLPIQRMLDFDFLCGRETPSVAGIINPGSEGFQKLFFGQEEIAIPVHSTIEAACAAHPTADVFINFASFRSAAASSMAALKQPTIRVAAIIAEGVPESDTKQLIAYARANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQVKMMVVLGELGGRDEYSLVEALKQGKVQKPVVAWVSGTCARLFKSEVQFGHAGAKSGGELESAQAKNQALRDAGAVVPTSYEALEAAIKETFDKLVEEGKITSVKEITPPPIPEDLSTAIKSGKVRAPTHIISTISDDRGEEPCYAGVPMSSIIEKGYGVGDVISLLWFKRSLPRYCTQFIEICIMLCADHGPCVSGAHNTIVTARAGKDLVSSLVSGLLTIGPRFGGAIDDAARYFKDAHDRGLTPYEFVEGMKKKGIRVPGIGHRIKNRDNKDKRVELLQKFARTHFPSVKYMEYAVQVETYTLSKANNLVLNVDGAIGSLFLDLLAGSGMFTKPEIDEIVEIGYLNGLFVLARSIGLIGHTFDQKRLKQPLYRHPWEDVLYTK

SEQ ID NO: 4322 - protein, 608 aa, Citrus sinensis
MATGQLFSKTTQALFYNYKQLPIQRMLDFDFLCGRETPSVAGIINPGAEGFQKLFFGQEEIAIPVHSTVEAACAAHPTADVFINFSSFRSAAASSMAALKQPTIRVVAIIAEGVPEADTKQLIAYARSNNKVVIGPATVGGIQAGAFKIGDTAGTIDNIIHCKLYRPGSVGFVSKSGGMSNELYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQAKNQALRDAGAVVPTSYEAFESAIKETFEKLVEEGKIPPVKEVTPPQIPEDLNTAIKSGKVRAPTHIISTISDDRGEEPCYAGVPMSSIVEQGYGVGDVISLLWFKRSLPRYCTQFIEICIMLCADHGPCVSGAHNTIVTARAGKDLVSSLVSGLLTIGPRFGGAIDDAARYFKDAYDRGLSAYEFVESMKKKGIRVPGIGHRIKRGDNRDKRVELLQKFARTHFPSVKYMEYAVQVETYTLSKANNLVLNVDGAIGSLFLDLLAGSGMFSKQEIDEIVEIGYLNGLFVLARSIGLIGHTFDQKRLKQPLYRHPWEDVLYTK

SEQ ID NO: 4323 - protein, 608 aa, Glycine max
MATGQLFSRTTQALFYNYKQLPIQRMLDFDFLCGRETPSVAGIINPGSEGFQKLFFGQEEIAIPVHATIEAACAAHPTADVFINFASFRSAAASSMAALKQPTIRVVAIIAEGVPESDTKQLIAYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNMPQVKMMVVLGELGGRDEYSLVEALKQGKVSKPVVAWVSGTCARLFKSEVQFGHAGAKSGGELESAQAKNQALRDAGAVVPTSYEAFEAAIRETFDKLVEEGKITPIKEITPPPIPEDLSTAIKSGKVRAPTHIISTISDDRGEEPCYAGVPMSSIIEKGYGVGDVISLLWFKRSLPRYCTQFIEICIMLCADHGPCVSGAHNTIVTARAGKDLVSSLVSGLLTIGPRFGGAIDDAARYFKDAHDRALTPYEFVEGMKKKGIRVAGIGHRIKNRDNKDKRVELLQKFARTHFPSVKYMEYAVQVETYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 4324 - protein, 608 aa, Theobroma cacao
MATGQLFSRTTQALFYNYKQLPIQRMLDFDFLCGRETPSVAGIINPGAEGFQKLFFGQEEIAIPVHSTIEAACAAHPTADVFINFASFRSAAASSMAALKQPTIRVVAIIAEGVPESDTKQLIAYARSNNKVVIGPATVGGIQGGAFKIGDTAGTIDNIIQCKLYRPGSIGFVSKSGGMSNEMYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQGKNQALREAGAIVPTSYEALEAAIKETFEKLVEEGKITPVKEVKPPQIPEDLNSAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVEGMKKKGIRVPGIGHRIKRGDNRDKRVELLQRFARTHFPSVKYMEYAVQVETYTLSKANNLVLNVDGAIGSLFLDLLAGSGMFSKQEIDEIVEIGYLNGLFVLARSIGLIGHTFDQKRLKQPLYRHPWEDVLYTK

SEQ ID NO: 4325 - protein, 608 aa, Manihot esculenta
MATGQLFSRTTQALFYNYKQLPIQRMLDFDFLCGRETPSVAGIINPGAEGFQKLFFGQEEIAIPVHSTIEAACAAHPTADVFINFASFRSAAASSMSALKQPTIRVVAIIAEGVPESDTKQLIAYARSNNKVVIGPATVGGIQAGAFKIGDTAGTIDNIIACKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKDAGAVVPTSYEAFETAIKETFQKLVEEDKIPPVKEIKPPQIPEDLNSAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVEGMKKKGIRVPGIGHRIKRGDNRDKRVELLQRFARTHFPSVKYMEYAVQVETYTLSKANNLVLNVDGAIGSLFLDLLAGSGMFTKQEIDEIVEIGYLNGLFVLARSIGLIGHTFDQKRLKQPLYRHPWEDVLYTK

SEQ ID NO: 4326 - protein, 608 aa, Gossypium hirsutum
MATGQLFSRTTQALFYNYKQLPIQRMLDFDFLCGRETPSVAGIINPGAEGFQKLFFGQEEIAIPVHSTIEAACTAHPTADVFINFASFRSAAASSMAALKQPTIRVVAIIAEGVPESDTKQLIAYARSNNKVVIGPATVGGIQAGAFKIGDTAGTIDNIVQCKLYRPGSVGFVSKSGGMSNEMYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQGKNQALRDAGAIVPTSYEAFEAVIKETFDKLVEQGKITPVKEVMPPQIPEDLNNAIKSGKVRAPTHIISTISDDRGEEPCYAGVPMSSIVERGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVESMKKKGIRVPGIGHRIKRGDNRDKRVELLQRFARTHFPSVKYMEYAVQVETYTLSKANNLVLNVDGAIGSLFLDLLAGSGMFSKQEIDEIVEIGYLNGLFVLARSIGLIGHTFDQKRLKQPLYRHPWEDVLYTK

SEQ ID NO: 4327 - protein, 608 aa, Gossypium hirsutum
  misc_feature (298)..(298): Xaa can be any naturally occurring amino acid
MATGQLFSRTTQALFYNYKQLPIQRMLDFDFLCGRETPSVAGIINPGAEGFQKLFFGQEEIAIPVHSTIEAACTAHPTADVFINFASFRSAAASSMAALKQPTIRVVAIIAEGVPESDTKQLIAYARSNNKVVIGPATVGGIQAGAFKIGDTAGTIDNIVQCKLYRPGSVGFVSKSGGMSNEMYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQAKNQALRDAGAXVPTSYEAFEAVIKETFDKLVEQGKITPLKEVMPPQIPEDLNSAIKSGKVRAPTHIISTISDDRGEEPCYAGVPMSSIVERGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVEGMKKKGIRVPGIGHRIKRGDNRDKRVELLQRFARTHFPSVKYMEYAIQVETYTLSKANNLVLNVDGAIGSLFLDLLAGSGMFSKQEIDEIVEIGYLNGLFVLARSIGLIGHTFDQKRLKQPLYRHPWEDVLYTK

SEQ ID NO: 4328 - protein, 608 aa, Arabidopsis lyrata
MATGQLFSRNTQALFYNYKQLPIQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVIIGPATVGGVQAGAFKIGDTAGTIDNIIQCKLYRPGSVGFVSKSGGMSNEMYNTIARVTDGIYEGIAIGGDVFPGSTLSDHILRFNNIPQIKMVVVLGELGGRDEYSLVEAMKQGKVTKPVVAWVSGTCARLFKSEVQFGHAGAKSGGEMESAQAKNQALKDAGATVPTSFEALESAIKETFDKLVEEGKVSPIKEVTPPQIPEDLSSAIKSGKVRAPTHIISTISDDRGEEPCYAGVPMSSIIEQGYGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPAVKYMEYAVQVETYTLSKANNLVMNVDGAIGSLFLDLLAGSGMFTKQEIDEIVQIGYLNGLFVLARSIGLIGHTFDQKRLKQPLYRHPWEDVLYTK

SEQ ID NO: 4329 - protein, 608 aa, Glycine max
MATGQLFSRTTQALFYNYKQLPIQRMLDFDFLCGRETPSVAGIINPGSEGFQKLFFGQEEIAIPVHATVEAACAAHPTADVFINFASFRSAAASSMAALKQPTIRVVAIIAEGVPESDTKQLIAYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNMPQVKMMVVLGELGGRDEYSLVEALKQGKVSKPVVAWVSGTCARLFKSEVQFGHAGAKSGGELESAQAKNQALRDAGAVVPTSYEAFEVSIKETFDKLVEDGKITPIKEITPPPIPEDLSTAIKSGKVRAPTHIISTISDDRGEEPCYAGVPMSSIIEKGYGVGDVISLLWFKRSLPRYCTQFIEICIMLCADHGPCVSGAHNTIVTARAGKDLVSSLVSGLLTIGPRFGGAIDDAARYFKDAHDRALSPYEFVESMKKKGIRVPGIGHRIKNRDNKDKRVELLQKFARTHFPSVKYMEYAVQVETYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 4330 - protein, 608 aa, Vigna unguiculata
  misc_feature (147)..(147): Xaa can be any naturally occurring amino acid
  misc_feature (223)..(223): Xaa can be any naturally occurring amino acid
  misc_feature (225)..(226): Xaa can be any naturally occurring amino acid
MATGQLFSRTTQALFYNYKQLPIQRMLDFDFLCGRETPSVAGIINPGSEGFQKLFFGQEEIAIPVHSAIEAACAAHPTADVFINFASFRSAAASSMAALKQPTIRVVAIIAEGVPESDTKQLIAYARANNKVVIGPATVGGIQAGAXKIGDTAGTIDNIIQCKLYRPGSVGFVSKSGGMSNELYNTIARVTDGIYEGIAIGGDVFPGSTLSDHVLRFNNIPQXKXXVVLGELGGRDEYSLVEALKQGKVSKPVVAWVSGTCARLFKSEVQFGHAGAKSGGELESAQAKNQALKDAGAVVPTSFEAFEAAIKETFDKLVEEGKVTPVKEITPPPIPEDLSSAIKSGKVRAPTHIISTISDDRGEEPCYAGVPMSSIIEKGFGVGDVISLLWFKRSLPRYCTQFIEICIMLCADHGPCVSGAHNTIVTARAGKDLVSSLVSGLLTIGPRFGGAIDDAARYFKDAHDRGLTPYEFVESMKKKGIRVPGIGHRIKNRDNKDKRVELLQKFARTHFPSVKYMEYAVQVETYTLTKANNLVLNVDGAIGSLFLDLLAGSGMFSKQEIDEIVEIGYLNGLFVLARSIGLIGHTFDQKRLKQPLYRHPWEDVLYTK

SEQ ID NO: 4331 - protein, 608 aa, Lotus japonicus
MATGQLFSRTTQALFYNYKQLPIQRMLDFDFLCGLETPSVAGIINPGSEGFQKLFFGQEEIAIPVHPTIEAACAAHPTADVFINFASFRSAAASSMSALKQPTIRVAAIIAEGVPESDTKELIAYARANNKVVIGPATVGGIQAGAFKIGDTAGTIDNIIHCKLYRPGSVGFVSKSGGMSNELYNTIARVTDGIYEGIAIGGDVFPGSTLSDHVLRFNNIPQIKMIVVLGELGGRDEYSLVEALKQGKVTKPVVAWVSGTCARLFKSEVQFGHAGAKSGGEMESAQAKNQALKDAGAAVPTSFEAFEAAIKETFDKLVEEGKVTPVKEITPPPIPEDLSTAIKSGKVRAPTHIISTISDDRGEEPCYAGVPMSSIIEKGYGVGDVISLLWFKRSLPRYCTQFIEICIMLCADHGPCVSGAHNTIVTARAGKDLVSSLVSGLLTIGPRFGGAIDDAARYFKDAHDRSLTPYEFVESMKKKGIRVPGIGHRIKNRDNKDKRVELLQKFARTHFPSVKYMEYAVQVETYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 4332 - protein, 608 aa, Gossypium hirsutum
  misc_feature (475)..(475): Xaa can be any naturally occurring amino acid
MATGQLFSRTTQALFYNYKQLPIQRMLDFDFLCGRETPSVAGIINPGAEGFQKLFFGQEEIAIPVHSTIEAACAAHPTADVFINFASYRSAAASSMSALKQPTIRVVAIIAEGVPESDTKQLIAYARSNNKVVIGPATVGGIQAGAFKIGDTAGTIDNIVHCKLYRPGSVGFVSKSGGMSNEMYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQAKNQALREAGAVVPTSYEALEATIKETFEKLVEEGKITPVKEVKPPQIPEDLNSAIKSGKVRAPTHIISTISDDRGEEPCYAGVPMSSIVEQGLGVGDVISLLWFKRSLPRYCTKFIEICIMLCADHGPCVSGAHNTIVTARAGKDLVSSLVSGLLTIGPRFGGAIDDAARYFKDAYDRGLTPYEFVEXMKKKGIRVPGIGHRIKRGDNRDKRVELLQLFARTNFPSVKYMEYAVQVETYTLSKANNLVLNVDGAIGSLFLDLLAGSGMFTKQEIDEIVEIGYLNGLFVLARSIGLIGHTFDQKRLKQPLYRHPWEDVLYTK

SEQ ID NO: 4333 - protein, 608 aa, Carica papaya
MATGQLFSRSTQALFYNYKQLPVQRMLDFDFLCGRETPSVAGIINPGSEGFQKLFFGQEEIAIPVHSAIETACAAHPTADVFINFASFRSAAASSMAALKQPTIRVVAIIAEGVPESDTKQLIAYARANNKVVIGPATVGGIQAGAFKIGDTAGTIDNITQCKLYRPGSVGFVSKSGGMSNEMYNTIARVTDGIYEGIAIGGDVFPGSTLSDHVLRFSNIPQVKMMVVLGELGGRDEYSLVEALKQGKVTKPVVAWVSGTCARLFKSEVQFGHAGAKSGGEMESAQAKNQALRDAGAVVPTSYEAFEAAIKETFEKLVEEGKIAPVKEVKPPQIPEDLNSAIKSGKVRAPTHIISTISDDRGEEPCYAGVPMSSIVEQGYGVGDVISLLWFKRSLPRYCTKFIEICIMLCADHGPCVSGAHNTIVTARAGKDLVSSLVSGLLTIGPRFGGAIDDAARYFKDAYDRGLTPYEFVEGMKKKGIRVPGIGHRIKRGDNRDKRVELLQLFARTHFPSVKYMEYAVQVETYTLSKANNLVLNVDGAIGSLFLDLLAGSGMFSKPEIDEIVEIGYLNGLFVLARSIGLIGHTFDQKRLKQPLYRHPWEDVLYTK

SEQ ID NO: 4334 - protein, 608 aa, Cucumis sativus
MATGQIFSRTTQALFYNYKQLPIQRMLDFDFLCGRETPSVAGIINPGAEGFQKLFFGQEEIAIPVHSTIEAACAAHPTADVFINFASFRSAAASSLSALKQPTIRVIAIIAEGVPESDTKQLIAYARANNKVVIGPATVGGIQAGAFKIGDTAGTIDNIVQCKLYRPGSVGFVSKSGGMSNEMYNTIARVTDGIYEGIAIGGDVFPGSTLSDHILRFNNIPQVKMMVVLGELGGRDEYSLVEAMKQGKVNKPVVAWVSGTCATLFKSEVQFGHAGAKSGGELESAQAKNQALRDAGAIVPTSYEALEDAIKETFGKLVEEGKITPVKEVKPPQIPEDLNSAIKSGKVRAPTHIISTISDDRGEEPSYAGIPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRNLTPYEFVESMKKKGIRVPGIGHRIKRGDNRDKRVELLQRFARTHFPSVKYMEYAVQVETYTLSKANNLVLNVDGAIGSLFLDLLAGSGMFSKQEIDEIVEIGYLNGLFVLARSIGLIGHTFDQKRLKQPLYRHPWEDVLYTK

SEQ ID NO: 4335 - protein, 412 aa, Ricinus communis
MATGQLFSRTTQALFYNYKQLPIQRMLDFDFLCGRETPSVAGIINPGSEGFQKLFFGQEEIAIPVHSAIEAACAAHPTADVFINFASFRSAAASSMAALKQPTIRVVAIIAEGVPESDTKQLIAYARANNKVVIGPATVGGIQAGAFKIGDTAGTIDNIIACKLYRPGSVGFVSKSGGMSNELYNTIARVTDGIYEGIAIGGDVFPGSTLSDHVLRFNNIPQVKMIVVLGELGGRDEYSLVEALKQGKVNKPVVAWVSGTCARLFKSEVQFGHAGAKSGGEMESAQAKNQALKDAGAVVPTSYEAFETAIKETFQKLVEEGKITPVKEVKPPQIPEDLNTAIKSGKVRAPTHIISTISDDRGEEPCYAGVPMSSIVEQGYGVGDVISLLWFKRSLPRYCTHFIEANMHHAVC

SEQ ID NO: 4336 - protein, 608 aa, Manihot esculenta
MATGQLFSRTTQALFYNYKQLPIQRMLDFDFLCGRETPSVAGIINPGAEGFQKLFFGQEEIAIPVHSTIEAACAAHPTADVFINFASFRSAAASSMAALKQPTIRVVAIIAEGVPESDTKHLIAYARSNNKVVIGPATVGGIQAGAFKIGDTAGTIENIIACKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKDAGAVVPTSYEAFETAIKETFQKLVEEGKIAPVKEIKPPQIPEDLNTAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLSPYEFVEGMKKKGIRVPGIGHRIKRGDNRDKRVELLQLFARTHFPSVKYMEYAVQVETYTLSKANNLVLNVDGAIGSLFLDLLAGSGMFTKQEIDEIVEIGYLNGLFVLARSIGLIGHTFDQKRLKQPLYRHPWEDVLYTK

SEQ ID NO: 4337 - protein, 608 aa, Glycyrrhiza uralensis
MATGQLFSRTTQALFYNYKQLPIQRMLDFDFLCGRETPSVAGIINPGSEGFQKLFFGQEEIAIPVHSAIEAACASHPTADVFINFASFRSAAASSMAALKQPTIRVVAIIAEGVPESDTKQLIAYARANNKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALSEAGAVVPTSYEAFEAAIKETFDKLVEEGKIPPVKEFTPPQIPEDLNTAIRSGKVRAPTHIISTISDDRGEEPCYAGVPMSSIIENGYGVGDVISLLWFKRSLPRYCTQFIEICIMLCADHGPCVSGAHNAIVTARAGKDLVSSLVSGLLTIGPRFGGAIDDAARYFKDACDRSLTPYEFVESMKKKGIRVPGIGHRIKNRDNKDKRVELLQKFARTHFPSVKYMEYAVEVENYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 4338 - protein, 608 aa, Glycine max
MATGQLFSRTTQALFYNYKQLPIQRMLDFDFLCGRETPSVAGIINPGSEGFQKLFFGQVEIAIPVHADIEAACAAHPTADVFINFASFRSAAASSMAALKQPTIRVVAIIAEGVPESDTKQLIAYARANNKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKEAGAVVPTSFEAFEDAIKETFHKLVEEGNVTPIKEFTPPPIPEDLNTAIRSGKVRAPTHIISTISDDRGEEPCYAGVPMSTIIENGYGVGDVISLLWFKRSLPRYCTQFIEICIMLCADHGPCVSGAHNSIVTARAGKDLVSCLVSGLLTIGPRFGGAIDDAARYFKDAYDRSLTPYEFVESMKNKGIRVPGIGHRIKNRDNKDKRVELLQKFARTHFPSVKYMEYAVEVENYTLTKANNLVLNVDGAIGSLFLDLLAGSGMFTKQEVDEIVEIGYLNGLFVLARSIGLIGHTFDQKRLKQPLYRHPWEDVLYTK

SEQ ID NO: 4339 - protein, 608 aa, Arabidopsis thaliana
MATGQLFSRTTQALFYNYKQLPVQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVVIGPATVGGIQAGAFKIGDTAGTIDNIIQCKLYRPGSVGFVSKSGGMSNEMYNTVARVTDGIYEGIAIGGDVFPGSTLSDHILRFNNIPQIKMMVVLGELGGRDEYSLVEALKEGKVNKPVVAWVSGTCARLFKSEVQFGHAGAKSGGEMESAQAKNQALIDAGAIVPTSFEALESAIKETFEKLVEEGKVSPIKEVIPPQIPEDLNSAIKSGKVRAPTHIISTISDDRGEEPCYAGVPMSSIIEQGYGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPSVKYMEYAVTVETYTLSKANNLVLNVDGAIGSLFLDLLAGSGMFTKQEIDEIVQIGYLNGLFVLARSIGLIGHTFDQKRLKQPLYRHPWEDVLYTK

SEQ ID NO: 4340 - protein, 608 aa, Arabidopsis thaliana
MATGQLFSRNTQALFYNYKQLPIQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVIIGPATVGGVQAGAFKIGDTAGTIDNIIQCKLYRPGSVGFVSKSGGMSNEMYNTIARVTDGIYEGIAIGGDVFPGSTLSDHILRFNNIPQIKMVVVLGELGGRDEYSLVEAMKQGKVTKPVVAWVSGTCARLFKSEVQFGHAGAKSGGEMESAQAKNQALQDAGATVPTSFEALEVAIKETFDKLVEEGKVSPIKEVTPPQIPEDLSSAIKSGKVRAPTHIISTISDDRGEEPCYAGVPMSSIIEQGYGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPAVKYMEYAVQVETYTLSKANNLVLNVDGAIGSLFLDLLAGSGMFTKQEIDEIVQIGYLNGLFVLARSIGLIGHTFDQKRLKQPLYRHPWEDVLYTK

SEQ ID NO: 4341 - protein, 608 aa, Orobanche aegyptiaca
MATGQLFSKTTQALFYNYKQLPIQRMLDFDFLCGRETPSVAGIINPGSEGFQKLFFGQEEIAIPVHPAIETACAAHPTADVFINFASFRSAAASSLAALKQPTIKVVAIIAEGVPESDTKQLIAYAKANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQVKMMVVLGELGGHDEYSLVEALKQGKINKPVVAWVSGTCARLFKSEVQFGHAGAKSGGELESAQAKNQALGDAGAVVPTSFEAFEGAIKETFGKLVEAGKISPVKEVTPPQIPEDLNTAIKTGKVRAPTHIISTISDDRGEEPTYAGVPMSSIVEQGLGVGDVISLLWFKRSLPHYCTRFIEICIMLCADHGPCVSGAHNTIVTARAGKDLVSSLVSGLLTIGPRFGGAIDDAARYFKDAYDRGLTPYEFVESMKKKGIRVPGIGHRIKSADNRDKRVELLQRFARANFPSVKYMEYAVEVETYTLSKANNLVLNVDGAIGSLFLDLLAGSGMFTKQEIDEIVGIGYLNGLFVLARSIGLIGHTFDQKRLKQPLYRHPWEDVLYTK

SEQ ID NO: 4342 - protein, 608 aa, Populus trichocarpa
MATGQLFSRTTQALFYNYKQLPIQRMLDFDFLCGRELPSVAGIINPGAEGFQKLFFGQEEIAIPVHSTIEAACAAHPTADVFINFASFRSAAASSMSALKQPTVRVVAIIAEGVPEADAKQLIAYARANNKVVIGPATVGGIQAGAFKIGDTAGTIDNIIACKLYRPGSVGFVSKSGGMSNELYNSIARVTDGIYEGIAIGGDVFPGSTLSDHVLRFNNIPQVKMIVVLGELGGRDEYSLVEALKQGKVSKPVVAWVSGTCARLFKSEVQFGHAGAKSGGEMESAQAKNQALKDAGAVVPTSYEAFETAIKETFEKLVEEGKISSVKEFTPPQIPEDLNIAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVESMKKKGIRVPGIGHRIKRGDNRDKRVELLQLFARTHFPSVKYMEYAVQVETYTLSKANNLVLNVDGAIGSLFLDLLAGSGMFTKQEIDEIVGIGYLNGLFVLARSIGLIGHTFDQKRLKQPLYRHPWEDVLYSK

SEQ ID NO: 4343 - protein, 608 aa, Arabidopsis lyrata
MATGQLFSRTTQALFYNYKQLPVQRMLDFDFLCGRETPSVAGIINPGSEGFQKLFFGQEEIAIPVHAAIEAACAAHPTADVFINFASFRSAAASSMAALKQPTIKVVAIIAEGVPESDTKHLIAYARANNKVVIGPATVGGIQAGAFKIGDTAGTIDNIIQCKLYRPGSVGFVSKSGGMSNEMYNTVARVTDGIYEGIAIGGDVFPGSTLSDHILRFNNIPQIKMMVVLGELGGRDEYSLVEALKEGKVNKPVVAWVSGTCARLFKSEVQFGHAGAKSGGEMESAQAKNQALMDAGAIVPTSFEALEAAIKETFEKLVEEGKVSPIKEVTPPQIPEDLNSAIKSGKVRAPTHIISTISDDRGEEPCYAGVPMSSIIEQGYGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPSVKYMEYAVTVETYTLSKANNLVLNVDGAIGSLFLDLLAGSGMFTKQEIDEIVQIGYLNGLFVLARSIGLIGHTFDQKRLKQPLYRHPWEDVLYTK

SEQ ID NO: 4344 - protein, 608 aa, Brassica napus
MATGQLFSRTTQALFYNYKQLPVQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVVIGPATVGGIQAGAFKIGDTAGTIDNIIQCKLYRPGSVGFVSKSGGMSNEMYNTVARVTDGIYEGIAIGGDVFPGSTLSDHILRFNNIPQIKMMVVLGELGGRDEYSLVEALKQGKVNKPVVAWVSGTCARLFKSEVQFGHAGAKSGGEMESAQAKNQALMDAGAIVPTSFEALESAIKETFDKLVEEGKVSPIKEVTPPQIPEDLSSAIKSGKVRAPTHIISTISDDRGEEPCYAGVPMSSIIEQGLGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPSVKYMEYAVTVESYTLSKANNLVMNVDGAIGSLFLDLLAGSGMFTKQEIDEIVQIGYLNGLFVLARSIGLIGHTFDQKRLKQPLYRHPWEDVLYTK

SEQ ID NO: 4345 - protein, 608 aa, Brassica napus
MATGQLFSRTTQALFYNYKQLPVQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVVIGPATVGGIQAGAFKIGDTAGTIDNIIQCKLYRPGSVGFVSKSGGMSNEMYNTVARVTDGIYEGIAIGGDVFPGSTLSDHILRFNNIPQIKMMVVLGELGGRDEYSLVEALKQGKVNKPVVAWVSGTCARLFKSEVQFGHAGAKSGGEMESAQAKNQALMDAGAIVPTSFEALESAIKETFEKLVEEGKVSPIKEVTPPQIPEDLSSAIKSGKVRAPTHIISTISDDRGEEPCYAGVPMSSIIEQGLGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPSVKYMEYAVTVESYTLSKANNLVLNVDGAIGSLFLDLLAGSGMFTKQEIDEIVQIGYLNGLFVLARSIGLIGHTFDQKRLKQPLYRHPWEDVLYTK

SEQ ID NO: 4346 - protein, 608 aa, Quercus alba
MATGQLFSRTTQALFYNYKQLPIQRMLDFDFLCGRETPSVAGIINPGGDGFQKLFFGQEEIAIPVHSAIDAACAAHPTADVFINFASFRSAAASSMAALKQPTIRVVAIIAEGVPESDTKQLIAYARANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQIKMIVVLGELGGQDEYSLVEALKQGKVTKPVVAWVSGTCARLFKSEVQFGHAGAKSGGDMESAQGKNQALREAGAVVPTSYEALEAAIKETFEKLVEGGNITAVKEVIPPQIPEDLNTAIKSGKVRAPTHIISTISDDRGEEPCYAGVPMSSIVEQGYGVGDVISLLWFKRSLPRYCTKFIEICIMLCADHGPCVSGAHNTIVTARAGKDLVSSLVSGLLTIGPRFGGAIDDAARYFKDAYDRNLTPYEFVESMKKKGIRVPGIGHRIKRGDNRDKRVELLQLFARTNFPSVKYMEYAVQVETYTLSKANNLVLNVDGAIGSLFLDLLAGSGMFTKQEIDEIVEIGYLNGLFVLARSIGLIGHTFDQKRLKQPLYRHPWEDVLYTK

SEQ ID NO: 4347 - protein, 98 aa, Castanea mollissima
MATGQLFSRTTQALFYNYKQLPIQRMLDFDFLCGRETPSVAGIINPGGDGFQKLFLVKRKLLSLCTQPLTQLVLHIPLLMSLSTLHHLEVPLLHLWLL

SEQ ID NO: 4348 - protein, 608 aa, Prunus persica
MATGQLFSRTTQALFYNYKQLPIQRMLDFDFLCGRETPSVAGIINPGAEGFQKLFFGQEEIAIPVHSTIEASCAAHPTADVFINFASFRSAAASSMAALKQPTIRVVAIIAEGVPESDAKQLIAYARANNKVVIGPATVGGIQAGAFKIGDTAGTIDNIIHCKLYRPGSVGFVSKSGGMSNELYNTVARVTDGLFEGIAIGGDVFPGSTLSDHVLRFNNIPQVKLIVVLGELGGRDEYSLVEALKQGKVSKPVVAWVSGTCARLFKSEVQFGHAGAKSGGELESAQAKNQALRDAGAVVPTSYEALETAIKETFEKLVEQGKITPVKEFKPPQIPEDLNSAIKSGKVRAPTHIISTISDDRGEEPCYAGVPMSSIVEQGYGVGDVISLLWFKRSLPRYCTQFIEICIMLCADHGPCVSGAHNTIVTARAGKDLVSSLVSGLLTIGPRFGGAVDDAARYFKDAYDRNLTPYEFVESMKKKGIRVPGIGHRIKRGDNRDKRVELLQAFARTHFPSVKYMEYAVQVETYTLSKANNLVLNVDGAIGTLFLDLLAGSGMFSKQEIDEIVDIGYLNGLFVLARSIGLIGHTFDQKRLKQPLYRHPWEDVLYTK

SEQ ID NO: 4349 - protein, 608 aa, Helianthus annuus
MATGQIFSRTTQALFYNYKQLPIQRMLDFDFLCGRETPSVAGIINPGSEGFQKLFFGQEEIAIPVHSTIEAACAAHPTADVFINFASFRSAAASSKLALKQPTIRVVAIIAEGVPESDTKELISYARLNNKVVIGPATVGGIQAGAFKIGDTAGTIDNIIQCKLYRPGSVGFVSKSGGMSNEMYNTIARVTDGIYEGIAIGGDVFPGSTLSDHVLRFNNIPQIKMIVVLGELGGRDEYSLVEALKSGKITKPVCAWVSGTCARLFKSEVQFGHAGAKSGGLMESAQAKNKALKEAGAVVPTSYEAFESAIKETFEKLSEEGKISPVKEITPPQIPEDLNTAIKSGKVRAPTHIISTISDDRGEEPCYAGVPMSTIVEKGMGVGDVISLLWFKRSLPRYCTQFIEICVMLCADHGPCVSGAHNTIVTARAGKDLVSSLVSGLLTIGPRFGGAIDDAARYFKDAYDRKLTPYEFVEGMKKKGIRVPGIGHRIKRGDNRDKRVELLQLFARTHFPSTKYMEYAVEVETYTLSKANNLVMNVDGAIGTLFLDLLAGSGMFSKQEIDEIVSIGYLNGLFVLARSIGLIGHTFDQKRLKQPLYRHPWEDVLYTK

SEQ ID NO: 4350 - protein, 608 aa, Helianthus annuus
MATGQIFSRTTQALFYNYKQLPIQRMLDFDFLCGRETPSVAGIINPGSEGFQKLFFGQEEIAIPVHSTIEAACAAHPTADVFINFASFRSAAASSKLALKQPTIRVVAIIAEGVPESDTKELISYARLNNKVVIGPATVGGIQAGAFKIGDTAGTIDNIIQCKLYRPGSVGFVSKSGGMSNEMYNTIARVTDGIYEGIAIGGDVFPGSTLSDHVLRFNNIPQIKMIVVLGELGGRDEYSLVEALKSGKITKPVCAWVSGTCARLFKSEVQFGHAGAKSGGLMESAQAKNKALKEAGAVVPTSYEAFESAIKETFEKLSEEGKIAPVKEITPPQIPEDLNTAIKSGKVRAPTHIISTISDDRGEEPCYAGVPMSTIVEKGMGVGDVISLLWFKRSLPRYCTQFIEICVMLCADHGPCVSGAHNTIVTARAGKDLVSSLVSGLLTIGPRFGGAIDDAARYFKDAYDRKLTPYEFVEGMKKKGIRVPGIGHRIKRGDNRDKRVELLQLFARTHFPSTKYMEYAVEVETYTLSKANNLVMNVDGAIGTLFLDLLAGSGMFSKQEIDEIVSIGYLNGLFVLARSIGLIGHTFDQKRLKQPLYRHPWEDVLYTK

SEQ ID NO: 4351 - protein, 608 aa, Glycine max
MATGQLFSRTTQALFYNYKQLPVQRMLDFDFLCGRETPSVAGIINPGSEGFQKLFFGQVEIAIPVHAGIEAACAAHPTADVFINFASFRSASASSMAALKQTTIRVVAIIAEGVPESDTKQLIAYARANSKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKEAGAVVPTSFEAFEDAIKETFDKLVQEGNITPFKEFTAPPIPEDLNTAIRSGKVRAPTHIISTISDDRGEEPCYAGVPMSTIIENGYGVGDVISLLWFKRSLPRYCTQFIEICIMLCADHGPCVSGAHNSIVTARAGKDLVSCLVSGLLTIGPRFGGAIDDAARYFKDAYDRSLTPYEFVESMKKKGIRVPGIGHRIKNRDNKDKRVELLQKFARTHFPSVKYMEYAVEVENYTLTKANNLVLNVDGAIGSLFLDLLAGSGMFTKQEVDEIVEIGYLNGLFVLARSIGLIGHTFDQKRLKQPLYRHPWEDVLYTK

SEQ ID NO: 4352 - protein, 291 aa, Cucumis melo
MATGQIFSRTTQALFYNYKQLPIQRMLDFDFLCGRETPSVAGIINPGAEGFQKLFFGQEEIAIPVHSTIEAACAAHPTADVFINFASFRSAAASSMAALKQPTIRVIAVIAEGVPESDTKQLIAYARANNKVVIGPATVGGIQAGAFKIGDTAGTIDNIVQCKLYRPGSVGFVSKSGGMSNEMYNTIARVTDGIYEGIAIGGDVFPGSTLSDHILRFNNIPQVKMMVVLGELGGRDEYSLVEALKQGKVNKPVVAWVSGTCATLFKSEVQFGHAGAKVVVSWSLHKQKIKL

SEQ ID NO: 4353 - protein, 608 aa, Vitis vinifera
MATGQLFSRTTQALFYNYKQLPIQRMLDFDFLCGRETPSVAGIINPGSEGFQKLFFGQEEIAIPVHSSIEAASAAHPTADVFINFASFRSAAASSMAALKQPTIRVVAIIAEGVPEADTKQLIAYARSNNKVVIGPATVGGIQAGAFKIGDTAGTIDNIIQSKLYRPGSVGFVSKSGGMSNELYNTIARVTDGIYEGIAIGGDVFPGSTLSDHVLRFNNIPQVKMVVVLGELGGRDEYSLVEALKQGKINKPVVAWVSGTCARLFKSEVQFGHAGAKSGGEMESAQAKNQALSEAGAVVPTSYEAFETAIKETFEKLHEEGKITPVKEVTPPQIPEDLNTAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTAYEFVEDMKKKGIRVPGIGHRIKRGDNRDKRVELLQRFARTHFPSVKYMEYAVEVETYTLSKSNNLVLNVDGAIGSLFLDLLAGSGMFTKQEIDEIVQIGYLNGLFVLARSIGLIGHTFDQKRLKQPLYRHPWEDVLYTK

SEQ ID NO: 4354 - protein, 608 aa, Solanum phureja
MATGQLFSKTTQALFYNYKQLPIQRMLDFDFLCARETPSVAGIINPGSEGFQKLFFGQEEIAIPVHSTIEAACAAHPTADVFINFASFRSAAASSMSALKQPTIKVAAIIAEGVPESDAKELIAYAKANNKVVIGPATVGGIQAGAFKIGDTAGTIDNIIQCKLYRPGSVGFVSKSGGMSNELYNSIARVTDGIYEGIAIGGDVFPGSTLSDHVLRFNNIPQVKMVVVLGELGGRDEYSLVEALKQGKINKPVVAWVSGTCATLFKSEVQFGHAGAKSGGEMESAQAKNQALRDAGAIVPTSYEAFEGAIKDAFEKLVEAGKTTPVKEITPPQIPEDLSTAIKSGKVRAPTHIISTISDDRGEEPCYAGVPMSSIVEQGLGVGDVISLLWFKRSLPRYCTRFIEICVMLCADHGPCVSGAHNSIVTARAGKDLVSCLVSGLLTIGPRFGGAIDDAARYFKDAYDKGLTPYEFVESMKKKGIRVPGIGHRIKRGDNRDKRVELLQRYARENFPSVKYMEYAVQVETYTLSKANNLVLNVDGAIGSLFLDLLAGSGMFTKPEIDEIVEIGYLNGLFVLARSIGLIGHTFDQKRLKQPLYRHPWEDVLYTK

SEQ ID NO: 4355 - protein, 608 aa, Glycine max
MATGQLFSRTTQALFYNYKQLPVQRMLDFDFLCGRETPSVAGIINPGSEGFQKLFFGQVEIAIPVHAGIEAACAAHPTADVFINFASFRSASASSMAALKQTTIRVVAIIAEGVPESDTKQLIAYARANSKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAVSKSGGEMESAQAKNQALKEAGAVVPTSFEAFEDAIKETFDKLVQEGNITPFKEFTAPPIPEDLNTAIRSGKVRAPTHIISTISDDRGEEPCYAGVPMSTIIENGYGVGDVISLLWFKRSLPRYCTQFIEICIMLCADHGPCVSGAHNSIVTARAGKDLVSCLVSGLLTIGPRFGGAIDDAARYFKDAYDRSLTPYEFVESMKKKGIRVPGIGHRIKNRDNKDKRVELLQKFARTHFPSVKYMEYAVEVENYTLTKANNLVLNVDGAIGSLFLDLLAGSGMFTKQEVDEIVEIGYLNGLFVLARSIGLIGHTFDQKRLKQPLYRHPWEDVLYTK

SEQ ID NO: 4356 - protein, 608 aa, Medicago truncatula
MATGQLFSRTTQALFYNYKQLPIQRMLDFDFLCGRETPSVAGIINPGSEGFQKLFFGQEEIAIPVHATIEAASAAHPTADVFINFASFRSAAASSMAALKQPTIRVVAIIAEGVPESDTKELIAYARSNNKVVIGPATVGGIQAGAFKIGDTAGTIDNIIQCKLYRPGSVGFVSKSGGMSNELYNSIARVTDGIYEGIAIGGDVFPGSTLSDHVLRFNNIPQVKMIVVLGELGGRDEYSLVEALKQGKVTKPVVAWVSGTCATLFKSEVQFGHAGAKSGGDMESAQGKNQALREAGAVVPTSYESFETSIKETFDKLIEGGKITPVKEFTPPQIPEDLNTAIKSGKVRAPTHIISTISDDRGEEPCYAGVPMSSIIEKGFGVGDVISLLWFKRSLPRYCTHFIEICIMLCADHGPCVSGAHNTIVTARAGKDLVSSLVSGLLTIGPRFGGAIDDAARYFKDAHDRGLTPYEFVEGMKKKGIRVAGIGHRIKNRDNKDKRVELLQKFARTHFPSVKYMEYAVQVETYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 4357 - protein, 608 aa, Solanum lycopersicum
MATGQLFSKTTQALFYNYKQLPIQRMLDFDFLCGRETPSVAGIINPGSEGFQKLFFGQEEIAIPVHSTIEAACAAHPTADVFINFASFRSAAASSMSALKQPTIKVAAIIAEGVPESDAKELIAYAKANNKVVIGPATVGGIQAGAFKIGDTAGTIDNIIQCKLYRPGSVGFVSKSGGMSNELYNSIARVTDGIYEGIAIGGDVFPGSTLSDHVLRFNNIPQVKMVVVLGELGGRDEYSLVEALKQGKINKPVVAWVSGTCATLFKSEVQFGHAGAKSGGEMESAQAKNQALRDAGAIVPTSYEAFEGAIKDAFEKLVEAGKTTPVKEITPPQIPEDLSTAIKSGKVRAPTHIISTISDDRGEEPCYAGVPMSSIVEQGLGVGDVISLLWFKRSLPRYCTRFIEICVMLCADHGPCVSGAHNSIVTARAGKDLVSCLVSGLLTIGPRFGGAIDDAARYFKDAYDKGLTPYEFVESMKKKGIRVPGIGHRIKRGDNRDKRVELLQRYARENFPSVKYMEYAVQVETYTLSKANNLVLNVDGAIGSLFLDLLAGSGMFTKPEIDEIVGIGYLNGLFVLARSIGLIGHTFDQKRLKQPLYRHPWEDVLYTK

SEQ ID NO: 4358 - protein, 608 aa, Solanum lycopersicum
MATGQLFSKTTQALFYNYKQLPIQRMLDFDFLCGRETPSVAGIINPGSEGFQKLFFGQEEIAIPVHSTVEAACAAHPTADVFINFASFRSAAASSMSALKQPTIRVVAIIAEGVPESDTKQLIGFAKANNKVVIGPATVGGIQAGAFKIGDTAGTIDNIIQCKLYRPGSVGFVSKSGGMSNELYNTIARVTDGVYEGIAIGGDVFPGSTLSDHVLRFNNIPQVKMIVVLGELGGRDEYSLVEALKQGKINKPVVAWVSGTCATLFKSEVQFGHAGAKSGGEMESAQAKNQALRDAGATVPTSYEAFEGAIKEAFEKLVSEGKTTPVKEITPPQIPEDLNTAIKSGKVRAPTHIISTISDDRGEEPCYAGVPMSSIVEQGLGVGDVISLLWFKRSLPRYCTRFIEICTLLCADHGPCVSGAHNTIVTARAGKDLVSCLVSGLLTIGPRFGGAVDDAARYFKDAYDRGLTPYEFVESMKKRGIRVPGIGHRIKRGDNRDKRVELLQLYARENFPSVKYMEYAVQVETYTLSKANNLVLNVDGAIGSLFLDLLAGSGMFTKPEIDEIVEIGYLNGLFVLARSIGLIGHTFDQKRLKQPLYRHPWEDVLYTK

SEQ ID NO: 4359 - protein, 608 aa, Capsicum annuum
MATGQLFSKTTQALFYNYKQLPIQRMLDFDFLCGRETPSVAGIINPGSEGFQKLFFGQEEIAIPVHSTVEAACAAHPTADVFINFASFRSAAASSMSALKQPTIRVVAIIAEGVPESDTKQLIGFAKANNKVVIGPATVGGIQAGAFKIGDTAGTIDNIIQCKLYRPGSVGFVSKSGGMSNELYNTIARVTDGVYEGIAIGGDVFPGSTLSDHVLRFNNIPQVKMIVVLGELGGRDEYSLVEALKQGKINKPVVAWVSGTCATLFKSEVQFGHAGAKSGGEMESAQAKNQALRDAGAVVPTSYEAFEGAIKAAFENLVSEGKTTPVKEITPPNIPEDLNTAIKSGKVRAPTHIISTISDDRGEEPCYGGVPMSSIVEQGLGVGDVISLLWFKRSLPRYCTRFIEICVLLCADHGPCVSGAHNSIVTARAGKDLVSCLVSGLLTIGPRFGGAVDDAARYFKDAYDRGLTPYEFVESMKKKGIRVPGIGHRIKRGDNRDKRVELLQLYARDNFPSVKYMEYAVQVETYTLSKANNLVLNVDGAIGTLFLDLLAGSGMFTKPEIDEIVEIGYLNGLFVLARSIGLIGHTFDQKRLKQPLYRHPWEDVLYTK

SEQ ID NO: 4360 - protein, 608 aa, Solanum tuberosum
MATGQLFSKTTQALFYNYKQLPIQRMLDFDFLCGRETPSVAGIINPGSEGFQKLFFGQEEIAIPVHSTVEAACAAHPTADVFINFASFRSAAASSMSALKQPTIRVVAIIAEGVPESDTKQLIGFAKANNKVVIGPATVGGIQAGAFKIGDTAGTIDNIIQCKLYRPGSVGFVSKSGGMSNELYNTIARVTDGVYEGIAIGGDVFPGSTLSDHVLRFNNIPQVKMIVVLGELGGRDEYSLVEALKQGKINKPVVAWVSGTCATLFKSEVQFGHAGAKSGGEMESAQAKNQALSDAGATVPTSYEAFEGAIKEAFEKLVSEGKTTPVKEITPPQIPEDLNTAIKSGKVRAPTHIISTISDDRGEEPCYAGVPMSSIVEQGLGVGDVISLLWFKRSLPRYCTRFIEICTLLCADHGPCVSGAHNTIVTARAGKDLVSCLVSGLLTIGPRFGGAVDDAARYFKDAYDRGLTPYEFVESMKKKGIRVPGIGHRIKRGDNRDKRVELLQLYARENFPSVKYMEYAVQVETYTLSKANNLVLNVDGAIGSLFLDLLAGSGMFTKPEIDEIVEIGYLNGLFVLARSIGLIGHTFDQKRLKQPLYRHPWEDVLYTK

SEQ ID NO: 4361 - protein, 340 aa, Arachis hypogaea
MLELRVGVRWSLPKQKIRHYRMLELLFPLRMKLWKAAIKETFDKLVEEGKITPVKEITPPPIPEDLNSAIKSGKVRAPTHIISTISDDRGEEPCYAGVPMSSIIEKGFGVGDVISLLWFKRSLPRYCTQFIEICIMLCADHGPCVSGAHNTIVTARAGKDLVSSLVSGLLTIGPRFGGAIDDAARYFKDAHDRGLTPYEFVENMKKKGIRVPGIGHRIKNRDNKDKRVELLQKFARTHFPSVKYMEYAVQVEAYTLTKANNLVLNVDGAIGSLFLDLLAGSGMFTKQEIDEIVEIGYLNGLFGLARAIGLIGHSLDEKRLKQPLYRHPWEDGLDTKGVGF

SEQ ID NO: 4362 - protein, 608 aa, Orobanche aegyptiaca
MATGQLFSKTTQALFYNYKQLPIQRMLDFDFLCGRETPSVAGIINPGSEGFQKLFFGQEEIAIPVHSAVEAACAAHPTADVFINFASFRSAATSSMAALKQPTIRVVAIIAEGVPESDTKQLIAYAKANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQVKMMVVLGELGGRDEYSLVEALKQGKVNKPVVAWVSGTCARLFKSEVQFGHAGAKSGGEMESAQAKNEALREAGAVVPTSFEAFECAIKETFEKLVGESKITPVKEVTPPQIPEDLNTAIKSGKVRAPTHIISTISDDRGEEPTYAGMPMSSIVEQGLGVGDVISLLWFKRSLPQYCTRFIEICIMLCADHGPCVSGAHNTIVTARAGKDTVSSLVSGLLTIGPRFGGAIDDAARYFKDAYDKGLTPYEFVESMKKKGIRVPGIGHRIKRGDNRDKRVELLQRFARSNFPSVKYMEYAVEVETYTLSKSNNLVLNVDGAIGSLFLDLLAGSGMFTNQEIDEIVGIGYLNGLFVLARSIGLIGHTFDQKRLKQPLYRHPWEDVLYTK

SEQ ID NO: 4363 - protein, 608 aa, Podocarpus macrophillus
MATGQLFSSTTQALFYNYKQLPIQRMLDFDFLCGRETPSVAGIINPGSEGFQKLFFGQEEIAIPVHSAIEAACKTHPTADVFINFASFRSAFASSMSALKQPTIRVVAIIAEGVPEGDAKQLIAYARANNKVIIGPATVGGIQAGAFKIGDTAGTIDNIIQCKLYRPGSVGFVSKSGGMSNEMYNTIARVTDGIYEGIAIGGDVFPGSTLSDHVLRFNNIPQVKMMVVLGELGGRDEYSLVEALKQGKVHKPVVAWVSGTCARLFKSEVQFGHAGAKSGGDLESAQAKNQALKEVGAIVPTSFEGLEETIKQTFQQLVEEGKIGPTRDVKPPPIPEDLNIAIKSGKVRAPTHIISTICDDRGEEPTYAGVPMSTIVEKGYGVGDVISLLWFKRSLPRYCTQFIEICIMLCADHGPCVSGAHNTIVTARAGKDLVSSLVSGLLTIGPRFGGAIDDAARYFKDAYDRGLSPYEFVEGMKKKGIRVPGIGHRIKRGDNRDKRVELLQLYGRTHFPAVKYMDYAVQVETYTLTKANNLVLNVDGAIGSLFLDLLSVSGMFTQQEIDEIVQIGYLNGLFVLARAIGLIGHTFDQKRLKQPLYRHPWEDVLYTK

SEQ ID NO: 4364 - protein, 608 aa, Solanum phureja
MATGQLFSKTTQALFYNYKQLPIQRMLDFDFLCGRETPSVAGIINPGSEGFQKLFFGQEEIAIPVHSTVEAACAAHPTADVFINFASFRSAAASSMSALKQPTIRVVAIIAEGVPESDTKQLIGFAKANNKVVIGPATVGGIQAGAFKIGDTAGTIDNIIQCKLYRPGSVGFVSKSGGMSNELYNTIARVTDGVYEGIAIGGDVFPGSTLSDHVLRFNNIPQVKMIVVLGELGGRDEYSLVEALKQGKINKPVVAWVSGTCATLFKSEVQFGHAGAKSGGEMESAQAKNQALSDAGATVPTSYEAFEGAIKEAFEKLVSEGKTTPVKEITPPQIPEDLNTAIKSGKVRAPTHIISTISDDRGEEPCYAGVPMSSIVEQGLGVGDVISLLWFKRSLPRYCTRFIEICTLLCADHGPCVSGAHNTIVTARAGKDLVSCLVSGLLTIGPRFGGAVDDAARYFKDAYDRGLTPYEFVESMKKKGIRVPGIGHRIKRGDNRDKRVELLQLYARENFPSVKYMEYAVQVETYTLSKANNLVLNVDGAIGSLFLDLLAGSGMFTKPEIDEIVDIGYLNGLFVLARSIGLIGHTFDQKRLKQPLYRHPWEDVLYTK

SEQ ID NO: 4365 - protein, 608 aa, Cucumis sativus
MATGQIFSRTTQALFYNYKQLPIQRMLDFDFLCGRETPSVAGIINPGSEGFQKLFFGQEEIAIPVHSTIEAACSAHPTADVFINFASFRSAAASSMAALKQPTIRVIAIIAEGVPESDTKQLIAYARANNKVVIGPATVGGIQAGAFKIGDTAGTIDNIVQCKLYRPGSVGFVSKSGGMSNEMYNTIARVTDGIYEGIAIGGDVFPGSTLSDHILRFNNIPQVKMMVVLGELGGRDEYSLVEALKQGKVNKPVVAWVSGTCATLFKSEVQFGHAGAKSGGELESAQAKNQALKEAGAIVPTSYEALEAAIKETFEKLVGDGEITPVKEVKPPQIPEDLNSAIKSGKVRAPTHIVTTISDERGEEPRYAGIPMSSIVEQGYGVGDVISLLWFKRSLPRYCTHFIEICIMLCADHGPCVSGAHNTIVTARAGKDLVSCLVSGLLTIGPRFGGAIDDAARYLKDACDRGLTAYEFVEGMKKKGIRVPGIGHRIKRGDNRDKRVELLQRFARTHFPTVKYMEYAVEVETYTLSKANNLVLNVDGAIGSLFLDLLAGSGMFSKQEIDEIVQIGYLNGLFVLARSIGLIGHTFDQKRLKQPLYRHPWEDVLYTK

SEQ ID NO: 4366 - protein, 608 aa, Fragaria vesca
MATGQLFSRTTQALFYNYKQLPIQRMLDFDFLCGRETPSVAGIINPGAEGFQKLFFGQEEIAIPVHSSIEASCAAHPTADVFINFASYRSAAASSLTALKQPTIRVVAIIAEGVPESDAKQLIAYARANNKVVIGPATVGGIQAGAFKIGDTAGTIDNIIHCKLYRPGSVGFVSKSGGMSNEMYNTVARVTDGLYEGIAIGGDVFPGSTLSDHVLRFNNIPQVKIIVVLGELGGRDEYSLVEALKQGKVNKPVVAWVSGTCATLFKSEVQFGHAGAKSGGEMESAQAKNQALRDAGAVVPTSYEALEIAIKETFEKLVEEGKIAPVKEFKPPQIPEDLNTAIKSGKVRAPTHIISTISDDRGEEPCYAGVPMSSIVEQGYGVGDVISLLWFKRSLPSYCTKFIEICVMLCADHGPCVSGAHNTIVTARAGKDLVSSLVSGLLTIGPRFGGAVDDAARYFKDAYDKNLTPYEFVESMKKRGIRVPGIGHRIKRGDNRDKRVELLQLFARTHFPSVKYMEYAVEVETYTLSKANNLVLNVDGAIGTLFLDLLAGSGMFNKQEIDEIVEIGYLNGLFVLARSIGLIGHTFDQKRLKQPLYRHPWEDVLYTK

SEQ ID NO: 4367 - protein, 608 aa, Aquilegia formosa
MATGQLFSRSTQALFYNYKQLPIQRMLDFDFLCGRETPSVAGIINPGAEGFQKLFFGQEEIAIPVHSAIEAACATHPTADVFINFASYRSAAASSMAALKQPTIRVVAIIAEGVPESDTKQLIAYAKANNKVVIGPATVGGIQAGAFKIGDTAGTIDNIIQCKLYRPGSVGFVSKSGGMSNELYNTIARVTDGLYEGIAIGGDVFPGSTLSDHVLRFNNIPQVKMMVVLGELGGRDEYSLVEALKQGKINKPVVAWVSGTCARLFKSEVQFGHAGAKSGGEMESAQAKNEALREAGAIVPTSFEAFEGAIKETFEKLVEQGKTTPVKEIQPPQIPEDLNVAIKSGKVRAPTHIISTISDDRGEEPCYAGVPMSSIVEQGYGVGDVISLLWFKRSLPRYCTQFIEICIMLCADHGPCVSGAHNTIVTARAGKDLVSSLVSGLLTIGPRFGGAIDDAARYFKDAYDKGLSPYEFVESMKKKGIRVPGIGHRIKRGDNRDKRVELLQLYGRTNFPSVKYMEYAVEVETYTLSKANNLVLNVDGAIGSLFLDLLAGSGMFSKPEIDEIVEIGYLNGLFVLARSIGLIGHTFDQKRLKQPLYRHPWEDVLYTK

SEQ ID NO: 4368 - protein, 382 aa, Nicotiana tabacum
  misc_feature (374)..(374): Xaa can be any naturally occurring amino acid
MATGQLFSKTTQALFYNYKQLPIQRMLDFDFLCGRETPSVAGIINPGSEGFQKLFFGQEEIAIPVHSTIEAACAAHPTADVFINFASFRSAAASSMSALKQPTIRVVAIIAEGVPESDTKQLIGYAKANNKVVIGPATVGGIQAGAFKIGDTAGTIDNIIQCKLYRPGSVGFVSKSGGMSNELYNTIARVTDGVYEGIAIGGDVFPGSTLSDHVLRFNNIPQIKMIVVLGELGGRDEYSLVEALKQGKINKPVVAWVSGTCARLFKSEVQFGHAGAKSGGEMESAQAKNQALKDAGAMVPTSYEAFEGAIKEAFEQLVSDGKTTPVKEITPPQIPEDLNTAIKSGKVRAPTHIISTISDDRGEEPCYAGVPMSXIVEQGLVW

SEQ ID NO: 4369 - protein, 608 aa, Theobroma cacao
MATGQLFSRTTQALFYNYKQLPIQRMLDFDFLCGRETPSVAGIINPGSEGFQKLFFGQQEIAIPVNSTIEAACAAHPTADVFINFASFRSAAASSLAALKQPTIRVVAIIAEGVPESDTKQLVAYAQANNKVVIGPATVGGIQAGAFKIGDTAGTIDNIIHCKLYRPGSVGFVSKSGGMSNELYNTIARVTDGIYEGIAIGGDVFPGSTLSDHILRFNNIPQVKMMVVLGELGGRDEYSLVEALKQGKVNKPVVAWVSGTCARLFKSEVQFGHAGAKSGGEMESAQAKNHALKEAGAVVPTSYEAFETAIKETFEKLVEEGKITAAKEFNPPQIPEDLNSAIKSGKVRAPTHIISTISDDRGEEPRYAGVPMSSIIEQGLGVGDVISLLWFKRSLPHYCTRFIEICIMLCADHGPCVSGAHNAIVTARAGKDLVSSLVSGLLTIGPRFGGAIDDAARYFKDACDRGLSPYEFVEGMKKKGIRVPGIGHRIKRGDNRDKRVEILQLFARTHFPSVKYMEYAVQVESYTLSKANNLVLNVDGAIGSLFLDLLVSSGMFSKPEIDEIVEIGYLNGLFVLARSIGLIGHTFDQKRLKQPLYRHPWEDVLYTK

SEQ ID NO: 4370 - protein, 608 aa, Tropaeolum majus
MATGQIFSRTTQALFYNYKQLPIQRMLDFDFLCGREIPSVAGIINPGSEGFQKLFFGQEEIAIPVHSTIEAACAAHPTADVFINFASFRSAAASSLSALKQPTIRVVAIIAEGVPESDTKHLIAYARANNKMVIGPATVGGIQAGAFKIGDTAGTIDNIIQCKLYRPGSVGFVSKSGGMSNELYNTIARVTDGLYEGIAIGGDVFPGSTLSDHVLRFNNIPQIKMIVVLGELGGRDEYSLVEALKQGKISKPVVAWVSGTCARLFKSEVQFGHAGAKSGGDMESAQAKNEALKDAGAVVPTSYEAFEDAIKEAFEKIVEAGNITPVKEITPPQIPEDLNIAIKSGKVRAPTHIISTISDDRGEEPCYAGVPMSSIVEQGMGVGDVISLLWFKRSLPRYCTQFIEICIMLCADHGPCVSGAHNTIVTARAGKDLVSCLVSGLLTIGPRFGGAIDDAARYFKDACDRGLAPYEFVESMKKKGIRVPGIGHRIKNRDNRDKRVELLQRYAKTHFPAVKYMEYAVQVETYTLSKANNLVLNVDGAIGSLFLDLLAGSGMFTKPEIDDIIGIGYLNGLFVLARSIGLIGHTFDQKRLKQPLYRHPWEDVLYTK

SEQ ID NO: 4371 - protein, 608 aa, Pseudotsuga menziesii
MATGQIFSRSTQALFYNYKQLPIQRMLDFDFLCGREIPSVAGIINPGSEGFQKLFFGQEEIAIPVHSAIDAACKAHPTADVFINFASFRSAFASSMTALKQPTIRVVAIIAEGVPEGDTKQLIAYARANNKVIIGPATVGGIQAGAFKIGDTAGTIDNVIQCKLYRPGSVGFVSKSGGMSNELYNTIARVTDGIYEGIAIGGDVFPGSTLSDHVLRFNNIPQVKMMVVLGELGGTDEYSLVEALKQGKVQKPVVAWVSGTCARLFKSEVQFGHAGAKSGGDLESAQGKNQALREAGAVVPTSYEGFETAIQQTFQKLVEEGKISPTPDVKPPAIPEDLNIAIKSGKVRAPTHIISTICDDRGEEPTYAGVPMSTIVEQGFGLGDVISLLWFKRSLPRYCTKFIEICIMLCADHGPCVSGAHNTIVTARAGKDLVSSLVSGLLTIGPRFGGAIDDAARYFKDAYDRGLSPYEFVEGMKKKGIRVAGIGHRIKRGDNRDKRVELLQEYARTHFPAVKYMDYAVQVETYTLSKANNLVLNVDGAIGSLFLDLLVVSGMFSQQEIDEIVEIGYLNGLFVLARSIGLIGHTFDQKRLKQPLYRHPWEDVLYTK

SEQ ID NO: 4372 - protein, 608 aa, Triphysaria pusilla
MATGQLFSKTTQALFYNYKQLPIQRMLDFDFLCGRETPSVAGIINPGSEGFQKLFFGQEEIAIPVHPAVEAACAAHPTADVFINFASFRSAAASSMSALKQPTIKVVAIIAEGVPESDTKQLIAYAKANNKVVIGPATVGGIQAGAFKIGDTAGTIDNIIQCKLYRPGSVGFVSKSGGMSNELYSSIARVTDGIYEGIAIGGDVFPGSTLSDHVLRFSNIPQIKMVVVLGELGGRDEYSLVEALKEGKINKPVVAWVSGTCATLFKSEVQFGHAGAKSGGEMESAQAKNQALRDAGAVVPTSYEAFEGAIKETFAKLVEAGKIPAVKEVKPPQIPEDLKTAIKSGKVRAPTHIISTISDDRGEEPTYAGVPMSSIVEQGLGVGDVISLLWFKRSLPHYCTRFIEICIMLCADHGPCVSGAHNSIVTARAGKDLVSCLVSGLLTIGPRFGGAIDDAARYFKDAYDRSLTPYEFVESMKKRGIRVPGIGHRIKSADNRDKRVELLQLFARTNFPSVKYMEYAVEVETYTLSKANNLVLNVDGAIGSLFLDLLSGSGMFTKQEIDEIVGIGYLNGLFVLARSIGLIGHTFDQKRLKQPLYRHPWEDVLYTK

SEQ ID NO: 4373 - protein, 238 aa, Prunus persica
MATGQLFSRTTQALFYNYKQLPIQRMLDFDFLCGRETPSVAGIINPGAEGFQKLFFGQEEIAIPVHSTIEASCAAHPTADVFINFASFRSAAASSMAALKQPTIRVVAIIAEGVPESDAKQLIAYARANNKVVIGPATVGGIQAGAFKIGDTAGTIDNIIHCKLYRPGSVGFVSNLVGCLMNIHTVARVQMDFLKVLLLEEMCSQVLLFLTMFCGLTISPRLNLLLYLGNLVGEMSIL

SEQ ID NO: 4374 - protein, 608 aa, Pinus taeda
MSTGQLFSRSTQALFYNYKQLPIQRMLDFDFLCGRETPSVAGIVNPGSEGFQKLFFGQEEIAIPVHSAIEAACKAHPTADVFINFASYRSAFASSMSALKQPTIRVVAIIAEGVPEGDTKQLIAYARANNKVIIGPATVGGIQAGAFRIGDTAGTIDNIIQCKLYRPGSVGFVSKSGGMSNELYNTIARVTDGIYEGIAIGGDVFPGSTLSDHVLRFNNIPQIKMMVVLGELGGRDEYSLVEALKQGKVQKPVVAWVSGTCARLFKSEVQFGHAGAKSGGDLESAQGKNQALREAGAVVPTSYEGFETVIQQTFQKLVEEGKISPTPDFKPPAIPEDLNTAIKSGKVRAPTHIISTICDDRGEEPSYAGVPMSTIVEQGFGLGDVISLLWFKRSLPRYCTKFIEICIMLCADHGPCVSGAHNTIVTARAGKDLVSSLVSGLLTIGPRFGGAIDDAARYFKDAHDRGLSPYEFVEGMKKKGIRVAGIGHRIKRGDNRDKRVELLQEYARTHFPAVKYMDYAVQVETYTLSKANNLVLNVDGAIGSLFLDLLAVSGMFSQQEIDEIVEIGYLNGLFVLARSIGLIGHTFDQKRLKQPLYRHPWEDVLYTK

SEQ ID NO: 4375 - protein, 608 aa, Zostera marina
MATGQIFSRNTQALFYNYKQLPIQRMLDFDFLCGREIPSVAGIINPGSEGFQKLFFGQEEIAIPVHSTVEAACSAHSTADVFINFASFRSAAASSMAALKQPTIKVVAIIAEGVPELDTKRLIAYAQANNKVIIGPATVGGIQAGAFKIGDTAGTLDNIIQCKLYRPGSVGFVSKSGGMSNELYNTIARATDGIYEGIAIGGDVFPGSTLSDHVLRYNNIPQVKMIVVLGELGGKDEYSLIEALKEGKIQKPVVAWVSGTCARLFKSEVQFGHAGAKSGGELESAQAKNQALKEAGAIVPTSYETFEGAIKETFEKLVDEGKIVPIHEVTPPPIPEDLSTAIKSGKVRAPTHIISTISDDRGEEPTYAGVPMSTIIEQGFGVGDVISLLWFKRSLPRYCTKFIEICIMLCADHGPCVSGAHNTIVTARAGKDLVSSLVSGLLTIGPRFGGAIDDAARYFKDAVDRAITPYEFVEGMKKKGIRVPGIGHRIKRADNRDKRVELLQEYARTHFPSVKHMEYAVQVETYTLSKANNLVLNVDGAIGSLFLDLLASSGMFNKQEIDEIVEIGYLNGLFVLARSIGLIGHTFDQKRMKQPLYRHPWEDVLYTK

SEQ ID NO: 4376 - protein, 608 aa, Pinus taeda
  misc_feature (148)..(148): Xaa can be any naturally occurring amino acid
MSTGQLFSRSTQALFYNYKQLPIQRMLDFDFLCGRETPSVAGIVNPGSEGFQKLFFGQEEIAIPVHSAIEAACKAHPTADVFINFASYRSAFASSMSALKQPTIRVVAIIAEGVPEGDTKQLIAYARANNKVIIGPATVGGIQAGAFXIGDTAGTIDNIIQCKLYRPGSVGFVSKSGGMSNELYNTIARVTDGIYEGIAIGGDVFPGSTLSDHVLRFNNIPQIKMMVVLGELGGRDEYSLVEALKQGKVQKPVVAWVSGTCARLFKSEVQFGHAGAKSGGDLESAQGKNQALREAGAVVPTSYEGFETVIQQTFQKLVEEGKISPTPDFKPPAIPEDLNTAIKSGKVRAPTHIISTICDDRGEEPSYAGVPMSTIVEQGFGLGDVISLLWFKRSLPRYCTKFIEICIMLCADHGPCVSGAHNTIVTARAGKDLVSSLVSGLLTIGPRFGGAIDDAARYFKDAHDRGLSPYEFVEGMKKKGIRVAGIGHRIKRGDNRDKRVELLQEYARTHFPAVKYMDYAVQVETYTLSKANNLVLNVDGAIGSLFLDLLAVSGMFSQQEIDEIVEIGYLNGLFVLARSIGLIGHTFDQKRLKQPLYRHPWEDVLYTK

SEQ ID NO: 4377 - protein, 608 aa, Helianthus annuus
MATGQLFSRTTQALFYNYKQLPIQRMLDFDFLCGRETPSVAGIINPGAEGFQKLFFGQEEIAIPVHSTIEAACAAHPTADVFINFASYRSAAASSNLALKQPTIRVVAIIAEGVPEADTKELIAYARANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQVKMIVVLGELGGRDEYSLVEALKAGKINKPVCAWVSGTCARLFKSEVQFGHAGAKSGGEMESAQAKNQALGDAGAIVPTSYEAFETSIKETFQKLAEEGKISPIKEFTPPQIPEDLNSAIKSGKVRAPTHIISTISDDRGEEPCYAGVPMSTIIEKGMGVGDVISLLWFKRSLPRYCTQFIEICIMLCADHGPCVSGAHNTIVTARAGKDLVSSLVSGLLTIGPRFGGAIDDAARYFKDAYDRKLSPYEFVESMKKKGIRVPGIGHRIKRGDNKDKRVELLQLFARTNFPSTKYMEYAVEVETYTLSKANNLVMNVDGAIGSLFLDLLAGSGMFTKQEIDEIISIGYLNGLFVLARSIGLIGHTFDQKRLKQPLYRHPWEDVLYTK

SEQ ID NO: 4378 - protein, 608 aa, Helianthus annuus
MATGQLFSRTTQALFYNYKQLPIQRMLDFDFLCGRETPSVAGIINPGAEGFQKLFFGQEEIAIPVHSTIEAACAAHPTADVFINFASYRSAAASSNLALKQPTIRVVAIIAEGVPEADTKELIAYARANNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQVKMIVVLGELGGRDEYSLVEALKAGKINKPVCARVSGTCARLFKSEVQFGHAGAKSGGEMESAQAKNQALGDAGAIVPTSYEAFETSIKETFQKLAEEGKISPIKEFTPPQIPEDLNSAIKSGKVRAPTHIISTISDDRGEEPCYAGVPMSTIIEKGMGVGDVISLLWFKRSLPRYCTQFIEICIMLCADHGPCVSGAHNTIVTARAGKDLVSSLVSGLLTIGPRFGGAIDDAARYFKDAYDRKLSPYEFVESMKKKGIRVPGIGHRIKRGDNKDKRVELLQLFARTNFPSTKYMEYAVEVETYTLSKANNLVMNVDGAIGSLFLDLLAGSGMFTKQEIDEIISIGYLNGLFVLARSIGLIGHTFDQKRLKQPLYRHPWEDVLYTK

SEQ ID NO: 4379 - protein, 608 aa, Malus domestica
MATGQLFSRTTQALFYNSKQLPIQRMLDFDFLCGRETPSVAGIINPGSEGFQKLFFGQEEIAIPVHSNIEASCAAHPTADVFINFASYRSAAASSMAALKQPTIRVVAIIAEGVPESDTKQLIAYARANNKVVIGPATVGGIQAGAFKIGDTAGTIDNIIHCKLYRPGSVGFVSKSGGMSNELYNTVARVTDGLYEGIAIGGDVFPGSTLSDHVLRFNNIPQVKLIVVLGELGGRDEYSLVEALKQGKVTKPVVAWVSGTCARLFKSEVQFGHAGAKSGGEMESAQAKNQALRDAGAVVPSSYEALETAIKETFENLVEQGKIAPVKEFKPPQIPEDLNSAIKSGKVRAPTHIISTISDDRGEEPCYGGVPMSSIVEQGYGVGDVISLLWFKRSLPSYCTKFIEICIMLCADHGPCVSGAHNTIVTARAGKDLVSSLVAGLLTIGPRFGGAVDDAARYFKDAYDRNLTPYEFVESMKKKGIRVPGIGHRIKRGDNRDKRVELLQAFARTNFPSVKYMEYAVQVETYTLSKANNLVLNVDGAIGTLFLDLLAGSGMFTKPEIDEIVEIGYLNGLFVLARSIGLIGHTFDQKRLKQPLYRHPWEDVLYTK

SEQ ID NO: 4380 - protein, 266 aa, Centaurea maculosa
MATGQLFSRTTQALFYNYKQLPIQRMLDFDFLCGRETPSVAGIINPGAEGFQKLFFGQEEIAIPVHSTVEAACAAHPTADVFINFASYRSAAASSNLALKQPTIRVVAIIAEGVPESDTKELIAYARSNNKVVIGPATVGGIQAGAFKIGDTAGTIDNIIQSKLYRPGSVGFVSKSGGMSNELYNTIARVTDGIYEGIAIGGDVFPGSTLSDHVLRFNNIPQVKMIVVLGELGGRDEYSLVEALKAGKISNQFVLGSVELVPAFSV

SEQ ID NO: 4381 - protein, 608 aa, Artemisia annua
MATGQIFSRTTQSLFYNFKQLPIQRMLDFDFLCGRETPSVAGIINPGAEGFQKLFFGQEEIAIPVHSTIEAACAAHPTADVFINFASFRSAAASSKLALKQPTIRVVAIIAEGVPESDTKELISYARSNNKVVIGPATVGGVQAGAFKIGDTAGTIDNIIQCKLYRPGSVGFVSKSGGMSNEMYNTIARVTDGIYEGIAIGGDVFPGSTLSDHVLRFNNIPQIKMIVVLGELGGRDEYSLVEALKSGKINKPVCAWVSGTCARLFKSEVQFGHAGAKSGGEMESAQAKNQALKEAGAIVPTSYEAFESSIKETFAKLCEDGKITPVKEITPPQIPEDLNSAIKSGKVRAPTHIISTISDDRGEEPCYAGVPMSTIVETGMGVGDVISLLWFKRNLPRYCTQFIEICVMLCADHGPCVSGAHNTIVTARAGKDLVSSLVSGLLTIGPRFGGAVDDAARYFKDAYDRKLSPYEFVESMKKQGIRVPGIGHRIKRGDNRDKRVELLQLFARTHFPSTKYMEYAVEVETYTLSKANNLVLNVDGAIGTLFLDLLAGSGMFTKQEIDEIVAIGYLNGLFVLARSIGLIGHTFDQKRLKQPLYRHPWEDVLYTK

SEQ ID NO: 4382 - protein, 608 aa, Picea glauca
MATGQLFSRSTQALFYNYKQLPIQRMLDFDFLCGREIPSVAGIINPGSEGFQKLFFGQEEIAIPVHSAIEAACKAHPTADVFINFASYRSAFASSMSALKQPTIRVVAIIAEGVPEGDTKQLIAYARANNKVIIGPATVGGIQAGAFKIGDTAGTIDNIIQCKLYRPGSVGFVSKSGGMSNELYNTVARVTDGIYEGIAIGGDVFPGSTLSDHVLRFNNIPQVKMMVVLGELGGRDEYSLVEALKQGKVQKPVVAWVSGTCARLFKSEVQFGHAGAKSGGELESAQGKNQALREAGAVVPTSYEGFETAIQQTFQKLVEEGKIGATPDVKPPAIPEDLNIAIKSGKVRAPTHIISTICDDRGEEPSYAGVPMSTIVEQGFGLGDVISLLWFKRSLPRYCTKFIEICIMLCADHGPCVSGAHNTIVTARAGKDLVSSLVSGLLTIGPRFGGAIDDAARYFKDAHDKGLSAYEFVEGMKKKGIRVAGIGHRIKRGDNRDKRVELLQEYARTHFPAVKYMDYAVQVETYTLSKANNLVLNVDGAIGSLFLDLLVVSGMFSQPEIDEIVEIGYLNGLFVLARSIGLIGHTFDQKRLKQPLYRHPWEDVLYTK

SEQ ID NO: 4383 - protein, 623 aa, Populus trichocarpa
MATGQLFSRTTQALFYNYKQLPIQRMLDFDFLCGRELPSVAGIINPGAEGFQKLFFGQEEIAIPVHSTIEAACAAHPTADVFINFASFRSAAASSMSALKQPTVRVVAIIAEGVPEADAKQLIAYARANNKARTMMQCYLNCNERKVVIGPATVGGIQAGAFKIGDTAGTIDNIIACKLYRPGSVGFVSKSGGMSNELYNSIARVTDGIYEGIAIGGDVFPGSTLSDHVLRFNNIPQVKMIVVLGELGGRDEYSLVEALKQGKVSKPVVAWVSGTCARLFKSEVQFGHAGAKSGGEMESAQAKNQALKDAGAVVPTSYEAFETAIKETFEKLVEEGKISSVKEFTPPQIPEDLNIAIKSGKVRAPTHIISTISDDRGEEPCYAGVPMSSIVEQGYGVGDVISLLWFKRSLPRYCTHFIEICIMLCADHGPCVSGAHNTIVTARAGKDLVSSLVSGLLTIGPRFGGAIDDAARYFKDAYDRGLTPYEFVESMKKKGIRVPGIGHRIKRGDNRDKRVELLQLFARTHFPSVKYMEYAVQVETYTLSKANNLVLNVDGAIGSLFLDLLAGSGMFTKQEIDEIVGIGYLNGLFVLARSIGLIGHTFDQKRLKQPLYRHPWEDVLYSK

SEQ ID NO: 4384 - protein, 608 aa, Sequoia sempervirens
MATGQLFSRTTQALFYNYKQLPIQRMLDFDFLCGRETPSVAGIINPGSEGFQKLFFGQEEIAIPVHSAIEAACTAHPTADVFINFASYRSAYASSMSALKQPTIRVVAIIAEGLPERDTKQLIAYARANNKVIIGPATVGGIMAGAFKIGDTAGTIDNIIHSKLYRPGSVGFVSKSGGMSNEMYNTIARVTDGIYEGIAIGGDGFPGSTLSDHILRFNNIPQVKMMVVLGELGGRDEYSLVEALKQGKVQKPVVAWVSGTCARLFKSEVQFGHAGAKSGGDLESAQGKNQALREAGAIVPSSYEALEDAIKQTFESLVEAGIIGQTHEYKPPQIPEDLNTAIKSGKVRAPTHVISTICDDRGEEPTYAGIPMSTIVEKGYGVGDVISLLWFKRSLPRYCTKFIEICIMLCADHGPCVSGAHNTIVTARAGKDLVSSLVSGLLTIGPRFGGAIDDAARYFKDAYDKGLSPYEFVEGMKKKGIRVPGIGHRIKRGDNRDKRVELLQLYARTNFPAVKYMDYAVQVETYTLSKANNLVLNVDGAIGSLFLDLLVVSGMFNQQEIDEIVEIGYLNGLFVLARSIGLIGHTFDQKRLKQPLYRHPWEDVLYTK

SEQ ID NO: 4385 - protein, 608 aa, Cichorium intybus
MATGQLFSRTTQALFYNYKQLPIQRMLDFDFLCGRETPSVAGIINPGAEGFQKLFFGQEEIAIPVHSTVEAACAAHPTADVFINFASYRSAAASSNLALKQPTIRVVAIIAEGVPESDTKELIAYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQIKMIVVLGELGGRDEYSLVEALKAGKINKPVCAWVSGTCARLFKSEVQFGHAGAKSGGEMESAQAKNQALTDAGAIVPTSYESFETSIKETFAKLAEEGKISPVKEFTPPQIPEDLNSAIKSGKVRAPTHIISTISDDRGEEPCYAGVPMSSIVEKGMGVGDVISLLWFKRSLPRYCTQFIEICIMLCADHGPCVSGAHNTIVTARAGKDLVSSLVSGLLTIGPRFGGAIDDAARYFKDAYDRKLSPYEFVESMKKKGIRVPGIGHRIKRGDNRDKRVELLQLFARTNFPSTKYMEYAVEVETYTLSKANNLVMNVDGAIGTLFLDLLAGSGMFTKQEIDEIVGIGYLNGLFVLARSIGLIGHTFDQKRLKQPLYRHPWEDVLYTK

SEQ ID NO: 4386 - protein, 423 aa, Centaurea maculosa
  misc_feature (251)..(251): Xaa can be any naturally occurring amino acid
  misc_feature (295)..(295): Xaa can be any naturally occurring amino acid
  misc_feature (301)..(301): Xaa can be any naturally occurring amino acid
  misc_feature (414)..(414): Xaa can be any naturally occurring amino acid
MATGQIFSRTTQALFYNYKQLPIQRMLDFDFLCGRETPSVAGIINPGAEGFQKLFFGQEEIAIPVHSTIEAACAAHPTADVFINFASFRSAAASSKLALKQPTIRVVAIIAEGVPEFDTKELISYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQIKMIVVLGELGGRDEYSLVEALKSGKITXPVCAWVSGTCARLFKSEVQFGHAGAKSGGEMESAQAKNQALKDXGAVVPXSYEAFETSIKETFAKLAEEGKITQVKEITPPQIPEDLNSAIKSGKVRAPTHIISTISDDRGEEPCYAGVPMSTIVEKGWALVTLFLFCGSSVVFPATAHNSLRFVSCYVRTTXRVSLVLTTQ

SEQ ID NO: 4387 - protein, 355 aa, Cynara scolymus
  misc_feature (269)..(269): Xaa can be any naturally occurring amino acid
MCLGQWNLCTPLQSEVQFGHAGAKSGGEMESAQAKNQALKDAGAVVPTSYEAFEASIKETFAKLAEEGKITQVKEITPPQIPEDLNSAIKSGKVRAPTHIISTISDDRGEEPCYAGVPMSTIVEKGMGIGDVISLLWFKRSLPRYCTHFIEICVMLCADHGPCVSGAHNTIVTARAGKDLVSSLVSGLLTIGPRFGGAVDDAARYFKDAYDRKLSPYEFVESMKKKGIRVPGIGHRIKRGDNRDKRVELLQLFARTHFPSTKYMEYAVXVEAYTLSKANNLVMNVDGAIGTLFLDLLAGSGMFTKQEIDEIVAIGYLNGLFVLARSIGLIGHTFDQRRLKQPLYRHPWEDVLYTK

SEQ ID NO: 4388 - protein, 608 aa, Gnetum gnemon
MASGQLFSHTTQALFYNYKQLPIQRMLDFDFLCGRETPSVAGIINPGSEGFQKLFFGQEEIAIPVHSNIESACVAHPTADVFINFASYRSAFASSMTALKQPTVRVVAIIAEGVPEGDTKQLIAYARANNKVIIGPATVGGIQAGAFKIGDTAGTIENIVRCKLYRPGSVGFVSKSGGMSNELYNTISRVTDGIYEGIAIGGDVFPGSTLSDHVLRFNNIPQVKMMVVLGELGGRDEYSLVEALKQGKVQKPVVAWVSGTCARLFKSEVQFGHAGAKSGGDLESAQAKNQALKDAGAIVPISYEGLEAAIQETFQKLAEEGKISPTPDVKPPPIPEDLSVAIKSGRVRAPTHVISTICDDRGEEPTYAGVAMSTIIESGFGVGDVISLLWFKRSLPRYCTRFIEMCIMLCADHGPCVSGAHNTIVTARAGKDLVSSLVSGLLTIGPRFGGAIDDAARYFKDAFDKGLTPYEFVEGMKKKGIRVPGIGHRIKRGDNRDKRVELLQAYARTHFPSVKYMEYAVQVETYTLSKANNLVLNVDGAIGSLFLDLLAGSAMFTQQEIDEIVQIGYLNGLFVLARSIGLIGHTFDQKRLKQPLYRHPWEDVLYTK

SEQ ID NO: 4389 - protein, 609 aa, Mimulus guttatus
MAATGQIFSRTTQALFYNYKQLPIQRMLDFDFLCGRETPSVAGIINPGSEGFQKLFFGQEEIAIPVHSAVEAACAAHPTADVFINFASFRSAAASSMAALKQPTIRVVAIIAEGVPESDTKQLIAYAKANNKVLIGPATVGGVQAGAFKIGDTAGTIDNIIQCKLYRPGSVGFVSKSGGMSNELYNSIARVTDGIYEGIAIGGDVFPGSTLSDHVLRFNNIPQIKMMVVLGELGGRDEYSLVEALKTGKINKPVVAWVSGTCATLFKSEVQFGHAGAKSGGEMESAQAKNEALRQAGAIVPTSYEAFEGAIKETFSKLVEGGKVTTVKEVKPPQIPEDLSTAIKSGKVRAPTHIISTISDDRGEEPTYAGVPMSSIVEQGLGVGDVISLLWFKRSLPHYCSRFIEICIMLCADHGPCVSGAHNTIVTARAGKDLVSSLVSGLLTIGPRFGGAIDDAARYFKDAYDKGLTPYEFVESMKKKGIRVPGIGHRIKRGDNRDKRVELLQLFARSNFPSVKYMEYAVEVETYTLSKANNLVLNVDGAIGSLFLDLLAGSGMFTKQEIDEIVGIGYLNGLFVLARSIGLIGHTFDQKRLKQPLYRHPWEDVLYTK

SEQ ID NO: 4390 - protein, 608 aa, Lactuca sativa
MATGQLFSRTTQALFYNYKQLPIQRMLDFDFLCGRETPSVAGIINPGAEGFQKLFFGQEEIAIPVHSTVEAACAAHPTADVFINFASYRSAAASSNLALKQPTIRVVAIIAEGVPESDTKELIAYARSNNKVVIGPATVGGIQAGAFKIGDTAGTIDNIIQCKLYRPGSVGFVSKSGGMSNELYNTIARVTDGLYEGIAIGGDVFPGSTLSDHVLRFNNIPQIKMIVVLGELGGRDEYSLVEALKAGKINKPVCAWVSGTCARLFKSEVQFGHAGAKSGGEMESAQAKNQALMDAGAIVPTSYESFETSIKETFAKLAEEGKISPVKEITPPQIPEDLNSAIKSGKVRAPTHIISTISDDRGEEPCYAGVPMSSIIEKGMGVGDVISLLWFKRSLPRYCTQFIEICIMLCADHGPCVSGAHNTIVTARAGKDLVSSLVSGLLTIGPRFGGAVDDAARYFKDAYDRKLSPYEFVESMKKKGIRVPGIGHRIKRGDNRDKRVELLQLFARTNFPSTKYMEYAVEVETYTLSKANNLVMNVDGAIGTLFLDLLAGSGLFTKQEIDEIVSIGYLNGLFVLARSIGLIGHTFDQKRLKQPLYRHPWEDVLYTK

SEQ ID NO: 4391 - protein, 608 aa, Mimulus guttatus
MATGQLFSKTTQALFYNYKQLPIQRMLDFDFLCGRETPSVAGIINPGSEGFQKLFFGQEEIAIPVHSDVAAACAAHPTADVFINFASYRSAAASSMSALKQPTIKVVAIIAEGVPELDTKQLIAYAKANNKVVIGPATVGGIQAGAFKIGDTAGTIDNIIQCKLYRPGSVGFVSKSGGMSNELYNSIARVTDGIYEGIAIGGDVFPGSTLSDHVLRFNNIPQVKMIVVLGELGGRDEYSLVEALKQGKISKPVVAWVSGTCATLFKSEVQFGHAGAKSGGEMESAQAKNEALREAGAIVPTSYEAFEGAIKEAFAKLVEAGKTTPVKEITPPQIPEDLSSAIKSGKVRAPTHIISTISDDRGEEPTYAGVPMSSIVEQGLGVGDVISLLWFKRSLPRYCTRFIEICIMLCADHGPCVSGAHNTIVTARAGKDLVSSLVSGLLTIGPRFGGAIDDAARYFKDAYDKGLTPYEFVESMKKKGIRVPGIGHRIKRGDNRDKRVELLQEFSRSNFPSVKYMEYAVEVETYTLSKANNLVLNVDGAIGSLFLDLLAGSGMFTKQEIDEIVGIGYLNGLFVLARSIGLIGHTFDQKRLKQPLYRHPWEDVLYTK

SEQ ID NO: 4392 - protein, 280 aa, Taxus baccata
MATGQLFSRSTQALFYNYKQLPIQRMLDFDFLCGRETPSVAGIINPGSEGFQKLFFGQEEIAIPVHSAIEAACKVHPTADVFINFASYRSAYASSMSALKQPTIRVVAIIAEGVPEGDAKQLIAYARANNKVIIGPATVGGIQAGAFKIGDTAGTIDNIIQCKLYRPGSIGFVSKSGGMSNEMYNTIGRVTDGIYEGIAIGGDVFPGSTLSDHVLRFNNIPQIKMMVVLGELGGRDEYSLVEALKQGKVQKPVVAWVSGTCARLFKSEVQFGHAGAKKWR

SEQ ID NO: 4393 - protein, 384 aa, Mimulus guttatus
MIVVLGELGGRDEYSLVEALKQGKISKPVVAWVSGTCATLFKSEVQFGHAGAKSGGEMESAQAKNEALREAGAIVPTSYEAFEGAIKEAFAKLVEAGKTTPVKEITPPQIPEDLSSAIKSGKVRAPTHIISTISDDRGEEPTYAGVPMSSIVEQGLGVGDVISLLWFKRSLPRYCTRFIEICIMLCADHGPCVSGAHNTIVTARAGKDLVSSLVSGLLTIGPRFGGAIDDAARYFKDAYDKGLTPYEFVESMKKKGIRVPGIGHRIKRGDNRDKRVELLQEFSRSNFPSVKYMEYAVEVETYTLSKANNLVLNVDGAIGSLFLDLLAGSGMFTKQEIDEIVGIGYLNGLFVLARSIGLIGHTFDQKRLKQPLYRHPWEDVLYTK

SEQ ID NO: 4394 - protein, 616 aa, Populus trichocarpa
MATGQLFSRTTQALFYNYKQLPIQRMLDFDFLCGRELPSVAGIINPGAEGFQKLFFGQEEIAIPVHSTVEAACTAHPTADVFINFASFRSAAASSMAALKQPTVRVVAIIAEGVPEADTKQLIAYARANNKVVIGPATVGGIQAGAFKIGETAGTIDNIIACKLYRSGSVGFVSKSGGMSNELYNAIARVTDGIYEGIAIGGDVFPGSTLSDHVLRFNNIPQVKIMVVLGELGGRDEYSLVEALKQGKVNKPVVAWVSGTCARLFKSEVQFGHAGAKSGGEMESAQAKNQAIKDAGAVVPTSYEAFETAIKETFEKLVDEGKITPVKEFTPPQIPEDLNIAIKSGKVRAPTHIISTISDERGTFNQYFLSEEPCYAGVPMSSIVEQGYGVGDVISLLWFKRSLPRYCTHFMEICIMLCADHGPCVSGAHNTIVTARAGKDLVSSLVSGLLTIGPRFGGAIDDASRYFKDAYDKGLTPYEFVEGMKKKGIRVPGIGHRIKRGDNRDKRVELLQRFARTHFPSVKYMEYAVLVETYTLSKANNLVLNIDGAIGSLFLDLLAGSRMFTKPEIDEIVGIGYLNGLFVLARSIGLIGHTFDQKRLKQPLYRHPWEDVLYTK

SEQ ID NO: 4395 - protein, 616 aa, Populus trichocarpa
MATGQLFSRTTQALFYNYKQLPIQRMLDFDFLCGRELPSVAGIINPGAEGFQKLFFGQEEIAIPVHSTVEAACTAHPTADVFINFASFRSAAASSMAALKQPTVRVVAIIAEGVPEADTKQLIAYARANNKVVIGPATVGGIQAGAFKIGETAGTIDNIIACKLYRSGSVGFVSKSGGMSNELYNAIARVTDGIYEGIAIGGDVFPGSTLSDHVLRFNNIPQVKIMVVLGELGGRDEYSLVEALKQGKVNKPVVAWVSGTCARLFKSEVQFGHAGAKSGGEMESAQAKNQAIKDAGAVVPTSYEAFETAIKETFEKLVDEGKITPVKEFTPPQIPEDLNIAIKSGKVRAPTHIISTISDERGTFNQCFLSEEPCYAGVPMSSIVEQGYGVGDVISLLWFKRSLPRYCTHFMEICIMLCADHGPCVSGAHNTIVTARAGKDLVSSLVSGLLTIGPRFGGAIDDASRYFKDAYDKGLTPYEFVEGMKKKGIRVPGIGHRIKRGDNRDKRVELLQRFARTHFPSVKYMEYAVLVETYTLSKANNLVLNIDGAIGSLFLDLLAGSRMFTKPEIDEIVGIGYLNGLFVLARSIGLIGHTFDQKRLKQPLYRHPWEDVLYTK

SEQ ID NO: 4396 - protein, 318 aa, Aristolochia fimbriata
MATGQLFSRNTQALFYNYKQLPIQRMLDFDFLCGREIPSVAGIINPGAEGFQKLFFGQEEIAIPVHSSIDAACSAHPTADVFINFASFRSAAASSMAALKQPTIRVVAIIAEGVPESDTKQLIAYARSNNKVVIGPATVGGIQAGAFKIGDTAGTIDNIIQCKLFRPGSVGFVSKSGGMSNELYNTIARVTDGIYEGIAIGGDVFPGSTLSDHVLRFNNIPQVKMMVVLGELGGQDEYSLVEALKQGKVQKPVVAWVSGTCARLFKSEVQFGHAGAKSGGELESAQAKNQALRGAGAVVPTYFEAFEDAIKETFEKLV

SEQ ID NO: 4397 - protein, 380 aa, Artemisia annua
MWERNAFSCGIINPGAEGFQKLFFGAIPVHSTIEAASAAHPTADVFINFASYRSAAASSNLALKQPTIRVVAIIAEGVPESDTKELIAYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNIPQIKMIVVLGELGGRDEYSLVEALKAGKISKPVCAWVSGTCARLFKSEVQFGHAGAKSGGEMESAQAKNQALMDAGAVVPTSYEAFETSIKETFAKLADEGKISPVKEITPPQIPEDLNTAIKSGKVRAPTHIISTISDDRGEEPCSMSSIVEKGMGVGDVISLLVFLATAHNSLRFASCYVPITGLVYPVLTTQL

SEQ ID NO: 4398 - protein, 584 aa, Lactuca sativa
MATGQLFSRTTQALFYNYKQLPIQRMLDFDFLCGRETPSVAGIINPGAEGFQKLFFGQEEIAIPVHSTVEAACAAHPTADVFINFASYRSAAASSNLALKQPTIRVVAIIAEGVPESDTKELIAYARSNNKVVIGPATVGGVQAGAFKIGDTAGTIDNIIQCKLYRPGSVGFVSKSGGMSNELYNTIARVTDGLYEGIAIGGDVFPGSTLSDHVLRFNNIPQIKMIVVLGELGGRDEYSLVEALKAGKINKPVCAWVSGTCARLFKSEVQFGHAGAKSGGEMESAQAKNQALMDAGAIVPTSYESFEASIKETFAKLAEEGKISPVKEITPPQIPEDLNSAIKSGKVRAPTHIISTISDDRGEEPCYAGVPMSTIVEKGMGVGDVISLLWFKRSLPRYCTQFIEICIMLCADHGPCVSGAHNTIVTARAGKDLVSSLVSGLLTIGPRFGGAVDDAARYFKDAYDRKLSPYEFVESMKKKGIRVPGIGHRIKRGDNRDKRVELLQLFARTNFPSTKYMEYAVEVETYTLSKANNLVMNVDGAIGTLFLDLLAGSGLFTKQEIDDIVNIGYLNGLFVLARSIGLIG

SEQ ID NO: 4399 - protein, 610 aa, Physcomitrella patens
MATGQLFSRTTQALFYNYKPSPVQRMLDFDFLCGRETPSVAGVINPGSDGFQKLFFGQEEIAVPVHGSIPSACKIHPTADVFINFASFRSAYASSMEALKQPTIRVVAIIAEGVPEADAKRLIAFARANNKVVIGPATVGGIQAGAFKIGDTAGTLDNIIHCKLYRPGSVGFVSKSGGMSNEMYNVLARVTDGLYEGIAIGGDVYPGSTLSDHVLRFNNIPQIKMIVVLGELGGRDEYSLVDALKEGKVGKPVVAWVSGTCARLFKSEVQFGHAGAKSGGDEESAQAKNKALADAGAIVPTSFEGLEATVKATYDSLVDKKVIIPVKDFVPPTVPEDLNSAIKSGKVRAPTHIVSTICDDRGEEPTYAGVPMSTIIEKDYGVGDVISLLWFKRSLPRYCTKFIEMCVMLCADHGPAVSGAHNTIVTARAGKDLVSSLVSGLLTIGPRFGGAIDDAARYFKEAHDKGLTPYDFVESMKKKGIRVPGIGHRIKSRDNRDKRVELLQKYARTQFPNVKYMEYAVTVETYTLSKANNLVLNVDGCIGSLFLDLLSSCAMFTPQEIDEIIEIGYLNGLFVLARSIGLIGHTFDQKRLKQPLYRHPWEDVLYTKYT

SEQ ID NO: 4400 - protein, 610 aa, Ceratodon purpureus
MATGQLFSRSTQALFYNYKQSPVQRMLDFDFLCGRETPSVAGVINPGSDGFQKLFFGQEEIAIPVHGSILSACKLHPTADVFINFASFRSAYASSMEALKQPTIRVIAIIAEGVPEADAKRLIAYARANNKVVIGPATVGGIQAGAFKIGDTAGTLDNIIHCKLYRPGSVGFVSKSGGMSNEMYNVLARVTDGLYEGIAIGGDVYPGSTLSDHVLRFNNIPQIKMIVVLGELGGRDEYSLVDALKQGKVSKPVVAWVSGTCATLFKSEVQFGHAGAKSGGDEESAQTKNKALADAGAIVPTSFEGLEATIKATYDSLVEKKVITPVKDFVPPTVPEDLNAAIKSGKVRAPTHIVSTICDDRGEEPTYAGVPMSTIIEKDYGVGDVISLLWFKRSLPRYCTKFIEMCILLCADHGPAVSGAHNSIVTARAGKDLVSCLVSGLLTIGPRFGGAIDDAARYFKDAHDKKLSPYEFVESMKKKGIRVPGIGHRIKSRDNRDKRVELLQKYARTHFPNVKYMEYAVTVETYTLTKANNLVLNVDGCIGSLFLDLLSSCQMFTAQEITEIIEIGYLNGLFVLARSIGLIGHTFDQKRLKQPLYRHPWEDVLYTKYT

SEQ ID NO: 4401 - protein, 610 aa, Physcomitrella patens
MATGQLFSRTTQALFYNYKQSPVQRMLDFDFLCGRETPSVAGVINPGSDGFQKLFFGQEEIAVPVHGSIPSACKVHPTADVFINFASFRSAYASSMEALKQSTIRVVAIIAEGVPEADAKRLIAYARANNKVVIGPATVGGIQAGAFKIGDTAGTLDNIIHCKLYRPGSVGFVSKSGGMSNEMYNVLARVTDGLYEGIAIGGDVYPGSTLSDHVLRFNNIPQIKMIVVLGELGGKDEYSLVDALKEKKVSKPVVAWVSGTCARLFKSEVQFGHAGAKSGGDEESAQAKNKALADAGAIVPTSFEGLEAVVKATYDSMVEKSVIIPVKDFIPPTVPEDLNAAIKSGKVRAPTHIVSTICDDRGEEPTYAGVAMSTIIEKDYCVGDVISLLWFRRSLPRYCTKFIEMCIMLCADHGPAVSGAHNTIVTARAGKDLVSSLVSGLLTIGPRFGGAIDDAARYFREAHDNGLSPYAFVESMKKKGIRVPGIGHRIKSRDNRDKRVELLQKYARTQFPNVKYMEYAVTVESYTLTKANNLVLNVDGCIGALFLDLLSSCAMFSKQEIDEIIQIGYLNGLFVLARSIGLIGHTFDQKRLKQPLYRHPWEDVLYTKYT

SEQ ID NO: 4402 - protein, 322 aa, Carthamus tinctorius
  misc_feature (248)..(248): Xaa can be any naturally occurring amino acid
MATGQLFSRTTQALFYNYKQLPIQRMLDFDFLCGRETPSVAGIINPGAEGFQKLFFGQEEIAIPVHSTVEAACAAHPTADVFINFASYRSAAASSNLALKQPTIRVVAIIAEGVPESDTKELIAYARSNNKVVIGPATVGGIQAGAFKIGDTAGTIDNIIQSKLYRPGSVGFVSKSGGMSNELYNTIARVTDGIYEGIAIGGDVFPGSTLSDHVLRFNNIPQVKMIVVLGELGGRDEYSLVEALKAGXISKPVCAWVSGTCAGSSSLKFNLGMRGPRVVVKWSPHKLKTKHFRMLGPLSQHHTKHSKFRSGNIREVGRGGQD

SEQ ID NO: 4403 - protein, 524 aa, Zea mays
FASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYSTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALREAGAVVPTSYEALESAIKEVFDKLVEEGKISPVTEITPPPIPEDLKTAIKSGKVRAPTHIISTISDDRGDEPCYAGVPMSTIIEQGYGVGDVISLLWFKRSLPRYCTQFIEICVMLCADHGPCVSGAHNSIVTARAGKDLVSSLVSGLLTIGPRFGGAIDDAARYFKDACDRSLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 4404 - protein, 561 aa, Quercus alba
MATGQLFSRTTQALFYNYKQLPIQRMLDFDFLCGRETPSVAGIINPGGDGFQKLFFGQEEIAIPVHSAIDAACAAHPTADVFINFASFRSAAASSMAALKQPTIRVVAIIAEGVPESDTKQLIAYARANNKVVIGPATVGGIQAGAFKIGDTAGTIDNIIQCKLYRPGSVGFVSKSGGMSNELYSTIARVSDGIYEGIAIGGDVFPGSTLSDHVLRFNNIPQIKMIVVLGELGGQDEYSLVEALKQGKVTKPVVAWVSGTCARLFKSEVQFGHAGAKSGGDMESAQGKNQALREAGAVVPTSYEALEAAIKETFEKLVEGGNITAVKEVIPPQIPEDLNTAIKSGKVRAPTHVISTISDDRGEEPCYAGVPMSSIVEQGYGVGDVISLLWFKRSLPRYCTKFIEICIMLCADHGPCVSGAHNTIVTARAGKDLVSSLVSGLLTIGPRFGGAIDDAARYFKDAYDRNLTPYEFVESMKKKGIRVPGIGHRIKRGDNRDKRVELLQLFARTNFPSVKYMEYAVQVETYTLSKANNLVLNVDGAIGSLFFGSPCRQWNVHQARD

SEQ ID NO: 4405 - protein, 384 aa, Triticum aestivum
MAAAASSPSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKTDIPLLVEKYANKEIQVDGLVTHDMPFSDINKALELMLQNRCLRCVIHMPK

SEQ ID NO: 4406 - protein, 381 aa, Brachypodium distachyon
MDAAPSAPAAITCRAAVAWGPGQALVMEDVEVAPPGAMEIRVKVVSTSICRSDVTQWQSTAQPDLFPRIFGHEASGVVESVGEGVTEFQVGDHALTVFIGECMSCKHCVSGKSNMCQKLGLERKGVMHSDQKTRFSIGGKPVFHYCAVSSFSEYTVVHSGCAVKVSPTVPMDRICLLSCGVSAGLGAAWNVADISKGSSVVIFGLGTVGLSVAQGAKLRGASKIIGVDTNPDKEEKGKAFGVTDFINPGELSEPVQQVIKRLTDGGADYSFECVGDTGVVSTALQSCSDGWGLTVTLGVPKTKPEVSSHYGLLLSGRTLKGSLFGGWRPKSDIPSLVDKYTNKEIQVDGLVTHDMSFSDINKGLELMLENRCLRCVIHMPH

SEQ ID NO: 4407 - protein, 381 aa, Oryza sativa
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 4408 - protein, 183 aa, Hordeum vulgare
SSSLQLIQYHGPRRDGFVGYHRRTLPGAQVHSWSPCQPPLQRQPRQRHNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCEESGKA

SEQ ID NO: 4409 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4410 - protein, 174 aa, Triticum aestivum
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4411 - protein, 173 aa, Triticum aestivum
APAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4412 - protein, 174 aa, Unknown
  Sequence found in Organisms: Zea mays, Pseudoroegneria spicata, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4413 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 4414 - protein, 175 aa, Hordeum vulgare
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCEESGKA

SEQ ID NO: 4415 - protein, 174 aa, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCEESGKA

SEQ ID NO: 4416 - protein, 173 aa, Triticum aestivum
APAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4417 - protein, 174 aa, Triticum aestivum
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4418 - protein, 175 aa, Leymus cinereus x Leymus triticoides
  misc_feature (35)..(35): Xaa can be any naturally occurring amino acid
MAPTVMASSATSVAPFQGLKSTAGLPVSRRSSSAXLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLKEVEEVKKEYPDAYVRIIGFDNLRQVQCVSFIAFRPPGCEESGKA

SEQ ID NO: 4419 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4420 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4421 - protein, 169 aa, Triticum aestivum
MASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4422 - protein, 175 aa, Triticum aestivum
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4423 - protein, 174 aa, Triticum aestivum
APAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4424 - protein, 170 aa, Triticum aestivum
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4425 - protein, 175 aa, Triticum aestivum
MAPAMMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4426 - protein, 175 aa, Triticum aestivum
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4427 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 4428 - protein, 174 aa, Triticum aestivum
APAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4429 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4430 - protein, 175 aa, Secale cereale
MAPAVMTSSTTTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4431 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4432 - protein, 173 aa, Triticum aestivum
APTVMASSATSVAPFQGLKSTAGLPVSRRSNGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 4433 - protein, 175 aa, Unknown
  Sequence found in Organisms: Gossypium hirsutum, Hordeum vulgare
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCEESGKA

SEQ ID NO: 4434 - protein, 174 aa, Triticum aestivum
APTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4435 - protein, 175 aa, Leymus cinereus x Leymus triticoides
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNLRQVQCVSFIAFKPPGCEESGKA

SEQ ID NO: 4436 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4437 - protein, 175 aa, Setaria italica
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 4438 - protein, 175 aa, Unknown
  Sequence found in Organisms: Pseudoroegneria spicata, Secale cereale, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4439 - protein, 175 aa, Leymus cinereus x Leymus triticoides
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLKEVEEVKKEYPDAYVRIIGFDNNRQVQCVSFIAFKPPGCEESGKA

SEQ ID NO: 4440 - protein, 210 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVTSLPSSHRAARSPARPKQLTHHGPHIKCHCSFVNSDIALGFPSPFVFLTCS
